United States Patent 10,888,096 (BIOPESTICIDES FOR POTATO LATE BLIGHT DISEASE) - sequence listing, part 12

SEQ ID NO: 51 - DNA, 378311 bp, Bacillus subtilis WAUSV36
atggcacggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaaccaacacaggatcatagccagaaatggatgtatattggtgtgctggcactcattatggcgtaataggacaaagcaggtgttttgacatcaatgcttgattggtctttttcctctttgatttcaataaaggtgatcgctttgacgattttgccgatgacagggatctttgacatagcctgagcggcgtccgggttgatattaacaagcgcagtgaataaaatagctgcagcgattgctgctgatgtcggccacataacgattcttttctttttggttcttgctgaagggctttttcaacaatgatatccaattctttaggaatctgaacatttttatattcttctcttaattgctgtaatctcttatccattaagaaagatcctccttcgtcaactgaatgcgcatcagcttcaatgctctgtataggcgcgttttgacggtattcgtgttttctcctgtaatttccgcaatttcttctaatttgaggtcttcaaaaaaacgtaaaataataatggttttatagcggtacggcaattcgtcaagcgcttcatggagatcagtatccttgtaatggtcttcctttcctttgcttaaaaattctatcgtttcgtcgtccatcactcttatctttttttgtttgcgcaaaaagtcaatggctgtccgtactaaaattttataaaaccagctttttatcgtctcagggttcctgaccgtttcaactgagctcagcgctttttttatagattcctgaacaatatctaatgcgtcatcttgatttttcacataactgaaagccaacctgtagaaatcttgcttatggtcagttatgcatgtgacaagcaacgcttttgttgtttgttttttcttcattgcaataaagggctcctttttgaatatacgtatatcgtaggctgttacctaggatagacgcggcaggctgaaaaatagtttgcgcagaatcacatttttttaaaagagagaagtaaatcagcatggggggtttatgcataaaaaaacaaggcttgttttgtacaagccttgtttttggggtaagagatgacaaacattattccaaataatgttttttgaaatctgagtgaatagaaaatttacggcgcaactggatgagatttttcccgaagctctcttctaaaagctctctatgctttttcagaatttccatgaggtacagatcatgaatgatcacttcagtaataggcatgactaaccctacatgcatcgtccatgcagcacggctgtcgttgccaagtgagacaatgcccgctactacttctgaatcatctccgctatagacaagccaccgtccgtcatactcttctgtaatttcactgctcatatcatgaaggtaaacattggcaaaatcagatacgatgtctccgtacgcaataatggtgacaataacgccttgttctgccgcctgtttgagctctgcttctatctccttaaaatcctctttccatatttctaagaggattctttttttggcagataagatacaagccttcaccttttcaagaatttcactgcggccggtgatattccagatgttttcccggtcatttgcggtctgctcgaacttttcaaaatatttctcagcctgatcaaaatgctcttccgctttgagccggcggtttttaatcagttcttttgcggggactggaacatactgaggcgtatttccatgactgacaaaaacatctccccttatgacaagactttccaatacttcataaattttagaacggggcactccggattttttggcaacggcatagcctgttaaaggtgattcttgcaataatgctaaatacgctttcgattcatattctgtaaaattgaggttttttaaaatgtctaacatattttctttcatatatcctccaatataaagagcaatcgctgccttagtaatcgctattttaacaaatcatattgatttattccaaacgcattgatacacttttataagtagttacttttgtagtcactatatgattgaggggatttttaaagggggagagaacaatgcacagcttactcgcatacataccgatcgctgccatgatggttatcataccgggggcagatacgatgcttgtgatgaaaaatacgcttaggtatggtccgaaagccggccgttataacattctcggattggcgacaggactttccttttggacggtgattgccattttaggattatcagtggtaatcgcaaagtcagtgattcttttcacaacgatcaaatatttgggagcggcatacttaatttatttaggtgtaaaaagtttttttgctaaaagtatgttttcgttagatgacatgcaatcccaagcaaaaaatatggcaagttctccgaaacgttattataaaacttcctttatgcagggatcactcagtaacattctcaatcctaaaactgttttggtgtatgttacaatcatgccccaatttatcaatttgaacggaaatataaaccagcagctcatcattttagcttcaatcctaaccttattagcggtgttgtggttcctgtttcttgtttatattattgattacgcaaaaaaatggatgaaaaactcgaagttccagaaagtgtttcaaaaaattaccggaataatattagtaggtttcggcatcaaaactggtttgagttaacacttaaatgaagtgaatgaaatttgaaaccaaagtttaatttagtgtttgacacatataaaaagacaagggagtgagtatcccttgtcttttttttatttcaccttatgtcctctgcgggtttgcaccttatacaaaataatcaataaaacaaaccagaccggggtgacaaacaaagcaatacgtgtatcattcgccagtgccaatatgacaagaatgaacgcgagaaatgcaagtgttaaatagttggataatgggtaaaaaggcattttaaatttgtttgctttcgcttcatgctgccttgtttttcgatatttcaaatggcaaatcaccgtgatgccccaaataaaaatgaagcatattgttgaaacacttgtaatcagcgtgaagacttgctcgggcattaaataattcagactaacgccaatcagaatggcgatggatgaaaagaacagcgcattgcttggcacgttagaagaagttaatttctttaatagtccaggtgcgtgatgatcctttgcaagtgaatagaccattcggcttgtgctgaataaagcgctatttgcagctgatgcggctgatgttaatacaacaaaattgatcaaactggcagccacaacgatgcctactgcagagaagacctgaacaaatgggctttcgtttggattcaacacattccaaggatagatacacataatcacgaaaagtgcgccaacataaaaaagtaaaatccggacaggaatttgattgatggctttagggatcactttttggggattttctgtttcacctgctgtcagtccaacaagttcaatacccacgaaagcgaagacgaccatttggaaagataggataaacccatgccatccatttgggaacatgccgccgtggctccaaaggttgttgaggctggcagggccggaagctgcggaaaaacctttcgcaatcaggagaataccagttacgatcagagccagtatggcaatgactttgatcaatgcaaaccaaaattctaattctccgaaaagtttaacggtggcaaggttcatgatcagcaggataataagcgcaagaagacccggcagccattgaggcacatcgggaagccaatattgcgtataaatgccgaccgccgttaaatcagccatcgcgagggaaatccaacagaaccagtaggtccacccagtgataaatgctgccatgtttcctaaatagtcccttacaaaatcaacaaaagagtggtatcccgcatttgataagagcagttctccgagcgaacgcataatgaaaaagcaaaatacgccggtgatcaagtaagcaaataaaatggatggtcctgcaaaatggatggatttacctgaacctaaaaataaacctgtaccgattgcacctccaatcgccattaattgtatatgcctgtttttaaggcctctagacaatttctgttgctggccaaaattgtctttgctagaattgcctatcaattttattttcctccagtaataaaaagatgagtaaagttttatcggatattataacatttaaaagaatagatacttttatttttaaattttaaaactattttaagtgctgttacatgtcttgtggctctatttttcactcgtgattctacctgaatagcagagtaaaacaggaaagtcatttggacaatctgacaggctagttttaatcggtaacgatttgtataattgcatacccactatgattgaggccggcagggggatcaaatcgataggatcggagataaagtttttaagcttacagattccttaacctccaatgtggattgcaaaaatgacgaagttttgcaaattgtaatactgtggcggtcacatagagtgtccgtctttttagttgtgaacgaacttaaggggttatatttgggtaatttgtcatgatctataagattcattttttgtcattgattattttgacatcattacattccccgagaatgataaactgtttactgattattacttttgaaggggactggccctccagaactgagcatctatcatactaatatgaggtgcaaatgattcaacatgtaaacatatacgcataaaagccagctttgtcaatctgctatagagacctttttaaacgtgtaaatctcaacgcggactataaagtttcgaaatattcttgttaatggcttatctaataaggacaaaggatgatagacgtgagaagaatagataaaatataccatcagctcaagcataattttcatgattcaaccttagatcatcttttaaaaatacaagggaattcagcaaaggagattgccgagcagctgaaaatggagcggtccaatgtcagctttgaattgaacaatctcgtccggtccaaaaaggtcatcaaaattaaaacatttcctgtaagatacatcccagtcgagatagcagaaaaattattcaacaagaaatgggatacagagatgatggaagtgaaagaccttcaggcgttttccggaaattcaaagcaaaatcatcaacacatttccacgaatcccctagagcttatgataggggcaaaagggagtttgaagaaagcgatctcccaggcaaaagcagctgtcttttatccgccgaacggtctgcatatgctcctcctagggccgactggttccggtaaatccctttttgcgaaccgaatttaccagtttgccatttactctgacatattgaaggccggcgcaccatttattacatttaactgtgcagactactacaacaaccctcaattattgctttctcaattattcggacacaaaaaaggttcatttacaggtgctgccgaggataaggcgggtttagtcgaacaggccaatgggggcattctttttatggatgaaatccaccgtctccctcccgagggacaagaaatgctgttttattttattgacagcggttcttataacaggcttggagaatctgaacataaacgaacatcgaacgtattgtttatttgtgcgactacagaaaatccgagttctgcactattgaaaacgtttttgcgaagaatcccaatgaccattcatattccttcgcttgaagaacgatcgcttaatgaaagagtggatctgacgacgtttttattagggaaagaagcagagcgaattaagaagaatctgagtgtgcatatcgatgtctataatgcgcttattcactctgcgaaatttgggaatgtcggacagctgaaatcaaatgttcagttagtttgcgcacacggatttttgcataaccttgacagaaatgaagttattgaactgactgttcgcgatctgcctgatgaaatcaagcaagaatggatgtccagcagcaaaaacatgcaaagaagcaaagccatttctgaatatgtcaatattacaacgattatctctccgattgtagaagatgaaacaacaaaaattgacgaagacctctcatttaacttatatcatttgattgaggaaaaagtgaaaacgcttatgaaagaaggtttatccaaaaaggatattaaccagtacatcttgactgatgtccatttgcatgtcagaagtttttttcatcatcaagcttttcaaaaagacaacctgctgacattcgttgaagacgatgtgattcaaatgacaaaacagttaaaagaaatagctgaacatgagctggattgcacatttgaccgtaagtttatttatttcttgagtatgcatattgacgcatttttaaagcgaggaaagcaaattgatgttttgaatacacaggagacagatgaaattcgtgatacccatgtgaaagaatatcgggtggcgatgatttttaaagataaaattcaggaatattttaaagtggctattcctgaaatagaagtcatctacttaacgatgttaattcattccatcaaatcgttaaaggagaacaaaagagtcggtattatcgtggcagctcatggaaacagcacggcgagttcaatggttgaagtcgcgacagaactgctagggagtacgccgattgcagcagttgacatgccgcttactgtttcaccttcggacattcttgaatgcgtagcagaaaaaatgaaacaggttgatgaaggtgaaggtgttttaatgctggtagatatggggtcgcttgcaatgctggaaagcaggctggaggaaaagacaggcatttctattaaaacgatcagcaatgttacgacttcaatggtgctggatgctgtcagaaaggtcaactatttgaatttaaatttgcatgcgatctatcaatcggtcacgaaggattttatcgagttgtgggagcgtcagccagcggcatccggcaaaaagaaggcattggtatccatctgcacgacgggtagcggaacggccaaaaagctggaagacattctaaccacgatcgtaaacaaggcctccgatacccccattcacatattgaccgtatcatcgattaagctggccaacagcataaaagaaatcgaaaaagagtatgaaatccttgcgacagtcggaacgaaagaccctaaaatcaatgctccgcatgtatctttagaagtgttaattgaaggggagggagagaagctgattcaacaggcgattacaaaaggaagcatctccttgagcaatggattgaacgaagcaaatattattgtcagggagctttgcgaggatagcctgaaaaaataccttgtcttcttgaatccccaccatgtgatcgacatgttattggagtggctgcaaaccgttcaggatgagctgggggtcattttcaataatgcggttttgatcaaagtcattatgcacacggctttcgcctttgaaagggtaattaagcagaatccgatcgctttctcagaggaagaagagatcaatgatcagctgaaggaaatggtgtacgtgacagagcgaacattagccccttatgaagaaaagctcggacttcgcataagtgatgatgaaaaattatttatagccgccatatttgctgaagaagtgcatggccagctgttttaaaaacagttttttcatatgaacctgtattaaatggaacaccattttaatacaggtttatttttttcgttttaagtgtttcaacaacaaattgctattggctgaaataacaatgaaaacgcttaacacaactgtgttggcacgatccttgcattatatatggatgtacaaaacaggaaaggagcaatagatatgatttcagttattatcagcggtcatggagattttcccatagcattaaaagagtcttcagggatgatattcggtgaagaaaataacctgattgcagtgccgtttttcaaaggggaaggaatacaaacgctgcaagaaaaatatcatcaggcgctcaaggatatcccggaagaacatgaagtgctttttttagtcgatatttttggagggacgccatataacgcggcagcttcctttattgctgaggatcaaagaatggatatggctgccggcgtaaacctgccgattctgctggaggtattaagcctgagagaacatctggctctcaaagatttgctgaacaacttaaaagcaatgagtcagcaaagctttcaagtgtgcagtgaacatttagaaaaagtaaaaacagccaatcaagatacaagagaggatgaattatgatgaacattgtgttagcaagaattgatgaccgctttattcacggccaaatcctgacaaggtggataaaagtccatgcagccgaccgaatcatcgttgtctccgacgatattgctcaggacgaaatgagaaaaacgctgatcctttctgttgcgccttcaaatgtaaaggcgagtgccgtctcggtttctaaaatggcaaaagcatttcatagtccgcgctacgaaggggtaacggcaatgctcttgtttgaaaatccgtccgatattgtatctcttatagaagcaggtgtaccgatcaaaaccgtaaacgtcgggggaatgcgttttgaaaatcatcgcaggcaaatcacaaaatcagtcagtgtcacagaacaagatataaaggcatttgaaacattaagtgacaagggcgtgaaactggaattgaggcagctgccttcagatgccagtgaggattttgtacagattttacggaacgtaacaaaataatcaaggggatgagaatatgtcttcattacaaattattttgttgttaatcattgcagcaatcaccggaatcgcaagtgtattggatgaagggcagacacaccggccgctagtggcctgtacgttggttggcttggtgctcggggacttaaaaacgggaattattcttggaggcacactggagctgatggcgctcggctggatgaacgtcgggcttgccatggcacctgatacagcgatcgcctctgtcatctcaaccattttagttattaccgctgatcaaggaattggcgaagggattgctgtcgctgttgctttagcagctgcgggtcaggcgctgacgatttttgttcggacgatcactgtctttttcatccaccgcgctgatcaatatgcaaaagcgggaaatataaaaggaattgaaattatgcatattaccgcgatggtgtttcaagctttgcgcgtcatgattcctacattgattgttgctttaattagtgtcagcgctgttcaggcgttcctgggaaatattcctgatgtcattacaaaaggactgcaaataggcggaggcattattgtggttgtcgggtatgccatggtgatcaatatgatgaatattccttatttaaagccatttttctatattggtttcttattagcggcgtttaccgattttaacttagtgggatttggagcccttggtctctgtctggcgcttttataccagcaggtgatgcaaaaacaaagcgctcacggagcagtcgcggccgcatcagacagtggcagtgttgctgtttatgatgacgatgatgatgatcttgatgcctaaacgatgagggggaagaaaaaatggagaaagaaaaacgattaacgaagaaagaaattttcagcatgtttattcgttcaaattttttactcggttcctttaacttcgaacgtgtgcaggcaatgggatattgttatgtcatgataccggcgatcaaaaaattgtacggtcccggagcgaaaagaaacgaagccttacagcggcatttggaatggtttaatacacatccgtggctgacagcgcctatatttggcgtgacggcagccatggaagaagaaatggcgaacaataaaggaattgacggaaaagcgataagcggaatgaaaatcggtttgatgggaccaatagcgggcgtaggcgatccaattttttggggaacgattcgtcctgtcttagctgcgctaggagcctcccttgctttaggaggaaacattgccggtcctttgctattctttttcttgctgaatgccataagattaagcacaaaatattacggattaaagtatggctatgtgaaaggaatggagattcttcaggatttagcggggaatcgcattcaaaagcttacagagggcgcttcgattctcgggttatttgttatgggggctctcgtgtccaaatggaccaccatcaacattccaatcgttgtatccaggattaaggatgaaagcggaaaagtagatgttcaaacggtacaaaacgtgctagatagcattatgccgggggcgctgcctctcggattaacgttattggtggcatggatgcttcgcaaaggggtgaatccacttctcattatttgcggcatctttgtcatcgggattctcgggtattgggctggattcttagcataaggtgtgtgaaggaaagagagagaaactgcagcagtcttttcatatataaatcattcggataacagtgaaacagaggagaattgccagaaacggaccagcttgcgcagcagtctcttttgaaagtgttcaaacatgaagagaggagcgaaggaacaaatgaaaaagagactgattcaagtcatgatcatgttcaccctgctgttgactatggcattttcggcagatgcagccgattcaagctactatgatgaggattaccgtcctcaatatcacttcacaccggaggcaaactggatgaatgacccaaacggaatggtatattatgctggggaatatcacttgttctatcaataccatccatacgggcttcagtgggggcccatgcattgggggcatgccgtcagcaaagatttggttacatgggaacaccttcctgttgcgctgtatccggatgaaaaaggcacgatcttttctggaagcgcagttgtagataaaaataacacaagcggttttcaaacaggcaaagagaagccgcttgtggccatttatacacaggatcgggaaggccatcaagtgcaaagtattgcctatagcaacgacaaaggaagaacatggacgaagtacgctggcaaccctgtcattccaaacccgggtaaaaaagattttcgcgatccaaaagtcttttggtatgagaaagaaaaaaagtgggtgatggtgcttgcggccggtgaccgaatcctcatttatacatcaaaaaatctgaagcagtggacgtatgcaagtgaatttggacaggatcaaggaagccacgggggagtatgggaatgcccggatttatttgagcttccggtagacggcaatccgaatcaaaagaaatgggtcatgcaggtcagtgtcggaaacggagcggtctcgggaggatcaggcatgcaatattttgtaggggactttgatggaactcattttaaaaatgaaaacccgccaaacaaagttctctggacggattacggcagagacttttatgcggctgtatcctggtctgatattccatccacagacagccgccggctatggttagggtggatgagcaattggcaatatgcgaatgatgttccgacatccccatggagaagtgcaacgtccattccaagagagttaaaattgaaagcgtttaccgaaggggttagagtggtccaaacaccggtgaaagagctggaaaccattcgcggaacctctaagaagtggaagaatctgaccatatcgcctgcaagtcataatgtgttagcggggcaatctggagatgcctatgaaataaatgcagaatttaaagtaagccctggttcagctgctgaatttggttttaaggtccgaacaggtgaaaatcaatttacgaaggtcggctatgaccgaaggaacgccaaattgttcgttgaccggagcgagtcaggcaacgacacctttaatccggcctttaacaccggaaaagaaacagccccgttgaagccggtaaatgggaaggttaagttgcgcatttttgttgaccgctcctcggttgaagtatttgggaatgacggaaagcaggtcataacggatattattctcccagaccgatcaagcaaagggcttgaattatatgctgcaaatggcggtgtaaaggtaaaatctttaacgatacaccctttaaaaaaggtatggggaacgacaccttttatgtccaatatgactggctggacgactgtaaatggcacgtgggcagacacaattgaggggaaacaagggaggtcggacggcgattcctttatcttgtcttcagcatccgggtcagacttcacttatgaatctgatatcaccattaaggatggaaacggaagaggggcaggagcactaatgtttcgctctgacaaagatgccaaaaacggttaccttgccaatgtggatgcgaagcatgacctagtgaaattctttaaatttgagaacggtgctgcttctgtcattgctgaatacaaaacaccgatagacgttaataaaaagtatcatctgaaaacagaggccgagggcgatcgctttaaaatctatttagatgatcgtcttgtgattgatgcacatgattccgtattttcagaaggccaatttggcttgaatgtgtgggacgcgactgctgtctttcagaatgtaacgaaggagtcttaattttaaaaaaggcacagacccgaacagtctgtgccttcttgttattttaacaagtttaaagattcgcggttaaatgcttccaaatcatcaggtgttctgcttgtgacaatgttgtggctgacgactacttctgcatctttgtagtttgcaccggcattgattaaatctttgcggatgctgcggtagcctgtgatatctttgccttttagaagatccgtatcaatcagtacttgcgggccgtggcaaattgcgaaaacaggttttttgttttcgacaaatgcttttgcgaattcacccggacggtcatctgcacgaagcaaatccggagagaatcccccaggaattaaaagtgcatcaaagtcacttgcatccacatcagagatggctttgtcaatctttactttctcgccatgcttaccggtaacttctttgccggcttccaaatcgatagccacaacactgtagccagcttcttcgtatgcttttaccggacttgtatattcgatgtcttcgaattggtctgtaacaagaactgcaatttttttgctcataaaaaaccctcctaataactctctattcatagaataacaggaagattgaccggccttcaaaatatttgcttaaagagatcatttttcgtgagtttcaataaaagcggcagcccatataaggactaacctattacaatgtggaaatatcaatcacaaatcgataacggacatcgcttcggaggatacgttcgtatgcctcgtccacttggtcagctccgatgacttcgattttaggttcgatgccatgctcagctgcgaaatccagcatctcttgagtttcttgaattccgccgactagagaacctgcaatgctgcggcgccccatgattagggaaaacacactgtatgtgtccggcttggcaggagctccaacgcttacaagtgtcccgtctatacgaagcattgataaataggcatctacatcgagatttgccgataccgtatttaagatcacgtcaaaacgcccggccaatgcagtgaatgtggctgggtcacttgttgcaaagtaatgatttgcaccgagttccagagcttcctctttcttattcatggaacggctcaggacggttacttctgcacccatcgcatgtgcaaattgaattgccaaatgtccaaggccacctacgcctacaatcgcaacctttttaccagggccaacattccagtgtttcagcggggaatacgttgtgatacctgcacacaacagcggactggcaacatccatttccaaacgatctggtatgcgaacaacaaatctgtcagtgacaacgattttttggctgtacccgccataagtggggtttccgtcgtagtctactgagttatacgtttgaacaacacccttcgtgcagaattgttcctctgcgttgagacagtattcgcattctccgcaagagtcaacaaaacagccgacaccaacgcggtccccgacagccaacttggtgacttttgttccaacggctgttacaacaccggctatttcatgtccaggcaccattgggaagatgccaccgccccattcatcaaaagcgctatgaatgtctgaatggcaaatgccgctgaatttaatatcgattaagacatcgtgcggccgtaatcctcttcgctcaatcgtcgtttgttcaaatttggcttttgcatgtgacacgcttaatacacgggtttgatgttgattacacatacgaacctatcctttcttcatcataagtgttgtaaataaaaacatgcacttatttatgttttatggtgtcttcaacataacgataaaccttaaagtctgctttaaggcaagggttttttaaaaaaaccatttaaaatgaacctgatttataagctgagaaacagtcagtaattaatgcagaaactgtaatcatgctgcgatcccgggatgaaagttcttcttctcttgcccaaatgtcaccgaatagaacatcatcatgaagttcagcaaactttggcgcaaattctcctaattgttctcttccggcagtgtgtttatttgccattcagcaatccctccaactacactgtttttagtgcatggagaagtatagagtttaaagtgtgctttaaggcaagtcccgaatatataaacccagattcagcagctaaccacttgttttgagcttgacttaaagttaactttaagtgttaccttcacaacatacaggatagagaggtgaagatcatgaatattgctcaggtggcaaagcagtttggcctgacagccgcaacactccgatattacgaacgtgtaggattaatcccgcctgtaaaacgaaaagacagcggcattcgcgactatgatgaagaagatatcaaatggattgaattcattaaatgcatgcgaaatgcgggactatcgatagaagcgctaattgaatatacaacattatttaccgaaggtgaccgtacggtagaagctcgaaaaaatatcctggctgacgaacgacagcggctgatagagaagcggaaagaaattgatgaaacaattaagagattagacacaaaaattaaagattatgatgggaaattgcgtgaaaatgaggcaaagctcaaaagcaggcctaaaacggaaagtcttcacggatcagtggagcaaagaaggtagcattctttgcgtgtgaagagggcaggtcaaaaacgaaggattttgtttctggcctgttttctccatcaagagatcgcataaaaagaggtggttacgattccttatttggattggagaatttgcaaacattatcggagatcagatggagaaaagcggttaatctatttacggtcataggacccgaacaaacagtgctcattttgaagctgaggaacagttgtggccaatcaatactgttcctcagcaaatcagtcattgtatgttaaagggttggcaattgaatggctgtatcaatattttttaaattcagcttgacttgttcgtcagggttccaaggatggtaccagcctttttccatcatatagcttgagagttgttcgtgcatatcgagtgcttcttccaaatggcggataaggacctcttttacttcaggcgttccggcttcagtggctgccatcgcataatttctgactccgttctttgctgaaattaataagtccatagcaatgatttggtctgttagaacattcatgccagtcagatattctatgataggattcatgatttattcatctcctcattcttgctttgcattagataaaatagaggcaaattcctgcaactggcgtgtggtgatatcaacatcttgctgcatgatttctttcagcttcggatcagataccagtgctttcattgttttagatttcgtcaaacaaagtgtcttaaatgcagtcatttcctgaacctcaagcacttcgtgtaaggcgtattccatttctgtaacctccgttttttaaggctttaacacaactttgatacaatcatccatttttgaatcaaaaatgtcatagccatgcttggcttcactaagcggcaggacatggctgacaacatctcccggatcaattttgcctgtcgatactagttcaaacatgtacggcatatagtggatcactggagcctgtccagagcgtatattgacgtttcgctgcataatatctcctaacggaaaaccgttatatctgcctccatacacacctgtaatttgtatggttcctcctttgcgaacagcttgggaagcaatgaccaatgcactcatcgttccgccatgaagctttaagccgctggcaaggaactcgagatcgctcattttaccatccatcccaacagcgtcaatgactacatccgctccgcctttcgtgatttcctttaaataattccctgtattctcatggtcttcaaaattaacgatttctactttgtttgtacgtttcgcatgctgtaagcgatagtttacatagtcaactgctatgacgcgttttgcgccttttagccaacaaaacttttgagcaaacaggccgactggtccgcagccgagaacgataactgtatcgcctttttttacgccggcattatccacactccaaaagccggtggtcatggcatcggcaatcacgcttaatttctcatcgggttcctcacaagattcagggattttaaaatgggtaaaattcgcaaacggcactcttaaatattcagcttgcccgcctggataaccgccagtttgccctgaatagccgaaataagcacccatttccccattgtcattagactgatcacattggctttccagctggtttttacaaaaaaagcattccccgcatgctatattaaagggaataattacccgatctcccttttttagtttagtcaccccagaaccaacttcttcgacgattcccatcggttcatggccgatgacatagtcttcttgcatattcggaatgaatccatggattaaatgtaaatctgatccgcaaatggctgtactggtgactttgataatcatgtcatcggatttttcaatctttggatcggggacatctttgacaacaacatttttaatgccttgatacgttactgccttcatgctgtaaaacctccagtgttagtgttcatcaggtgtccggtcaaacatccctttgcgatttgtttcatcaggaaagaggttcatattgccgaccatgatcgtgttttttgcagagagctgatccagcttatactgttcgctcagctcatatggatggaaccactttttgctgatcatcagttccgtaatctcttggtgcatcgcaattccttgcatcagctgtttccgaagcagtgctcttacatctggtgaagcggtttctgtcaaagctacagcagtattccttacgccttccttagctcgtataagaaaatccatcgcgaatgtagtgtctgctagttcaggcacattcagcgaattaatggggtctaaatgatcattattcaaagaggcttacctccctttcaattgatgattggcgttgggcggctttgagggacaggggcctgaaatgaggcacgctcataaaccgcttgtaattcagtaaggtcttgaatggattgctgtacatctttttccatcaagtccttcagttcttggtcaaacacaagcccttgcattaactttgatttcgctatacaaagtgttttaaagttcacgatttcatgtaagtcaacagcctcatgagctgccaatgtttgatgatccatattgatgtaacctccttttatcaacgttacatttcccgaaatgaagttgaagcatacagaaaatacactcggtatcattttttgttttaagaatcgctgtttttgctcgttcttatgacatggactaaactgcacttaaatctgaaataagggtgaagtatggaaacttgacatagtgctgtcaggtttctttggtatcattaaattggatgaccagtaaaagtatggttttataggaggcactcgatatgaagctgttacaaattagactgttggtgaatgattttaagaaaagcgtcgagttttataaagattcattaggacttccaataagttggttagagaatgaaatggaatatgcactctttgataatggggaaacgaaaatagagcttttatctcgagaaacgatggctgaaatcgttggagaggaaaaaaagtccttggaaggagaagctcaatcaaaatttttgcttcagtttaaggtagaagatgttgataaaacgtatgacgatttacacgaaaaaggagttaaatgtgagaataaaccgcatgatcgcaaggaatggagtgcccgagttgctcacttcagagatccagatcataatctgattgaaatatataaaatgttatgattttttgactcgcaaaatcatagaataacgtttgataacgtacctaatcatttttacacgccctggtaaaagaaagcaaagtcataataggttgcggacactgaacttgcagcatttacgctgatttgtatggtgtccgtttttgattggtgaaaaaggtggagtatctatgaatcgagaagaagcgtggatacaaggaagcagtacactgattgagttaattggtggaaacgaagccgcttgatccatgtcctttttcctgattgtcaatcgtgattaccgactggacaaatgattaagagccaaatgtaacacaccatcaatatcaagcctgactaccatttattttgtatccttaattgtcgaaaacataggaataattccacttttgaaagatctagtttatggtacattgataaatatatgggaggggagggggcatggtatctgaaagtaaatccttaactggatgtaagaaagtcaaacgtacggcatttataaggggagggtataaggtgaataagttaaagaggctaagtatgctaacggtgatgattgcatctgtgttcattttttctagccatgcacttgcggctcagtattatacggtttcaacaagcagcggtgctcctgtcaacatgcgcagcggcccaggtacaagttggggaattgtaacgaccattccgagcggaacccgcatcccgatctattgctacaaaaccggtacaactgtaactggaaagtatggaacgagcaatatttggaattacacagagcggacgcttgccagcggggagatcgttcctggatttgtctctgatacatatatgtatacaggctcagacggtccggttgttcctaaatgcagctggtagcctatgttctatcgtttcttaaaatgaaggaattgaagaaagagggatgacattgactaaactgaaaatgctgagtatgttaaccgtgatgattgcatctttattcattttttccagtcaggcacttgccgttcagtactttactgtctcaacaagcagcggtgcgcctgtcaatatgcgcagcggtcctggtacaaattatcctattatgctttccattccgagtggctcccgtgttccttattattgttacgcttatggaacgactgttacagggaagtatggaacgagtaatatctgggaccaaatccagtggaaagattcccggggtgtcgtgaatattggatatgtgtctgacacatatgtgtacacaggttcagacggccctgtcggttacaaatgcaattagctaaatactccgtacaatagaatctcttcttaagggcctatctaggacgaaccataccaacaacaatagttggtatggtttttgctgcgatgaagtcttccatacctgcatttgtggtgattttcaaaagagattcatgatgttagacactggttgttgttgaggacaaaataacgagccgctttagagttgtatctaatggtataaaatacggaattaagataggaaataatcaataggagaacgtaatgtacaaacctatttttcgatgaaatccctaatatcactttggttaaacatctcacattgcgttctcgttagtgaaaagttctttttacgcttcgtgaaatcttctccaattccatagttagtttcacctgtcctattttgaaaattttaatcaatccttaacacgtatgtttcttttctttttctaacatgtcgtgtaacctctcagaaaattctttatggtacattgtgtaccccgtatgatttccggggaattcaacccattctgtttccaattgttccgctagggcgttcgcgcaacgataaggaaaaagctcccgagaagcacttccgccagctgggagtatcttcatcggtgaagatgtaaacacagtttttaatgcttcgaaatctaatgtatagctgagaattccttgaatttcatactcagtgaaatacgttgaattgccgagaagccgctttgtcaggacagcctttgattgttcgtctgtctctaatcttgacattaatttaatgacttcacttcgatgatttttcttaaggtcttccatgaattgctcggcttgtttcagctcatttccatgcagaagctgcaataagattggttcgtgtgggatcatgacatgtacttgttcgggatggcgtatgcacagatcaagcccgataacagccccggagctgcttccaaatacataggccggcttattggtgattttggctagaagacggtgagcatcgtcactgtgtgtttccacacggtaaccctcaatctgattggcgagattgctgcgggaatggccgcggcgatcataagtaataaccgtgtaccagttagccagatgattggcaacatgatggaacttgtcggcatcaccgcctcctccgtggaccaaaagaatgattggaccagagccacgcacctgatagtggatgttcgcgccgggtacttgcaacgttccattgtttatcgtcatttgtaggaccttcctttcttctcatctcccttaactttacacaattggccaatggtatcatatgcaggaaataactaagaaacaaactcgccatataaaaagcactgattattttttatcagtgcttccgttttgtttatttagagtagacaattttttttattgtttcaatagagaggtgatattcatcagataattgatgaatggttttgccgtttttaaatgcttttttaatagaagcgtttctgtcatcgatcagctttcttgttcctgaacacgcaccccatttttgatgagaggattcaggtttagggatatatattgtttttccttgaacatacttttgaatttccgatatcagcttttcaggtaaaatagcggttgcttttacatatgccatttctgccagctccttatttttttatgtcaaataaggtgcaaagccactatatcagaaaagcttacttgggcgatcttttagaaagtctaccccatgcaaagtatcgccttcccaatagtaggctttgcatgggacgttgcggaatctggcattctcatcttgcttgccattacatcacctccctaacgattttcgatgatcacttccattataaaatagagtaaagccttatggcatcttgttaatgaaagttgaagcagtatgaaaatcaagggaccttcccagtgagaggggctaaggctgattggcaatgaatagagtaagattcaagctatattactttagattcaaaatattgacaaattgatgtattttcaacaatagggcagtttcttcatgtatactgagtctgtatttacaatatttagaaaggggaagtgaaatgaaaatcagtatgcaaaaagcagatttttggaaaaaagcagcgatctcattacttgttttcaccatgttttttaccctgatgatgagcgaaacggtttttgcggcgggactgaataaagatcaaaagcgccgggcggaacagctgacaagtatctttgaaaacggcacaacggagatccaatatggatatgtagagcgattggatgacgggcgaggctatacatgcggacgggcaggctttacaacggctaccggggatgcattggaagtagtggaagtatacacaaaggcagttccgaataacaaactgaaaaagtatctgcctgaattgcgccgtctggccaaggaagaaagcgatgatacaagcaatctcaagggattcgcttctgcctggaagtcgcttgcaaatgataaggaatttcgcgccgctcaagacaaagtaaatgaccatttgtattatcagcctgccatgaaacgatcggataatgccggactaaaaacagcattggcaagagctgtgatgtacgatacggttattcagcatggcgatggtgatgaccctgactctttttatgccttgattaaacgtacgaacaaaaaagcgggcggatcacctaaagacggaatagacgagaagaagtggttgaataaattcttggacgtacgctatgacgatctgatgaatccggccaatcatgacacccgtgacgaatggagagaatcagttgcccgtgtggacgtgcttcgctctatcgccaaggagaacaactataatctaaacggaccgattcatgttcgttcaaacgagtacggtaattttgtaatcaaataagcagtgaggaaaagaaaccgctgcagatgaactcaatctaaaagataccaatgatgttggtatctttttatttgcagtaaaaagtattcaattttctctataatgattatgtcatgcttgaggcagatacatgaaaggaccttggcgatttcataaaaaacaatatagaggcttttttaaagccatgcaagattacaatggatctgtgcaagaaggcgcattcaatccatctattaacgatggaaaggggggaggctttttgcacagtccatctacatcatttgatagtctccatgcgtataaactgttccgtccataatacgtcgtgcggtacggacgatctttataccagtgggctccaccattgtttcaataataccagaagaatgagctagccgaacctttgtagagtggttttttgctattcttgcagggattgcaccttccactgaaagggctcttgttgtacatatcgctccagtgacagccagtgcttgatgtggcttttgcatggacatcatcctgatgtgtaagtccatctcaacgcttgaatgccaagcacctgtactatctttatatttctctggttttgctactatagccagtttggggacagccggcgataactttgtagctgaaaatcgactggcaaagccgcatttctctgccgcaatggatcttaattcttcaaattgagccaactgtagatcagtaaattcttctgcaagttccgttccatccaggccgatactgctcgcttccacaaaaactaatggatttgcatagtcgataatagacacctctatttggccttgacttgtatctaaaaactccgaactatttccagtaggcaataaatgaccggtaactgaaccagcggcatcatgaaagtttaaatagattggagatccagatccaggtactccagatatcgtaacatctccgtcatatttgacctgaccgtcttccacttctacttccgcaatgatcattttattcgtattggtattcaggatccttaccgcagtcattggttctttcgcttttacaagtccttcttcaatagcaaatggaccaacagcagcggagatatttccgcagttccccttaaagtccaccttttcttccgaaatgctgacttgaccgaaagtatagtgaacatcaatatccgaagtatatgctttctttattattgccactttactagtaagggaattaccgccacccaaaccatctatttgtcttttatcaggacttcccatgacatcaagcaaaaagggctcccattcgtttttattgttaggcatggctgattcgtggaaaaaaacgcctttgcttgttccgcctctcatgattgttacattcgtcttgaccatcgtcatcatcctcatcttaaaggtagtattttttatgttttttagtgtagaaggtaaaaaataaaataaaatataagttttcttaatattcgataaaaaaacttttataattgtgaaagaaggactagaaaggaagatgaaaatggatgagaaagattggattttattgaaaattcttcacgaagaacaaagtgtaacaaaaacagcagaacgattatttacatcacagccttccatcacttatcggttgaaaaagattgaggagattttcggaattgaattattcaccaaaaggcataaaggaattacctttactgcggaaggagaacacttggttgcttatgcaagaagaatgctacaggaacttcaagataccaaagatcatatctctaatctaagcaaagaggtgcaaggacatctaaggctgggggtatcaagcaatttcgctcaatataagctccctaagttattaagggaattttccactatgtatcctaatgtccaatatagtgtacaaacaggctggagcacagatgtcatgaaattattagatgctggtattgtacaagtcggtatactgagaggaagccatcgctggaaaggggtggaggaacggctgacacgggaaaaattacatatcatctcaaaaaaaccaataacgatagagcaacttcctttttaccttttatcaaatataaaacggatgcttctttaaaaacgattatagaagattggatgcatacgaatctaaaacaagcccccattattgcaatggaagtggatcgacaagagacttgcaaagagatggtaaagcatggtcttggttactccatagcaccagaaatttgcctgcaggaatctgatcatttgtacacaatggaactgtataatgctaagggtaagcctctaatgagagatacttggctaatgtacgatcaaaaatcattaggaatcaaactcgttaaagcattcattgattttttaaagggtgaacaaatggtaaccatttaaagttatgatagaattttttttgaaacacagtaaaaaaatatttatttaacttattacaccgtataagatatgttaatcaaaagtcatttgaaagcgcattcttggaggtgtaatatgcttactattttaggtttttcgatggtaactgtttttacaatattaataatgacaaagaaagtctcgcctattgttgccttgaccatcactcccattgtttttgctcttattggaggttttggtaagggtattggcgacatgattttagaaggaattcaaacagttgcaagttcagcggcattgctattgtttgctattctttttttcggaattttaattgatgcaggtttatttgatccgctaatagaaaaaattttatctatagtaaagggagaccctgtgaaaatagcgatagggtctgccgtcttggcaatgcttatcgctttagatggggacggtacaacaacctatatgataacagtctcagcaatgttacctttgtataaaagaattggtatgaatcccatggttatggcgacattagcaatgctgtcgttgagtatcgttagcggaatgactccatggggcggaccagctacaagagcgatttcagtgctgggtttggatccttcagatttctttgtgccattacttccgaccatgcttggaggtattgcttgtgtgatatttctggcttttctaatgggaaggaaagagaggaatcgaataggcatcgttcaattagagcctagacatataacaaaggacagctctcaatcttatatggctgctactttggagagcgaacaattgaaaaggccacgcttaatatatcttaatttattcctcgttataagtatcatggtgtttattgtgcttggaactaagcatccgtcagttttatttttaattggttttgttcttgcccttactataaattatccgaatgtaaaaatgcagaaggagcgaatcgccgagcattctggtaatgccataaccgtggtattattggtattttcagcaggagtatttgctggtatattatccgggacaaagatggtggatgccatagcaggatcattaatatccatcatcccctcatcaatgggagggtttttccccgttattgtagcactcactagtattccgtttacttttgttttatcaaatgatgcatattactttggtatggtacctatctttgcagaagctgcctcagcatatggtatagaaccagtagaaattgcaagggcttctataatggggcagccggttcatctgatgagtccattggttgcgtcaacagtattgctagtaagcatgcttaaaatggacttggggtcatttcaaaggtttgccgttaagtgggctgtaattacatcattagttattacgttgttagcaatcattacaggggctattactattttgtaaagaaacaataataatatttagactgccaatgaatcattagtttgattgatttaaatacagctgaaaggggtcccaagctgatcaagccagttgtctttccagttactctattgtttagggttcttttttaagcggcagcatttttgtcgatgtttagccagcattttcagcacgatgtggaaaagacaagagacaaacatgctcttgtctttcttaatatgatagttcagtataaatatttaagaaaaatgtcagtattgagtaatgaatgtatcaccaggcgtatgcctcaggtgtctctcctccaggtccgggaaagatatcatttaacatgcggagaatctccttatccagactgatttcaacggcttttatcgtatcacgcagctgctcaaccgttcgtggtccgatgatcggcgcagttaaaactggatttgccagcacccatgccaaagccacatttgcttctttttctcctagttctttgcataaatctgaaaatttctcgagttgcaaacgatgtttttcaattaaatctgctctttttgctgtacgagttccggcattgcttttcaatgccttcccgccaagaagccctcctgcaaggggactccacgccactactcctaaaccaagatcccgtgcagccggcagcacttccatttcagctgttcgttctaataaactatacttatgctgttcagtgacgagtcccatgaatcgccgtttttcagcttcagcttgcgctttaactaaatgccagcctgcaaaattactggatccaatatagtctactttgccggagcgaacctgagtctcaaaagcttcccatatctcatcccacggtgtccgcctatcgatatgatgcatttggtacaattcgatatgatctgtctgaagccgcttcagtgatccttccagatgacgtctgattttgtatagagacaagcccctcatatcatttggtccgtcattcggatcagaaatcggttcatatacttttgtcgccagaacaactttctcgcggcgctgtcctccttgtgcaaaccattttccaatgatgctctctgtcaatcctgcgtttttgccccagccgtaaatattggcagtatcaaaaaattgaatgccgttatcaagtgcttcatccatgatacggaacgcagtcttttcgtctgtatcaactccaaaattcatcgtgcctaaacataaacggctcacccgcaatcctgttctccctaaataggtatactccacaacaaacctctcctttatcattatttttggcaacagctgcaatacaattgattcaacaattgtttgctctttgttacgattaaaaagacgaagcaaatgtaaagcagacgcaaaattataggaggttttttcaaatgaatatagaggatctatgggatcaatttcatcagccgttaaaaacatatatttcacatagggttaacgatcaatctatcgttgatgacctcttgcaaatcgtatttatgaaaatacaagtgcatctcccaaatctgatcgatgaacaaaagatcgacagctggatttatcggatcactagaaatacgattattgatttttaccgtacaaaaaaacaagcgaaatattgcctgatgttctacattttaatgacagtgcagaggaagaaaatttcaccaaggaagcaactgtgtgtattcgatcgaccatcaaacggttgcctgaaaagtatcgagaggcgctcgagttaactgatttccaggggttatcacaaaaagagttgagtgaaaagctcggcatttcttactccggagcaaaatcaagggtacaacgcggacgtggaaaattaaaacagctgcttgaggggtgctgtcacattgaagcggatcgatatggaaatatcgtagactttcgtattttaaaggaataactgatgaacatagtcagttattcctttaaaataggccatccgcatgaagagcatttttcctttgatgtttgcaagagatgtatgtataataaatcgtaatgttttcgatttaataaaaaaggagtgttggaatgaacattttattttcaaaacggctaggcatattaacgattggttcattactagttttggcaggatgtcagacttccggttcttctgcaggtgagtctaatcaaacaacatcatcctcagcagttgaagaagactcttccaaaacgcaagagcaaacatctgacagtcatacacacgaacattctcacgatcatagtcatgcgcatgatgaagaaacagaaaaaatatatgaaggctattttaaaaacagccaagtaaaggatcgcttactttctgattgggaaggagattggcaatctgtatatccatacctgcaagatggtactcttgacgaagtgttttcatataaatcagaacacgaaggcggcaagacagctgaagaatataaagagtattataaaaaaggctatcaaacagatgttgaccgtattgtaatccagaaagatactgtaacgttcttcaaaaatggaaaagaatattctggtaagtatacgtatgacggatacgaaattctaacctatgatgcgggcaatagaggggtaagatacatattcaaactagctaaaaaagcagaagggctgcctcagtatattcagtttagtgatcatagtatttacccgactaaagctagtcattaccatctctattggggggacgaccgtgaagctttacttgatgaagtcaaaaactggcctacttactacccgtcaaaaatggatggacacgatattgcccatgagatgatggctcattaaatgatgattactctatgaaagttgttctgccatagccattttttctgtggagaattgatagaatggggaaaaaactgattgagaccattcagtatccgccatattattgtgacgtggcataccttgagtcatctcacatgaagagtagaagaaacctatttcaaaataaaaaatcattggatgtatggcagtggattacgcttgaaatctattggcttatatgaagcaaagaagagaacccaaaaaccgcaaagcttcttcaagaaagcttgcgggtttttttatatgtctaagcctcgattcatctcaccataaaaatgcatttcaactttctcttttgatcgacaatagtccataaagggaagaataattccctcacaaagaagtcgtggcagtaatctccataggtgtgtttgcatggcccactttaatggttttgtttaaatctaataaaaaacagacgccataaagatttcttatggcgtctgatggatatgaggtaaggtgtgttcttaatagccaccaaagaaagatgtcccaacgatgattaataggatgaatagaactacgattaatggaaatgacctcataacatcaccttccttaaaagaggatagtacatgatatgcagatcgagcttattcgatagtgatgctagtttaattgatgtaaaaatatttttaaggctggactgctaactgatctttattagttattggatcatacttatgattttggaatgaatccgtttcaaagtgatgtgttgttctcggccaatcgttggctaatcttcctgatgcaatcgagctatatgaagccatccctcttttatgaaagtacacccaaaacttctctctcttgcagacccttaatcatttgacttgcatatcgagcgtaagcatgcctcatctaaaaataaagtgcaccatctgctatttgttttaacatttttaagacagtgatgcacaccttttgcgttgagcaaatggaacaggttcagaaggggcgagctgcccttacttcacccagataaaagacggggatagacggcatgtaccgaagctaactgaaagttaaattgaaatgaaaaaaggggcatgttaagccccctttaagactatcgagagcttctcaatagcctaacgcattgtatgtttaacatgttttaatttttgacaacggataaactgacactgttgcctgagactgttactttagcgaagtcttgtgtatcaattacaggtgttattgctttgttgtcgatggtgatgtttgtaaaagatgttgaaaagtttgatttgatagattggcgtgaccctgttgttgcaactgtagcgagcgctttccattttgagatggagccgacatttgttttgctgatttctgaaatgagacggccgttgtatccggcattgttcgtgccccagtatgtagcgcgggtattgccgttaaggtttttgtagatggtaagttgtacggtgctgccgggacggaagcctttcgtattcgtgaattggcttcctccttcgaggtactgaacctgatcctgtccttttgaaccgactttcatatatggtttccatacattatatttatcactgtactgaaacccgatatcggattctgtgcctccgctaaaaccagagtagatgtaggctgtcccatttgaaacctgagtggagctaggaagctggattttcgtaacaagaatggcaccattactgttcaagtaagccctcccgccgattccatcagttagctgtgatgcagcttctgcggtttttggactaataatacccggtacatctactgcacatgtgccaaaaagcacggttgccgtaagcgcacccgcaagcagaccttttttcatcatcattatttccccctatcattataattagaaaacgctatcatcttgtattataaaacattatgaaaataattccataataaacatgcacatagatacagaatttacacattatgactttgtgcatctggcaaacggtcgattcgcaatcgtgaaaaatctcctgtgaagtgtaaatgttacgataacttttcaatcgagacttgtgttttattgaaatagaaaagctatagagaggggggagaaataagaggggaaagagagaaaacactgtaatcagatatgtgtgtataactcaattgtttgttagaaaaaaagtgggctttttaagcccgcttcttagttcatgtttctcttcaggagattgtctttttcatttacattcaatgtccaacatgactcctttgagtttcatctaatatttcaaacaatcttttgtactttgatatgacttcttggtccacaattttatggccagaattgaaaaaggtgattgagcccgatcctttaccaagctggttacgatctgcaagaacttttttcaactgttttgcagtaccgacactgcctgaaatcatatcaacttttatcccaaacagtttttcaaaactgtttttgaaaaacggaaaatgagtgcatcctaacacaatcgttccatattgtttcagatcaaaagaagatagttcgttctttagatatttaatgattttgtcttcactaaaatcaaagttctcagcaaattcaactagtcctggaagagctaagcaatcaacaaggtcatggtgatcaatttctttaactagattatgaaatttctcttctttaagcgtcaaattagtagcaactaccagaactctttttctttcctctgtacatttatttatagcaggctttacagcgggttcgattccgattatcggaaagtcgaagtttctccgaagatcctctatcgcaatgctagtagctgtattacacgcaataacaagagctttgatattttgactggccagaaattcagctgcattgaaaatatattctttaactttaccctttgatttttcaccgtatggaacgtttaacgtatctgcataaaaaatgtaatcttcataaggaagaacttttatggcctcatacaatacagtcatgccaccaattcctgaatcaaaaaatcctattttcatcacttctcacgctttctgtctcattctttttttatcatatgactttatatcatctgaatcaaacgaaaaagaaccattttactattcaaatttaatatgggagctatcgattattcgaatagggagcaaaacttgagaaggggagataagatcgaaatgttggtaatgtattgtggttgtggtgaaattatcaagatcgcatcgtatcaatgtgatgattgataacccgattcaaattagctttgaaaatgtaggagtatttagatttccagagtcagtggatgaaattacgaaaaaaaaagcaaactgcctgtcaaagtttgctttttgctctatcaatgaggtgcgcctatatttttatatcctcttggcaaagctgatttaaaagctgcttaaccgaaatttcctcagtcaatgaccgtatcccttgacctgcccataaagacatctgatcatggttattttgaagtgaagccttctgtctcattgccttcgttagtgtattttgataagggtacggaagggtttgtgtctcaaactgttcattttcttccatccatttatttacgattcctctggcctctttacctgaaaataatgtcgtaagctttgtatctgcttcgtttgcttctagtattttctgtttatgcactggatgtgcgttactctcgtgacaaattaaaaaggcagaaccgatttgaacgccttgggctccgagggttaaagctgcttttactcctctgtggtctatcattcccccagcagctatgacaggtacgctcagtgcatctgctgcttgtggaatcagagccattaaacctacggcagattcacctttggaaggtaagaatgctccgcgatgtccaccggcttcacttccttgaaggactactatatccattccccgttcttccattaacaatgcttcttctactgttgaagcggttcctattaaacagcatccagcggtttttagctcctttactgcgtcttcaggcggcagatcaaaagtgaatgagcaagccttaaccttgtattttaaaattagatcaattttttgatagaagtcatcccactcttcttgtacagatgtgaattgatttacttgattagctaacggtatgttttctttccactttttaatctgatcttttggtggcatctctagacctagcggaacaaacacattaatttgaaaaggagcgtctgtcagctcaaatatttcttttatttgttgttctaggaggtctggcgtaagataccccgatgctaagctgccaagagcaccttgattcgaaactgcagatgcaagtcggggctttgtaataccgccagccattggagcttgaataatcggttttgttaaagaaaactttttcataaattcattcataccgaatcctcccgttaagacatgatttttgaaaaaagtgtcattttaaaatttactcaaaaactcgtattcgcttaaatatatcgttttccttctttttgtcaatctctcataccagttaacatgtcgataaagcaggggggattaaagtgtgtcaaagatagtgtcgtcccatggcggctctacaaaaaactgaatattcatgtagtccgtcatagttgatatctgattttgagatgtcttgcatcttaatattgaatgatatataggagaacatcatgtaaaataaagcttagaagaatacatcacattcaagagtaaaaaaatctataagacgttttacagttagatattaaggctgaaacggaggaacatgtaatgcgaagtgagcaggaaatgatggacatttttttggactttgctttgaacgatgagagaatccgattggtcactttggaagggtcacgtacaaacagaaatatccctcctgacaacttccaagattatgacatctcgtattttgtaactgatgtagaatcttttaaagaaaatgatcagtggctcgaaatctttgggaagcgcattatgatgcaaaaaccagaagatatggagctttttcctcccgaattaggtaattggttttcatacattattctttttgaggatggcaacaaattagatctaacccttattccaattcgtgaagcagaagattattttgctaataacgatggtttggttaaggtattgcttgataaggattcgttcatcaactataaagtgaccccaaatgatcgccaatactggataaaaaggccgactgcaagggaatttgatgattgctgtaatgagttctggatggtttcgacttacgtagtaaaaggactagcaagaaatgaaatcctttttgccattgaccatttaaatgaaattgtacgtcctaatttattgagaatgatggcctggcatatcgcatctcagaaagggtattcatttagtatggggaagaactataaatttatgaagcggtacctttcaaataaagaatgggaggaactcatgtctacatattctgtgaatgggtatcaggaaatgtggaagtctttatttacttgctatgcattatttagaaagtattcaaaagctgtatcagaaggtcttgcatataagtatcctgattacgatgaaggtattactaagtatacggaaggtatttattgctcagtaaagtgataagaatataggattgtcttcatatgatatttgattctcgctgacaatggagaccaagtagtcagatgtttgtaaaaagatgcgtaaatcgttacgtttaagaatgtctacgcattttactatgattattcttgtccgaaatttttgttctttttaacgaaaggaggcattataattaacctataagcacattgaaaaaacaaaagaatgaaaaggaggatttttgtgtttcaaaccttagaccattttttgaaatcttgggagttcgaagcagatgctacacagaaactattaaatagtctgactgatgaatcacttaaacaagaaataacttcacaaaattggactctaggccgtattgcttggcatactgttgctgccattggcatcattacctcaaacacagacttaacgttccaagccccagctgaagattatcctgttccaacttctgctcagtttatagctgacagctatcatcaagccagtaatgcatttgtacaggcattaaaaacccaatggactgaccatacacttcaagaacgtatcaactttattggacaacaaatgcctaacggttcacttttgatgtttttaattcaacatcaaaaccaccatcggggacaaatgactgttcttatgagacaagcaggtttaactgttccaggtatttatggtccagcaaaagaagaatgggcaaaatttggtttggaagccccgaaaatgtaattaacctttttataaaaagttacgctatgacaacatataagaagatgttttgatcaatcttttttcaaaacatgttcttttttgttcgtttacaatgataagaacatattcgaatcatttttattccaaaccacttcaaatgacaacgttcttccgctttattgttggcctgttcccaacgatgtaagtataatttttaatgctgtcaaatcttcgatacacatatctatagattcctctctaacaaaacccccgctttttctgccatcactcgaggtggggaaggcatttcatttttcaaccaccattcgactactcctacgtatgcatttgcaacaaattcagcagcgatcgatggttcagaaattccaatgaaacattcaggtgttgctcaatttttgaataaaagcagctgcgccaaaaggaagcctattggaagagtctagctgagttggaacgtcttctcaaaagggaaggcaatttatttactgtaattcatacaatgagtaaagcctcccaggtataatctttacttcgttcgacaaattctgcaaattgtagacaacttcctgattatttggataattaactgaataggaggggaaaagttgtcatatttcattatacttatcatcgttctattatcggagcattggtaacagcagcagtcggtatcatctcttcaaaagtagaggtaatctcgccgaaaactacaatagaatctaaagaggaagaacagaaaagtttttatacgctgaaataaagcagagaaagagcatctcctgcgggggtgttttttatagaggagttggaaaaactgaatcagactaatttacttttaagattcacccttgaaattgctgcactaatctccttaggggtgtatgcttggataagctttaatggttattttaaatatgttttaactttggttttacctattgcagttatgattgtctggtctgtatttgcagtacctcatgatcctagtcgaagcggacaaactgtaatagctgtaaacggagtaacaaggttagttattgaattattgatctttgcaatggctgttgcagcgctttattttagttatttaaaaccagttagtattgtctttttatgtcttataatactccactacatcatttcagctgagcgtatcaaatggcttctaaatcaatagtttttcatttcagcactcgttattagagtgttttttattattctctgtagagccagtgattctcagattagatttgaaggttaacggcttgggcacagttgcagtatagaacgcattttccaataaagaaggcgctcatttgaaattcatcattaaacaattgtacaaaagtaaaatttgtatttagaatgtagtaataaatagaaattctacgtaggagggtatcttgtggaagaaaagaaagctttaatcattgtggatgtacaaaaagccttcgatgataaaaaatggggggaacggaataacgtaaaggcggaagaaaacattagtaaaatactagaattatggagagaaaaaggatggacagtcatatacatacaacacacttctgataaacctcattctttattccatccaaagaatgaagggtttgcaataaaggaaatagttaagcctatggatgaagaagtcattataaccaagacagtaaatagcagctttattggtacgaatttagaagaattcttaaaattaaatgaaataaccactgtagtcataactggtttaaccacgcctcactgtgtatcaaccaccacaagaatgagtggtaatttagggtttgatacatacctgatttcagatgcaacagcagccttcggaatgagagaccaaaatgatacatattatgatgcggcgactattcataatatatctctagctacattgcatgatgaatttgccacaatattgacaactgatcaattaataaatgattttataaaaactcactgatgaaaaacattttggcacagtaaaacggcaggcgcctttccaataggaagggcgctttaattcgatttcctgctttactgctcagaggaggtgcatcaatgtttctttatcgacaagcaagagcagatgaagtaagcaaagtggcaaagctattccatcaatctttcaatcaatatccttttatggatttactcgtaaaacgcgaaaaaaagatcattcatttatttttgaaatgcataaagtactgacaagagcatattttaaaaagcatttcttttttgttggcattcagaatggtgaaatggttgttgccgctctattaaaacatcgtgataaacccgacattaaacttgatcgattatatagcagcaggggggataacattaatcaaaatggggctaaaaaattttccaaatccttaaaagagccggcatagaagtattaggagtttcgccattttatcagggaaagagtttaggcagcaaaatgattaatgactgtctcatatcttttatttcaaaatgcggggacggcattttggcccttatcatgaatactgatctcaatggatcattttacaaatcgtcctgattttatatttaaagattatcataacctttcaaagatggaggtcgaatgaatgtcttcaaaagaaaaaagagtgtaaccattttgacggaaagtcaattgtcttcgagagcatttaaagatgaagcgtatgaattttataaagaattgcgaaaatcacaggctctctacccattatctttaggagctctggggaaaggctggctcatatcgagatatgatgatgcaatacatttattaaagaatgaaaaattaaagaaaaactatgaaaatgtatttaccgcaaaagaaaaacgtcctgctctattgaagaatgaagagactttaacaaaacatatgcttaattcagatccccctgatcacaaccgcttgcgaactcttgttcaaaaagcatttacgcatcggatgattttgcagttggaagacaaaatccagcatatcgcagattctttattggataaagtgcagcccaacaaattcatgaacctagtagacgattatgcgtttccattgccgattatcgtgataagtgaaatgctcggcattcccttggaagatcgtcaaaaattcagagtatggtcgcaagcaattattgatttttcagatgcccctgaaagacttcaggagaatgaccacttgttaggggagtttgttgaatatctggaatccttagttcgcaaaaaaaggagagaacctgcaggagatttaatcagtgcattaattcaagcggaaagtgaaggcacacaattaagtacagaagaattgtactcgatgattatgctgcttatcgttgcaggtcatgaaacaaccgtaaacttaatcaccaatatgacatatgctctgatgtgtcaccatgatcaactagaaaagctccgccagcagccggacttgatgaattcagccatagaagaagcattgcggtttcacagccctgttgagctaacgacaattcgctggacggctgaaccgtttatactgcatgggcaggagattaaacggaaagatgtgatcatcatttctttagcatcagcaaaccgtgatgaaaagatatttccaaatgccgacatatttgatattgaaagaaagaacaaccgccatattgcttttggccatggcaatcatttttgtcttggtgcacagctagcccgcttagaagcaaagattgcgatttccaccttattacgccgctgtccaaatatacagttaaaaggcgaaaagaaacaaatgaaatggaaagggaattttctgatgagagcactcgaagaactgccgattagtttttaatttttaggggatatgtgattttcaaacatatcttgttttactcctcaattagattaaacgatagtaaaagctgtaacataaaaatttgatatgatagctttttaaaaacaaagtttagcattatttatgcctaccgggtatgaagatgtcttgcaaacaccaatagtttcatcctatcggtgttttttatttgttttcagcctcatttggacaaacagctgttacatagtaaacgtttgttaagataaaataatggagggcatagtttctaatgagaaaaataataatagatggaagagactttgaaaatatagaagttttacatgatgatttaaaagataaactagacttcccagactactatgggagaaatttagacgctttatgggattgcctgacagggtgggtggatttgccgctcactttagtcttgaaaaattttgagttcagcaatacatttttaggttcatacgctgacgatgtattagaagttatacaagaggctcaagaagaactaaaggacgaatttaaaataataatagagtagactttctgttttgcgaattttaacaattttcgttcgcggaaaaaggcaatagggcaccgcaaattcaattttcggtgagaccgcaataactttttggcttctgataagtttcttatgatgttggtatcaagtcacacaagtacataactctcccatgacttctttctgatgtaagttaatttcattatgagttaatcgcgaggataattttattctgtgaataatactttaaaaggatttaaatttaaataatatttgattaacgaataaaaattcgttattatttaaattgtatgaaatataattctgttaagttgtattgggggttgtgaaatgggtattatgcttgacgaaactgataaggccatcttaagagatttgcaggaagatgcttcaatatcaaatttaaatttatctaagaaaattgggctttcaccatcagcttgccttgcaagaacaaagaacctagtagaagcaggtataattaaaaagtttacgactattgttgatgagaaaaaacttggaatcgaagtcacagcactagctctcatcaacttatcacccttaaatagggagacaattcattcatttttagaggatataaacaaattcccacaggttcaagaatgctacacacttacaggaagccatgactatatgcttaagattgtggcgaaggacatggagagttatcggaattttatcattgattcattaatgcagaatcctgctattagtggagttgacacaagcatagtcatgagtacagaaaaaagaactgtcagtgtgccaattgatgaaatgtaggaggttgttgatttgaataaaaataaagaatcgttacatttaagctctcctgctataaacactcatatgaataagagaagtcaaatatgggctgcatttcgttctgcattcccatataccattccgatttttgcggggtttttatttttggggatagcttatggaatctttatgcattctttgggatttagcgcaatctatccaatcatcatgagttttatgatatttgcgggctcaatggagtttgttgcagcgaattttttacttggtgcgttcaaccctatgaatgctctttttttgacgttaatggtcaatgcccggcatttgttttatggaatttccatgttggataagtacagggggactggaaagaaaaagctttatctgattttcggaatgtgcgatgagtcattttctatcaattataccgctaatgttccggcgaatgttgacaagggctggtttatgttttttgtgacactgcttaatcatttatattgggtcgcgggggcagcgataggaggtatttttgggtcgtacgtgaagtttaataccgaagggcttgattttgtgatgactgctctgtttattgtgatattcatagaacaatggatgaaagagaaaaagcattacagtgctctctcaggacttggactttcagtagcctgtcttatcctttttggcggaaaccaatttattattcctgctatgctcgccattttaggggtactgactgttctgagaaaaccattggagaaagctgaggtttccgtatgacgatgactatgacgcagcaaatgatcaccattgcaatggtcgtgctaggaacaatgctgacacggttccttccattcatgattttcccgtctggcaaaccgacaccgaaatatgtacagtatcttggtaaagtgctgccatcagcggtaatcgggcttttggtcatttattgtttaaaagatgtgagtctgctttctggaagtcatggcattcctgaattagttggagcagctgcagttgtactgcttcacttgtggaagaaaaatatgcttctttccatagcggggggaaccgttgtttatatggttttggtgcaattggttttttaaccgatatcggaaactatcaaatcatgcttttattaaacttgataaaaatatataaaactgacacaagcttattttggaatcaacactgtgccagtgcaaatagcatctgtaatgtttcctggctattcaagaagtgtctactttaatcggaggatatataatgtcaaaaaaagtgtctgcttcctatatcatcattataggattaatgctatttgcattgttttttggagcaggaaatctcatttttccgcctatgcttggtcaattggccgggaaaaatgtatgggtcgctaatgcaggtttcttagtgaccggagttggattgccattactggctataacagcatttgttttttcgggtaaacaaaacttacagtcgttagccagccgtgttcacccggtgtttggcattgtatttacgacgattctctatttggcaatcgggccttttttcgctatcccgagatcaggaaacgtatcgtttgaaattggggtaaaaccttttttatcaaatgatgcaggccctgtctcattgatcatatttacaatattatttttcggattggcatgcgtgttatcacttaatccttcaaaaatcattgatatagttgggaaatttttgacaccaattaagctgacatttatcggattgcttgtagtggtagctcttattcgcccaattggaaccattcaagcaccgtcaaaagggtacacatcacaagcgttttttaaaggatttcaggaaggataccttactctggatgcccttgtagcatttgtttttggaattatcatcgtgaatgcattgaaggaacaaggagcttctaccaaaaaacagctgatgggtgtttgtgcaaaagcagccgcgattgcagctgtactcttagcagttatgtatacagctctttcctatatgggggcttccagcgttgaagaactagggattttagaaaatggagcagaggttttggctaaggtttcatcctattattttggttcttatggttcaatcttattgggcttaatgattacagtggcgtgtctgacgacaagtgtcggactgatcactgcgtgttcttcattttttcatgaactatttccgaacatttcttataaaaaaattgctgtcgttttatcagtgtttagtacgcttgtcgcaaatataggattaacccagctcattaaggtgtcaatgcctgtcttactgacgatgtatcctatcgcgatttccttaatatttttaacgtttttgcattctgtatttaaagggaagacagaagtgtatcaaggcagtttattattcgcattcatcatcagcttatttgacggtttgaaggaggcgggaataaaaattgaagttgtgaatcatattttctctcagattctccctatgtataacatagggctggggtggctcattccagctattgcaggaggaatatgcggctatatactgagtatattccgaacaaaaacaagttgatcaatcaacagcaatatcactcagatctgcaggatctcctccatcagtggatacttcaactgttacaattggatgttctgcccctgtccaaccgaaaatatcaatcttcccgttgtcacccgaaatctgtaggtgaatatttaatagttgtgagagcgactgactctttaggaaatagtcagcctttaacttcaagacgcaaccaagtgtctagggcaatgatcttcgttcaaaattctttgaatgaagaaaatctacatcctaatatcggctaggtttcacgattcagagtgcgaaatcacgaagaaaaagcaaactccataccgaagtttgcttttttgctctatacaaacaatgagatgcgcctatatttttatatcagacaactgatcagaggtattttgaggcgaagcctgccttccatccatttatttacgattgatctggcctctttacctgaaaatgatccctcatatgcgttaaaaaagcagataaagcaggggtaattaaagtgtctttccgccttataaacatggttgatacgaaagaatatttgtcagagatagtgtggctgcagatgcggccttctttttcatgcgaagcaatgattgaacgaggcagcagtgaaatccccaagccggcgcttacacagccaatgatcgcttcaagtatgccaaattccattaattttataggtaataaaccttcttcttgcaggatatgattgagctttgctctgtatgagcatcctttacggaatacaagcattgtttgtgtttgaacatcctgaatggaagaaatcacagggtgtgaagcacttgtaacaagaaccatctcttcatccaataccttttcttgaactaaatcagggtgttcaataggccctgaaataaaagcgccgtttaactcataatgtaaaactgcttgtatttgttgttccgtagggccggttactaggttcaaatcaacatttggatagaggttattataatgtgcaaggagttgaggaagccaaactgcagctgttgtttccattgatcctatacgcagtggcccagaaggcgcggatgattcgcccatggctgctctagcttcttcaatagtatgtagaattttctctgagtaagaaacaagaatttgccctgggggagtaagtgtgattcctcgactatgacgatagaataattttgtctgtaaatcgttttctagttgttgtatcttattcgttacgttcgattgtgcataatttaaagtctgagcagccttggaaatactgccttcacgagcagtagtgagaaaaacctgtaacaactgaatattcatctagtcctccatagttgatatctgattttgagatgtcttccatcttaattttgaattatatatgatagcagagcttcatgtaaactaaagcttagaagaataaatgatttctaaagtaagtgataaagctatttcaaaaaatggttaattactcgaagttgattctgtatattgcctatggaaatacacatcataacataggcttgactaacaccagaatgaaggggttattgggaaattactttattttctaaatgtagcagctgcttggaaatagctgacacattaacgaatgaaattaaaaagactgttgtagtagaaggaggggattttatgccattacttcgttttgacttaatagaagggcgagatcaatcaagtttgaaaaaacttttagatgtcgctcacaatgttgtagtagaggcttttgatgtgcctcaacaagaccgttatcaaattgttcatgaacatccagaaaatcatatgattattgaggatactgggttaggatttaaccgaactaaaaatcttgttgttctttcagttacaagtaaatcccgaccggaagagaagaaacaaaaattttacaggctgttagctgaaagactggaatctgagtgtggtatcgcatcaactgatttaattgtatctattgttgaaaatgataatgctgactggagttttggacttggtgaggcccaatttttaacaggtaaattgtagttgaatactaccctcaaatgcttgattgaagaaaaggatagagaaactagggtagcggagcaaaccatgtgtttgctccgcttttttatgtttataaaagaataattaaggaggtattgtggatttctataaaaatattttgacatttcagtaaagagcagatatatttatatatgaacacatgctcatatataaatattatttgtatcatgttagaatgcttcataacagatttgaaataataaatacatatgtattaaaaactttaggtaaggaggagttttttatgggtcacaatcataatgaaggagcaaataaaaaggttttattgatctcttttatcatgattacaggttatatgattatagaagctataggtggatttttaacaaatagcctggcgcttttatctgatgcaggccatatgctgagtgattcaatttcattaatggttgccctgattgcttttacattagctgaaaaaaaggcaaatcacaataagacattcggctataaacgatttgagattcttgcagctgtgataaacggtgctgccttaattcttatttctctttatatcatttatgaagcaatcgaacgcttctctaatccaccaaaagtagcaacaaccggcatgcttacaattagtatcatcgggttagttgtgaatctattggtcgcttggattatgatgagtggcggagatacaaagaataatctgaatataagaggagcttatttacatgtaataagcgatatgctcggctctgtaggtgccattttagctgccatacttatcatcttctttggatggggctgggcagatccattggctagtatcattgtggctattcttgttctaagaagtggttacaatgtgactaaagattccattcacatcttaatggaaggaactccagaaaatatcgatgtctctgatatcattcgtacaattgaagggacagagggaattcaaaacattcatgatttacacatatggtctatcacaagcggattgaatgctctttcttgccacgcagttgttgacgatcaactgaccatttcagaaagtgaaaatattttacgcaaaattgaacatgaacttgagcataaaggcattacgcacgtaaccattcaaatggaaaccgaagcgcataaccacgacaatgcgatcctttgtcagcccaaaatggagaagcagcgtgaccaccatcaccattaaattttttatctaactttatagtgaggagatcaactaggattttgcagattctgtctactgacaatttgaaattggcggggtgataatgtgtacgacactatagtaatcggggctggtcaagcagggatctcaataggatattatcttaagcagtccgatcaaaagtttatcattttggataaaagtcatgaggtgggggagagctggaaagatcggtatgactcattagttttatttacttctcgaatgtatagctctttgcctggaatgcatcttgaaggagaaaaacatggatttccttcaaaaaatgaaattgttgcttatctaaagaagtatgttaaaaaatttgaaattccaatccaattacggacagaagtaataagtgtcctaaaaataaagaattatttcttaataaaaacaaatcgggaagaatatcaaacgaagaatcttgtcattgctacagggccttttcatacccctaatattccatcaatatcaaaggatttatccgataatattaatcaactacactcatcacaatataagaattcaaaacaattggcatatggaaatgtactagtagttggtggtgggaatagtggtgctcaaatagctgttgaattatccaaagaaagagttacatatttagcttgtagtaataaacttgtttatttccctttaatgatcggaaaaagaagcatcttttggtggtttgataaactaggagttttacatgcaagtcatacatcaatagtaggcaaattcattcaaaagaaaggtgatccagtatttgggcatgaattaaaacatgcaataaaacagaaggagatcatcttaaaaaaaagagtcattgccgcaaagcaaaatgaaatcatttttaaagattcatctacattagaagtaaacaatattatttgggctactggtttcaggaatcccttatgttggataaatataaaaggtgttttggatcaagaaggtcgaatcatacatcatagaggtgtttcacctgtagaaggattgtactttataggtttgccttggcagcataagcgaggttcagcgttgcttcaaggcgtaggaaatgatgctgaatacattgtaaaacaaatgaacggtgaataaacgaagcagagcagtaactcacatgtttactgctctattttttgcgtgaataagggtagcgaagtggagatgagccttctcttttatttaagaagttagaatatagaaagagaaaaatcactttaagccatactcatatttttatgttcaacaatggtctttaggaggctgcgcattgaatttgtcaggtacgcatctttatggcgtataaaaattgttgagatacagctgtctttctcaggcaatgggtggcaataaaccttaccttgtacagctagatgcataacagcagattccggtaccactgttataccgagtccaagtgcaacactatttaagattgtctctaggatgttaaattccatcattctgtttgggagcacaccttcatctttgagccattgttcaagcctagaccgatacccgcacccctggttaaaaacaagaatcggagtcgttgaaaaatcctctatattaaacgttttgttactggttacaagagtaagtttttcagtataaacatcatactgttccagaatagaatgtttcaaggggcctgaaataaaagctccgtctaattcgtgattcatgacctttttaataagttcctctgttagaccagcctgcaatgataaatccacattaggatactttttataataggaagctatgatggtcggcagtatcctcactgtttccactgtaccgatttttaatattccagacggtatttcagtatctagaaagacttgctccagttcttcaacatctttcaaaattttgttaacgtattcaatcatttttcggccctctgggcttagtgaaaccccttttttatggcgattgaaaagaggtgttttgagctcattctctaattgcttaatccgcgcagttacattagattgtacataatttaactcttttgcagcaccggtaatactcttgtgatgggctacgcatttgaaaatttgtaagtctcgcagttccatgaagatccccccttcattaaagtatcattatcaatgatgtttttcatcacttttgttcattttacttgatgcttacttctttttataattctcattgtaattttaaagaaaaggaggggaattcaatgaaaaaaggtcaattattcattggtgcccttacatgtttagtagcaagtatgtcttggggcgcgatgtttccagttgcagatcatgcattagaatttgttgatccgttttatttttcatttattcgctacggtgtggtaacgattatgttagtgattttattattggtgagagaaggaaagaaatcatttcatttagagggtaaagcaaaatggatcattttatttggggtgatggcgtttactatatacaatgttcttatttttttaggtcaaaggttgatggggaagtctggaattatgacagcatccattgccgaggcactcatgccgatgctttcaattgttattctatggggatataaacatgtgaaacctaaaaaatacacaatgatcagtatattgattgcctttttgggggcttcgatggtcataaccaaaggtaatataagtttctttttttcattaggggatcatctattctcgatactctttatattcattggtgttttagggtgggttgtctacacaatggggggacagatattccgagagtggtccacacttcgttattcaactttgacatgtttattcggcacagctataacaggaatcatgacagctatacttaccgcgcaaggttacgtgtcggtaccgagtattaaagtgattgcagcaattaagtatgattttttatttatgattactttaccaggtatcatagccctccttagttggaactatggcattaaaatcctatcatccattaatgggattttatttattaactttgtccccattactacattgttaatcatggtgatcaaaggatataacataactgcttttgatatagtaggaacactgtttgtcattattggactcattttaaataacatatatcagcgtaaggaagattataagcaggtattgcaaaaagaaaaaacaaatttgactatcacttagacagtgggggatttaaaatgtttgaaggtttattgtttttcatttcagctggaattgtctgtgaacttgctgcaattaatagaaatggccgcaaaaatataaagcaacaggccgaattgattcaaattttaaaagaaaatctttataaagacattaaataaatcaagacggttgggtattattgaaacacaccagaaaattcaggtgtgtttttattttgctttcttttttaagccttaaaacgccactaatcgttagttgaagactatgggaaccactctccatacggaaaaagatgattatttacatcattcagagttgattttaggttcttttgaacttataatgttatatatactgttttttgtttattcaataaatatttacatcggaggtgtacgccttactaggtaaggcaaatcattgacaaccattaaccttataatctttactcttttaattgtcttaacagcattttttgttgcgactgaatttgcgatagtaaagatcaggtcatcaaaaattgaccaactcatattagagggaaaaaaaggtgccatatcagccaaaaaggtcattactcatttggacgaatatttgtcagcttgtcaattagggatcacggttacagcgttgggaattggctgggtcggagaatcgacttttgaagtgattttgcaccccttatttgctcattttcatgtaagtgaaacagtctcacatgtattgatcttagtgattgcttttgtgatggcgacttttttgcacgttgtagttggagagcttgctcctaaaacactcgctatccaaaaagcggaaaccatcactcttttgactgcaaagccaattatttggttttaccgcatcctgttcccttttatatggtttttaaatggttcagcccggtttatagtaggactcttcggtttgaaacctgcatcagaacatgaacttgctcattctgaagaagaactgcgcatcttactgtctgaaagctataagagcggtgaaatcaatcaaaatgagttgaaatatgtaaataatatttttgaatttgatgaaagaatcgccaaagaaattatgattccgagaagagagatcgtagcgatttctagtgaggattcttatgaaactattgttaagatcattaagacagagagctatacaaggtacccagtcctaaatggagataaagattcaatcattggttttatcaatgctaaagaatttttgtcagcttatattgacacagaccagaagataaaagaggatttcaagttagaaaatcatatcaaccctgttatccatgttattgaatccgttccaattcatgatgtattggtaaaaatgcaaaaagagcgaacacatatcgctattcttgtggatgaatatggcggcacttcaggtttagtcactgctgaagatattcttgaagaaattgtcggggaaatcagagatgaatttgataaagatgaagtgcctaatattagaaaagtaaatgataatcactatatcttagattcgaaagtgctcattgaagatgtaaatgatttattgggaacgacgttagcaagtgacgaagtggatacaataggcggctggtttatgactcaacaaatagacgctgcagttgggtccgttatagaagccgatgggtatatttttaaagtgcacgaaacagttggccggcatattaattatttagaaattgtccggaaaaaagaataacatctggataaaacacatgagattttgactaataagatgcttaaagcctgagatgaaattttcatccaggcttttttaaacaatgatcttgcagtttaagtaggtaatcattatcgaagttcaaacgtttctcagcaaacaaggaggcttggatatctatagctcttttaccattaccttctcaccattaaagtcgagttcaccattaaattgaaaaccaaacctttgataaaggcgtatagcatgaatattattttcaaatatacttaaataaattctcttgcatttatataactcagcaaggtgctgaatgagggctttaagcattttcttccctaatccttttccctgatagcgttcgtcaataaaaaatcggtcaagccagactcgtccgtttttattatcttcatcatactcgggaaacaatccatacattgcaaaaccgactagatctccttcatagtaaagcccgacaggtttataatagtgacattcttttgcatcttctaaacatacttttgtagattcaatatatgataattgattctggctgacatgtagatcaagaattgcagcacgattatcatcagttactgcttttatgtttatactcatactacattctccttttttcttatcccggtatcctgatattgctaaaactcagcttatactatattcacgtcaagcaacatgtagcctatcaaattaagtaccttttcttattgtgcctaaccaggggcattccctgcatccaaatgacttaactttatagaaaatgaattaattcaaagctgcagcatcattctttttttctttccaaaccattgtaagaccaaggccgacaatcataacgaaacctgcaaaaaggaaaggataatgaatgttaagatcaaatagtataccgcctagagcaggtccaaatatatttcccaggctggtgtatgtggagttcatgcctgctacgaaaccctgctggttaccggccatattggataaatgagcggttaaggccggacgtagcaaatcgaacgccagaaaaataaaacaagttacaagcaaaacagttaaaaatcctgacataacagtagacacgaaagccaagatcgcaccggttattaagcacagctgaatcattcttttctctccaagtttgttgaccaatttcccgaatagtaaaacttgaataactaccgcaacaatggaactaatcgtaataatggctgcaatatcttttggtgtgaagccaaatttatgatcagaaaacaagctgaataccgtttcataagctgataaaccaaaagccattacaaagacgataataaatgcaatgaaatagacaggatgaatggatctcttcaagtctttaatgaaatttgattcctttgtatgagatgagagttgatggcgttcttctatcgacaatgactcttttagtataaaaacggaagtgacagctgctattaacgcgatggcggaggcgaagaaaaacggcatgcggataccaaagccggcaataaatcctcccgcaccaggtccaataataaagccggtgctaattgcagcagaaacataccccatagcctttgacctttcctttagggttgtaatatcagctacatatgctgttaccgcgggcatgataaaagccgcacttacaccacccaatatcctcgagaaataaaatattgaaacatgggtccctaatccgaaaatcaactcagataaactgaatataagcaacccgagaataatcattttttttctcccgaaacggtcaacccacctacctgcaaaaggtgaagtaattaactgagaaatggcaaaagccgcaacaagataacccattgtgctgccggataaatgcatgattttcataaaagaaggcataactggaatgattaaaccgataccaagaaatgctacgaagatgttgcttaatagtataatgaatatcgttttttgctcatttattgattttttcatctgaattccccttttactcaattgaaccctttttacctatccttttcgcttgaagcttttttcaagtacaatcaaatcataaggtatatggttaccgtatagtcaaggaggtttttatgagcgaagatgttaagaagtatttcacaacaggggagttttcgaagctctgccgtgtaaaaaaacaaactttatttcattatgatgagattggtcttttctcgccggaaataaaaaagaaaatgggtatagatattattcctatcatcaatttgagacttttcaagtcatcagtctatttaaagagcttggggttccattaaaagaaataaagtgtctaataaaaggaaaaacaccagacaagatcctgcatgttctaaaagaaaagtctattgagattgataaaaaaataaatgagcttaagcagttgcaaacgatcttacaaacaaaagtgacgcttacagaacaagcacttgagactgatttttcctcaatttcttttgaatatttaaatgaagaaacattcatgttaagccgaaaaacattaaacttaccagaacgaaaatatgtggcagccatttcagaactcattcatgaagttcagcaatatgaattagatgaaggatatccgataggcggaatctttgcacgggaacaaatcttagaaaaagacttctacaattacagttacttttatataaaagtaaaagatggggcagagaacataaattatcatgtacggccaaaaggcctgtatgcagttggatatgaaataggcggaaatactgaagaggcgtaccggagaatcattgagttcattgaaagaaatggaatgcaaataggggaaaatgcatatgaggaatatatgctggatgagatggtagttgacgggtatgaaaatacatatgcaaaaatcctccttcaagttaaagaggtgtaaaattacgagattttcatatggaaaattgtttctgttgtgtgcccaaaaagaatataaactggtttactaaaagcgagcccacatacaggagacggtacaaacggcactgggaaccgcaagtctatcggcgttgaaatatgctataacgattcaggaggggataaattctatgctgctgaaaaactggccatcaaggcgcatccaaagagataaatctaaaagagctgggataggggggacaaacaacagaattccgtatactctgttgttgtgctatgtaaatgttcaaaagccatttaggatcgtcgacctttgataatccatcatataaaggtgtcattcgatgtcttgttaacaaaggctagtgaaattcaacatctagaaaacgattacaaggtcggtgataaattattcatccatgaatcaaacggtgatcgaacattcatttttgtgtttaatatgagttttcttgatttagcacactcccttaataaatgcataggatactatcacaaaaatttataattgcggggatcaaaaaatgtactataaccctttttcgcctcaatgttattattatgtgactgtgccgatgtataatgatggaagatctgtttattggactattccaaatgagatggagaaagtacacagaggtgccgatttgcgctcttcatatgaagatagaaaccttcttttgaaggattatggaccaaaaccatttgttgtaaatatcaatagagccacaaaacaaaacaatacgttccgtactgctttatggacaggaaagcattttcaagttactttgatgagtcttggtattggagaagacattggtttggaaatccatcctaacgttgaccagttcttacggattgagcaggggcgtgggatcgtcaaaatgggaaagagcaaagatcatttgaactttcaaagaaatgtctatgatgattctgccattgttgtccctgccggcacttggcacaacgtaattaatacaggaaatacgccattaaaactttactccatttatgctcctcctaaccatccatttggtacagttcatgaaaccaaagcagatgcagtggctgcggaagattagcacagatattctggagaattctagaataattaaagtcacatccagcatgaaacatggggaaccagtaccatgctaatgaaaccccatttaatatccaagcagcgtgtcttgtgctaattttaagtaattgataaataaagccgatttaaaattaaatcggcttattgctttattcgagttccttttagcagaattggcattatcgaatgtaagtattttttcaatccgcggatatcgaaatgaatctatcagctcaaagaaagtaactttcacacttgactatatacctatgggggtatattattgttttgtgaataaacaaagagttaataaggtggtgtaaatagtatcaattatttagttattgcattcctgcttatttttgtgattatcattgcaacgtatagacgttattatcctataaccggaatctcttgtatccataaagataaattagaggctatggacatcacaatattagatattcgtcattataacgatgtagccaatttttcggataatattattttaaacatcccatatgcgtatctaaaacgtttttatttagagattccacgtgataaaatacacataatagctcgtgaccgggtggaattaaatttaggagtgcgttttctaaagcgcaaaggtatccatgtaaacagttatgaactggcaacatgtaaatgtaaaaataaatgaaagaaaggatttcattgatatatggagtatgatcaaaagattaaaaaccgcttacgacggattgaaggacaaattaaaggtgtattgactatgatggaacaaggaaaagattgtagagaggttgtgacccaattagcagcttcccgtaatgcgatcgatcgagcgatgggtttaattgtgagcacaaaccttgaacattgtgttcgtgaaagtttagaaaaaggcgaagacacacaaaatttagtaaaagaagcagtcgacttattggtaaagagccgataaaaattcatcaacctaaggttgacgaatttttatatgcgttatattataccccctatggtatttaaagagttgaataaaagcagatctttcgaaaaaattttttgactttaatatacccgcaggggtaattagttaggagaataaacatgacagaacaaacaaaacgcacaacaattgttttatttagcggggattatgataaagcaatggcagcctatattattgcaaatggtgcagctgcctacgatcatgaagtgacgatcttccatactttttggggatttaacgctttacgtaaagaagagctgattccagtgaaaaaaggatttcttgaaaaaatgtttggaaagatgatgcctcgtggtgctgataagatgggtttatctaaaatgaactttgcaggtatgggccctaaaatgattaaaaatgtgatgaaaaagcataatgtacttactttacctcagttgattgagatggctcaagaacagggggtaaagctcgtagcttgtacgatgacaatggatcttcttggtttacaggaaaaagaactattagatgatattgactatgctggtgtagcagcttatttggcagatgctgaggaaggcagtgtcaacttatttatctaatgttactcatttactcattgctaagcggaatgagaagtttaaaggcaagtaaaaatattgaagaaacaaggatttaaaaacatcacaaatataaaagggggtatgaatacatggtgttaacttacagtgagaaactttttgtatatttgtatacccccacccctatataagaaaaggaggaaaaaatgatgaaagcaactattgtactagacgctaaaggtttggcgtgtccaatgcctatcgtaaaaacgaagaagagaatgaaggatttaaaagctggtgaagtattggaaattcatgcgacagataaaggttctacagcagatctggaagcatgggcaaaaagtacaggccatgaatatctgggtactgaagcagagggagaaatacttcgtcattttcttcgaaaaggaggagagcattcatcagaaaatgcatcttcaattcctgagatttcattagaagctttcaaacagaaagtagatagtgacgagtctcttaacattttagatgttcgagagatagaggaatatgaaaaagctcatatcccaggagttgtgcatatccctcttggtgaagtggaaaagcgcgctaacgaattaaacgaaaatgatgaaatttatattatctgccattcgggaagaaggagtgaaatggcggcccgcaccatgaaaaaacaaggttttaaaaaggttattaatgttgtcccgggtatgcgggattggacaggtaaaaccgaataaataaaaagcatgatgaacagatgagtacaagagtagcgattattgcggcaaatagcggtctgtttgatgcttataaagtctgtaatattgcgacaaggaaaagagcatgtcgcagaaggttgtaggaacgcaaatgtgccttctattcttaactgattgaaatgggagttgcatgatttggttgtcaaataacgatggacgttatgggtttaacaaaagatgattttatggaaggaatcgaagtaggcggggctgttacctttttggttttacgaaagatgctgatgtatccttaacgttttagtcccgctaaaagatttgatataggaggtattgaaacatgaccgtaaaggcaatgaccccaaaagaagtgacaaaaaaaatctttaacaaagaacctttatttattttggatgtgcgtaatgaaaatgattttagtgattggaagatagaagggcatgactttgaccatttgaatgttccttattttgatcttttagatggcgtagaagatatcttggagaaaattccttctgataaagaagtgctggtcgtttgcgcaaaagaaggttcatccgtcatggtatccgaaatgctttctgaagcaggtcattctgtatcctaccttaagggtggaatgaaagcatggagcgaacatttagagccggtaaaagtcggggatttaaaagatggcggtgagatgtatcagtttgttcgaatcggtaaaggctgcttgtcatacatggtcatttccaatggtgaagcagcaattattgatgcgacacgtatggtgaatttctttatagattttgcgaaggggaagggtgcaacgattactcacgtatttgatacacatcttcacgcggaccatatttcaggcggcagagtcattgctgaaaaaacaaaagcaacctactggttaccgcctaaagatgctgaagaagtggaattcgattatcagccgttggaagaaggaaatgacattattattggaaatacaacgattaaaattcaaccgatttattctccggggcacacgattggctccacttctttcattgtcgatgaccagtatcttctttcaggtgatatcttgtttattgattcaatcggcagaccagacttagccggtatggcagaagattgggtaggagatttaagaaaaacgctttatagccgttacaaagcgttatcaaaggatttaattgtattaccggcacactttatgatcattgacgagctaaatgagaatggaagtgttggtaaacaactaagtacattatttagcgagaaccatggtttgaacattgcggatgaaacagaatttagacacctagtaacagatcatttgcctccgcaaccaaatgcataccaagagattcgagaaacaaacatggggaaaatcagcccagatgaagaaaaacagcgtgaaatggagattggcccaaaccgctgtgcaatacggtaacacaagtttctgctaaaaagaggagagaagaacatgaaatcagataaagtattagacgcaaaaggcttggcatgcccaatgccaattgtcagaacaaaaaaagcgatgaatgaactggaatcaggtcaaatattagaagtgcatgcaacagataagggagccaaaaatgatcttacagcctggtctaaatcaggcggacatgaccttttagagcaaacggacgagggcgatatattgaaattttggattcaaaaaggctaatgaatgtgaaagggtatcgaatagaaagatacccttttcctatgaaaggaggcaaataaaatggatattgcctttatcacaactcttttcattatagggtttattggtgcctttatttccggaatgattggtattggcggagcagttattaattatccaatgctattgtacattccttctttagtgggagtgatgtcattaactgcccatgaagtttcagggataggggctattcaagttttttttgcgacactcggcggtgtttgggcttatcgtaagagtggtcttataaataaaacattaattatttacatgggaagcagcatccttttagggagtgtattggggagttacttttctcattatatatctgaaaaaggaattaactttatatacggaattctggctattatagcagttattttaatgtttatacctaaaaaaggacagaaaggacaagaacatagcgaagataaggaagtgatatttaataaatggttggcttcttccttagcgtttatcattggtggcgtatcaggtattttaggagctggcggcgcctttatcctagtccccattatgttatcgattttaaatattcctgttagagtcacagtcgcttcatctcttgcgattacatttctttcatccattggcgcaacagttggaaaagtaatcacgggccaggttctttttgtaccagctctggttcttatgattactagtttaatagcttctcctattggcgcatcagttgggcaaaaagtaaatacaaaattcctgcaatgggttttagcgcaattaataggtgcgacagctattaaaatttggttagagctcctttgatatgagccagcgggtaaaatgaaagattaaaagattcatcactcgttggtttcttattaatgttatgacacttggccgcgttcaataaatgtttcaagtgtttgatgaaattcattttgataatggtgacttggacaagtcttgactatagtaccatgaaatgcatttgacttagtggtgtccagtgttgttttgcattaagacagcatacataaaataaaagagaccataacttaatctttgatcaccttttttaaaacattttaatcctgattggtttaaggggtatggtatgtgatgggtataatgagtcaatataaattatgtctattttgtgcccaaaataaatagagggactcgaactaaaaaagaggatgccaaactatataggtatctttgtttgctttagagttattatatttgaatatgacatgccacgtaacaacacgttattgcacatataattaagaagcaactactaaggcagattcttctctcttttaacaccatatccaatcagcctcaaatgtaatataatgttgccaaaccatattggttgtggcaccgaggaggaaatgataggtggtttatttcgtagcatttttttgttttgctattacacttcataatattgaggaagctatttggttacctgagtggtcacaacaatcttcaaagtttcaaaagccagtaacttcaaatgaatttcattttgctgtcattgttataactatgttggcttatttatctgcatttggttttttatatatgccagaatcagatattgcaaaatggattttcattggctttctaggttctatggttatcaacgctatttttccacatcttatcgcaactgttgtaatgaaaaagtatgcacctggacttcttacgggcttattgcttaacattccagtaaactcattagttatttatcaaatgtttttaaagaatttgattgtatggaaggagttaataatatctacgttggttgtaggaattattttattagcacttattccattattatttaaagttggtgataaagtatctccttaatgagtttaaattggtaaggattgagggaaaaggtagaaattttctaaataatggattattctgtatatcggatttctacaaaacaatgtcttaagtcatcattgattttggtgcccaattagttgccctgaattcatgaaaaaaggataaaataggtgtaaataaagttgctattttaaaattagaatcaattcattatcgtaaaaaataataactaattggcaaagaaaggataatcagtctaatgaaaacattagttatcgttatacatcctaatttggaaacgtctgttgtcaacaaaacctggatgaatcgtttaaagcaagagaaagacattacggttcatgacctgtacggtgaataccctaattttatcattgatgtagaaaaagagcagcagctcctgttagatcatgagcgtatcgtttttcagttcccaatgtattggtacagcagtcccgcgttactcaaacaatgggaagatgatgtgttaacacatggctgggcttatggaactggaggaactaaattgcatggaaaagaactactcttagctatctccttaggcgcacaggaatctgattatcaagcaggcggagaatataatatcacgatcagcgagcttatcagaccgtttcaagtcactgctaactatataggaatgcgttttcttcctgcgtttacacaatatgggacacttcatctttcaaaagaagatgttaagaacagtgcggagagattggttgactatcttaaagccgagcattaatccggtattcgcgagggaagctgaaacaaatgatgtgttatgaaataagggtttgtgacagattttcataaacttaatttcaaagttacatcaaatacttaattcaggggggggcatagtgcgagggcttaaaattaattaaagcagggcaatgagtacgtatttcttaatgaaatgtagagttccttggcctctaataggtacccgatttgtgtccagaattctgaaaaatgatgaaaataagtataaataaaataaacatatgctttgaataaaagcttttgtaactcatgatatgtttttactatgttgagggactagtgggcgtggtatatgtcagaaaagaaaccgatgattcaaaggtgttttgacccctgtttatgagacagggatcaaaacaccttttaaacatcattattaccttcctctgataatgaaatataaaaaagttaccagcaactctctgcggcatctcgccgtgttcaattgtttagtccttttttttcataatctttacaaatctgaaaaagtcatcatcattcagtaggggcttgtcatcttcacgtccattgcgatgcatatgcggattagagtgatgttcattgtagaactctacgatatgaaatccacacttattcacatagaagttgatatttcgcttttcgaaataaggtgtcacggtttcccaaagcacagtatccggatactgtgcttcaatggctttccaagcagaaagaccaatcccttggctgtgatattctggagatacatagaataaatctagcgaattatgatttgtttggctgttgatacgtactactgcaccaccgacattcttaccatcctgaagaatatgatataccactgctccgggagcattgaaagactcctgaacatcattgtccgatggaatcggcccatcttcgcaatcaccgaacgtttcaatcacggcgatcgcaaaggcttcttgtaattttttttggaattctggcagatcagattcctttgctagttccagaataacttttggttcatttttagttttcatgattgttcactccctcagttgctaaaatatagagttcagtcgttcagtaaaacattcgagctgctctgcgaggccttttcacaaaaaagtgattccatcgctctttcttccgcggtaaatttggcgttaaaatacttcaaaagctttctcctgtctttttgtatgattctttttctttgtttcattggaaaacaagctgcatgtaaccctaatttactattgttcactaccgtattaagtgtcgtatgcgggatttgtcatcattctcgaatttttcctgcgaaaagttacaaaaatagtcgaatgaggcgcctttgactatgaacatgcgtaaaagattcaatttagattcgatcatgagcaatgcacattgagtaaactctggtggatttattagcccaaagaagcctaaatgatataaaaataactagtccatatatcaaatctgtccgtttaatgcccgcttcattcaacaacactaatttgaagtcatgcaatctgtgcaagggggttatttctgaatagatttttccgaatgcagcggagttgctttgggactcccgtttactttgccgtacgtcagcttgcgccatactaattccatcggaccgtacctaaaccgtttcaaccacaatgtactaaagctcataagaacgaagtacacggccagactgaacatgaacgtgccggcggattgaatatgatccgcaagcccgaatccgtacctgaggaacagaactgttccaatgatagagtgaagcagataacaggtcaatgacatccgtccgactttggtgaatatcatcatagggcctcgcagctgaggaaggtatagaaacagcattgcaaaagtgctcatataaaacatacttccggttaagccgccattttgacccaagacagaggaaatgtccttccacagcatattctcagaaagattaaacatgtctagtaatatactgctttgtgttattagaaaagcgattgtgctaatgatccagatacgcttccatataggctttttcgcttccatgtctttgaaaaattccatcttaacaaagtacacgcccagcagaaacatgagaaacatggaatagatcatagagaaagagccggcagccatcgtgaccatatctgtccaccgagtgctgatggattccatgtaggtaaggctgctgtggctaaacaaagtaaactctgaaaaattcgggttttttgaccctgcagtattgatgacattgtacaacattgtgaaaacaggagtcaggaattgaaacacgataagtgcgataatccatctaagcaccgttttggccgtgcgtttatagaaggcgagtaacaggaagccacttacggcgtaaaaggccaatatgtcaccgacccaaacaaatgtgatgtgcaaaatgccaaatcccaacaggatagataacctgcgggcaaacagcttgttgggactctctaccttctgcgcggctcgatccataaagatcataaacccgactccgaacaggaaggagaataacgtaacgaatttcccttcggcaaaccaggaaaccagcttatgcagtacgtcatcggaggccatttcgaatccctttactgaatctacgatcagaaaataattgacaataataatgccaagcaaggcaaatcctcgtacgatgtccagaaaatgaacccgttcccgcagactcaccggttgcccgcgtccttctttttgtacaatcatatcaatactcctttcccatttatcacggcaatgtgtagtgcggatctgaaaaacttgagccttacaatggataaatataaagaccgaatcttaacaatttatgaagagtcatcattttttttagaaaatgtgacaaatttgtggcgagcatcagctttcataaattgttaagatttacgtagtatcttataacgtacttattactatgaacgatatatagtaaggacacacgagaaataacaacaagaatcatgaggtgagagagacatggcctatcgaatattagtcgtagaggatgatgaggatattggtgatcttttggaggaatcccttacacgtgcaggttacgaggtgctaagagccaaggatggaaagcgagcattgcaacttgtgaatgactcgcttgatttggttattttggatattatgatgccaggcatttcgggaattgaaacatgtcagcacatcaggaaatcctctaacgtcccgattctgtttctgacggccagatcgagtacactcgataaaactgagggattactcgccggcggcgatgattatatgactaaaccattctcggaagaggaacttcacgctagagtgattgctcaattacgcagatatactatctatcaggaaaagaaggaacaggaagaaacatttcttatcgggggcaaactaagagtgagcgaagaatttaatgaggtgtggaaagaggagaagcaaatcaagttgtcagatctggagtatcgtatcctgaaacttctgatgaacaaacgcaacaaaatattttctgcccaaaatatatatgagagtgtgtggggacagccttacttttactgttccaacaatacggtgatggtgcatatacggaagctgcgctccaaaattgaggatgatccggcacgtccggtttatataaaaactgaatggggaagaggatatcgatttggcgcatcttaaatttacgctaaccaaaaaactggctttgctgataatggttgctgcgattgtgagtggtgtgatctttctgacgttgcaaaagatcacagatgatctgatcgagggatatctgagttcggaagagtattatcacgaggagtcagcaagatacattcaaaaattcagcaagtacgtttcagaaaatgagttgtctacatcagatagaaaagcgtttggcgagtgggtcaaaaaagaaaattacattaacctcaccatattcaaggatcaggagctgcaatatgattctatttattccgaatcggattatggaaaggaaaagctgactcagtacgctcaaaatcattcacatcctgtcaagtttagcgatggtgaaggacgagtcattatcgacggtttctactcttcccgatattatgatctggcctttgcattggatttgctcggggcaaccctcatctttttaatcattgttctcttcggaattcgccaaagtcttcgctaccttaaaacgattcatcaagagattcatattcttgaagggggcgaactggactacgagatgacgataaaagggcatgatgaattagcgatgattgcaaagagcattgaggatctgcggaaagctttcctggataaacttaaagctatcgaggaattgcaagctgagagccgcagcctggttaccgaaatgtcgcacgatatgcgcacaccgctgacgtcgctgatcatgaatctggagtttgccaaaaaagagggaggcgaagcgggtgccagcaaagatcggtatgtagccaatgcttatggtaaagcactgcaattaaaaagcttgtctgacaatctgtttgcgtatttcctgctgaacaaggaatatgaggccgatctggagaccgttgcagtgaaagaagtgatctacgatctaatatcagatcagattgctatccttcatcaggagcattttcgggtccatatttcaggcgagctgccggaaacctatattaacgtgaatttggaggagcttggtcgtgtatttgataatgtgatgtcaaacttattgaaatacgcagatccggaagaaaaaatcagtatcacgtttgtatcggatcaagagatatttgagatccatgttagcaatacgattaaacttgcagatataacaccggaaagcaacggactcggtgaaagaagcattgcgcgaatgatgtcccgcatgcagggacagtttcacagtatacaaaagaattctaagtactacattgtgctacgattttggaacaccaagatgtaggctgagaataaaaaccacgaatatattgaaataggagacaacatgatgagattttctaacaaattcaaaaaggtgccttacctgttacaagcgcttctcaacgtctgtctgttctttctggcgttagccttaagcgcacttctgatcagcgagacttggtacattgtgctattcgtatacaagtcactgttcaacaaagtggacagctattatgagatgcttggagaactgcttatattcttcatgtactttgagttcattgctttgattatcaaatacttcaaatcagactttcattttccgcttcgctacttcatttatattggcatcacagctgtcattcgtttgattatcatcgatcatgatcaggcgatctcaacgttctggtgggcgatggccattcttgcaatgatttgtggattctttattgccaatagacgaaattctgttgttgaacattaataaattagttcgcattatgccgaaacgccgccgaaatgtcctaattgtgaaagggaactggtacagatttttataactctatctgtttaatgtcagctcagaaatctgtagtggatcaaattgaatcgtggttgtaagtggatatccgaatgtatttattggctactttaacagacatgtcccgatgaaatagcattaactgtttggagatgaaaatcgcttctttatttcacaaggaagaggttaaaattcttaataaataagatgaaaaagttaggttggacgtttattgggtttttgtaaccattttttaccataattgatataaacgtatagaaatgataacaaatgaatatatagtgtgtaatgaaaataagctttcataaccaatgagctagatttactatattgagggcctagtgatatagaaaacagatcgatggtacaaaccatcggtttttttatttgttttcatactcattgaaaatcacctcattaggacaaacaggtattacgcagcattacccaaggggtgatgtattttatgaaggtaataatcatcgagggactgcaaactgacaaatgcatgaacgattgctatcattatttaataaaactttataggcaggagatccagggtgatagcaatatatcgtggaacaagcgatcaagggatcgagcatcgacagccagatcgaggcctgtataaagaaagcagggactaaagatgtactgaagtataccgatctaaggattttctcaggagagcttttagaacgtccggctttgaatgcctgcgggaggattataagtcaagttatttgttacgatcctgcctgtctttctcggagagcttatcagcgatgaaaaaaatgattttcataactctttcaaatagagaaagccggagtatgagatccggcttcttctgcattatttccccttcgccttcttccgcttttccttctctgcccgataaaactcatgaaacatcttcatcagcgcccgcttttcaatccgcgatacatagctgcgtgagataccgagttctttggcaatctctcgctgcgttttttccttcttcaaatcaagtccaaaccgcccgacaatcacttccttctcacggtcatctaaaatgtcaatgtattgtttcactttttcaagctccatattgagctggatcgtatctatcacgtcttcgttttctgatttcaaaacgtcaatcaggcttatttcattcccttccttatcctgcccgatcggatcgtgaagggagacgtcttttttgtttttttcaatgcgcgcaaatgcatgaggatttcattattcattacaaaaagggggggcataaatttcccgtaacagtttgactaaataaatgttgagtcagtttcctgtaataaatgcttaaacgtttcttagcgaatgaaggggataccttaaataaccaagctacattttcaattgcatgtgattgtatgtacggaaggttgatattacgcaacatgcaagttggaatgcaaaagtgatatgtaaaataattggactgccaatccaaataatcagtccaagttgcaggcattgtttttttatcgccttcatgtctatatatatggcaaaattcatgagcaaaatcataccattgttcagttcggcttttacggctgtccaagcatatattataaattccgctgtgtttaagtgcgaagcttgtaacaggtttaaacgaaagcctgatatctaaagcctcggcaatccgttcaaaattaatttgttctggttctgtaatatcaatcttcttgtataagttttcaatccaatcctctaaatgactgtttgtatacctcaagatgaaaaacctccttaaagacgacaatctaaaaattggattcgtttaaatattatatggaaatcaagacttttttcataggaaaatgcgtctaaggagatggaatatgaatccgtttaatcatgactgttttcgtaagtattatgattttaacacgcatctggatttccctcgaaaagtaaaggtcttttagggatttatgtcaaaataatagtaagtacgttatgcaacaaacagggagtttggttgcttaataaggaggggaagtatgaaaaaaaatattcacatattgggagcctctggtgtcggaacttcaacattgggtgctgcattatcaaagcgtttgcctcatacgcatcttgatactgataattactattggttagacaaattcactaaaaaaagagaaattcctgaaagaagaaagttgcttgaaaaagacttaacaatcaatgaaaaatggattctttctggtgcagtgtgtggctggggcgataatctaaaaagttattttgaccttgtcgtcttcttatggattccacaagatatacggcttgagagactaaggcacagggaatttcagcgttatggaaacgaagtgttagccggtggcagtaaatatgaacaatcaaaaacatttttagagtgggcttctttatatgataatgctggaatggaagttagaagtagagctttgcatgaacattggatggcagatttatcttgtccagtgttaaagattgaagacgactgctcagtcaatgaaagagttgaccgtgtcttggattatctgagttctaattaaactaacggatagcaatagctgcatcagaaaataaatccaaaaatcaaagacagttccagtatggcatttaatgagctgtttttttaataccgctatcaatttgcctactatttttggtagcatccccacaacagagaagagattgttcttcataaggaagtttttggatcagttgcaggaaatggaacctcaacgattagatacatcctaaaacctgtccagctagtgcttatgttggttaccattgagtgaaaagcacttgccgatccttttttgttggtgtaatcattagtgaattattacaattgcaaatgataggggcaagggaataaatggacttcaaaggagtttaatcatgaaaaataatgataagaagaaagaggttcaaagaaaatacagagaagagattaaaaaaagaaacaaaagaatgaagataataaaaattttattaaagaaacaattattgttgttacgataattgtattgtttatttttttcacatacactttgcaaggtttttaacaagaagccctcttttcccatttcgatactctgcaatttccctcacaataaacgctcaatttttttacatgagaatataaaagaaacataaatgaaaatataaatgagaaaaacaacaaaaacccttgtcacgtaagggtttgtaaaggattcaaaatcactttttaaatgagggtatgaatgaaatataaatgagaatctaaatcttattagtaaacagaattaaacataataaacagaaataaataataataaactaactgcgtttatttatctgatttccgtctttcttttaattgctccgttataatctccaaagcagcctgtaagatctcatctgttacctcaccgtcttttgctgcaaggaatgtttcaggatcgtttaacactttttttgcttcatcctgaaatactttttcattgctttctcctttaagaagataatccaaagaaacatcaagtatgtttgaaatattaattaaggttttatagtcaggctcacgactacctagttcataggcggtgtaggcaggccgagtaattccaagtttatcagccatattttgttgggttagtttcttttgttttctgcactttttcaagttctcggagaacatattaatcacctgacttttgtttttattctatatctcattgtaacgtaacaaagggttacatataagttttggtaacaaaacgatactttttttatgaaaatgtgttgacaatgtaacgaatcgatactattatctaagtaacgaaacgttacattttctgattaagggggtgaaaaatgatgagaaaatggcttaagaaaaaccgcttagaaaaagggtttactcaagaagaagttgccaaagctgcacagattggtagagcatactacaccatgatagaaaatggtactaggaagcctagtgttattgtctcaaaaaaaataggagagaaattaggctttgactggactattttttttgaggatgtatgtaacgaaacgaaacataattctaaggattcagcatgattagaattcacaaaggaggccttttaattatgaaagtcatcttgaaaaaaggaccactgtttgaacaggcagaggccaaagcctacaaatacctcagtggcatacttgttcagcgtatgaatgaacaccaagagaagcttgcgcaaaaaaataaaaaggaatcagcctaagtcatttataaacagcatggtctttcaacttcaattttaaaactaaaaacctaatataacaggaggcaaacatatggagaacaacccatacaatatgcgtaatttaccgcagattatgcgtagtgcccgtaaggctgcaggtctttcacaataccaaatcggcaagttaatcggaggtaaggatcaaaggtatgtttcagatgttgaaaatggacttgccaagcttactccagagttatgtattaaatggtttgagaagtgcgctgcctatgaacatattgatcttgtacattacttattcaaacttcatcctacagccgctgctcctattgatccggcactcaatgaatgtgcaagtaatgcggtgattaatatggttcaccaattggaggaagcactgcaagcaaccaaacatttagcccgttggctcacggataaccgaccaggtaaaacagaggagctgccgatggccgatattaagcagatttttgatttgattgcggctaacaaaacattgatttattcacttgttcgtactcacgggttgaaaatgcaggaacttgcagatagatggacgcggaaagctctagttgatcaagttgctatggcaaaacaagaaggaaggcaggcggtttcagtatgaatactaatcatttcttgaaggcagatgttcctatcgcaaaaagaaaaatcgaatcagcagaagagctatcaatcatgctgtcagaggcattacgtgatggtgattatgaagaagcgattagtcttgctggaagcatcaaggttcttactgaggatattagccggcttgcaaacaaaggacgcctttatgaaacggcattgaaaatgcaacagcaaggtatcaacttaactgtagtgagcaggtgtataggatgatggttcattttgttcataaaccggcaactgctctggaagttcgtaaatggtgtgtgatgattcgtaacaatagtgaattccatctgttatgggatagacgtgcagacaaattcagagaggagaataagaatggtcgaaaatccaatggtcataaacaactggcacgataagctgactgaaacggatgtacaaatagatttttacggtgatgaagtaacaccagttgatgattatgtaattgatggcggcgaaatcattctcagagagaacttggaaaggtatctaagggagcaacttggttttgaatttaaaaacgcgcaataaaaaagcccactcggcaaagtggacttctttaaaggctatctaaaaaaactcatgtgcaaatattttatcagatagcctcaataaaaacaatgggggttaggtggaatgacaagcaaacgggctgaggttcttgctaagaattctgaaatgagccgtgatgaatggcttattgaaagaagaaaaggaattggcggctcagatgcatccattatcttggggctgaacaagtggaagacaccttttgaattatggttagacaaaacaggacaggtccctgttagtgaatcgcaaagtgaagctgcttactttggatcattgctagaagatattgttgcaaaagaatttgagatacgtagtggcaagaaggttagacgtaaaaaagcaatactcagacatccagaatataatttcattttggctaatgttgatcgaatgatcgttggtgaaaaagcgatccttgaatgtaaaacaacatcagcctacaacttaaaagaatgggaggacgaagaaatccccgagagctatatcgttcaggtccagcattatctgggtgtgcttggacctgaatatcggaaagcttattttgctgtgctgattggcgggaacaaatttgtctggaaagagattgagcgagacgacgagttaattgacatgatctttaaagcagagattgagttctggaatgacaaggtcttaggtggacaagctcctgctttagatggttcaagtgctgcggaggaatacctcaaaaaacgatatgccgaaacggaaaataacaaagctattgatttaactgcggctaatcgagaacgtattcaacaatacttgcttattaaagaacagatctcagagcttcaaagccaggcaaaagaattagagaaccaaatcaaacatgaaatgaaggatgcagagtatgggtttatcggtaactatcaagcttgctggaagcctgttgtctcaaatcgaattgacacgaaaaagctcaaagaccagtttccggatgtatacgagaaagttaaaaaggaaactcatttcagacgttttggaatcaaggaggttagctgattatggctactaatcaatcaattaaaaacaacatccaaaagaaacaaaaaaacgtacctgtgcaacaacaaggagcaacaatgaaagggctactttcctcaccatctgttattaaacgatttgaggaagtgttagggaagagggctacacagtttactgcttctatcttaagcctttataacagcgagcagatgctacagaaaacagatcctatgagcgtcatatcctcagcaatggtggcagctacactcgatttacctatagataaaaacttagggtatgcctggattgttccttacggaggtaaggctcaatttcagcttggatacaaaggatatatccagctagccttacgaacaggccaatataaatccatcaattgcataccgattcatgaaggcgaattgcagaagtggaatccgttgactgaggagatcgagattgattttgaaaaacgagaatcagacgcggtaattggttatgcagcttattttgagttgataaatggcttccgaaaaacagtgtactggacaaaggcacaagtagagaagcacaaaaagaaattcagtaagtctgattttggatggaaaaatgactgggatgcgatggctcttaagactgtattaaaagcagttttgagcaagtgggggattctctctgttgaaatgcaaaaagcagttattgaggaagatgaaacaagggaacggattgacattaccaatgaggcagacagttcagaaattatcgattccgagccttcaaacaaagatgaaacggaaaaaccaagcgcccaagaaaccgatccttttgacggcaagcctgtagatataaaagacgatgaacttccgtttgattgagccggcatctctgacataactgcactctgtgaaaggaagtaggtgattgacttggacataaaagcaatggggtatgtggtcataccccgactaccattcaaagagtttagggatgaaaaaatttatgatcacttgttcaaaagagctgaatacaggccaaatcaagagctagaacttgggcagaccattatcaaagttgtggaactagcaaaagattttaactggtcagctgcacagatcaaatactcactagaccgaatggagaaacagggatatatcaaattgcaccgtcttccacaaaaaagagggttcatcgtcaccatacttcattatgcagactacatacaactaggaaattacatgaagaacaaagctttggaaccagctcagattgaacatcaggaggtcgatgacaaaatgaaaaatgcctttgagctatatgaaaacaaagttgctcggtcagtcggcccgatggaggcacagcggatcggctacatggtcgacgattatggtgaggaaaaagtgatggaggctatcaagacagcgtttcaattaaaggggaaagctgcaagtttgtcatatgttcaagccatcttatcaaatccattcactcaaaagagaaaggagaaacaatatggctataaacaaagcagtcagtatagacaccgcatttcaaacgatcatgcaggaacttcgggaaaggtcagcccgctttttgggaacaaaacaggccgtatcagaagaaaaggctgaatttgattgtccttattgtaaggatcgtggaattgtcgtttatcgagtccataaggacacttcttggcatttagatgaacagttagaccttatggttccggacgatatggtgtcggaagatgattttctgttaggtaaggtttgtacgccggataaagctagcgaatggaaagatacttattcaaaacagtgtgaatgtgtaagacgaaagaaaattgccagactcatggcagctagtggcattacagaagagtttgaaaagcttctctttggtaacttcataacggacggtaagccagacatgatcaaggacgcttatgagtgtgcagtggaatactataaagattttcaaaagatcaaaggagaaaggcaaaacagtatcgcattacttggacagccaggtagcggtaaaactcatttgctcacggcgattatgaataatctgatcaagaaaaaatcagtacactgcatgtatttcccttatgtagagggcatgggtgatttgaaagctaactttgataacttagaagcaaaactcgatgccatgagaaaggtcgaagttctattcattgatgatttatttaaaccaataaacggtcaaccaagggcaacagactggcaggttgaacaaatccagtcagtcttgaactaccggtatttaaatcacaaacctttgctgatttcttcggagttaacaatcgatgagattttggatatagacgaggctcttggttcacgaattcaccagatgtgccgtgattacatagtgattattagaggcgatcgaatgcaattaaatcataggttaggtgattgggaatgaaaaagaaaacgaatataaaagcaactggtggactttatatatttggcccttcaaatcgaaatgaaggtaaagatcttacaccaacaatccgtttacttgaggaaaaaataaagcaaatggagcggatgctgagtgcttaaagcagtcgtgtctctgctgataattttactttctgcaccgagaatagaaaaagaaattaagttatgggaacagcttgacgggaggtaaagaacagttggattgcattaagttcactgtttatggtgagccagtcgcacaaggaaggccgcgtggatcaatacgaaatgggaaggtgcatatgcgtgatccagcgaaatcaaagtatttcaaacagtatgtggcattggttgcgtctcagcatcgaccagaaacaattattactggtcctgtctcaatggatgtcaaagtgtacagaccaatgcctaagtcagtttcaaactcaaaaaagaagaaagagaaagctgaaaagggccttctgcggccgactacaaagcccgacgttgataattatgtaaagggcgtgaaagatgctttgaatcatctgatatacaaagatgatagtcaggttgtggatttgaaagtcagtaagttttatagcgaagagccaagggtggaagtcatgataagagaggtttctgcctaaaaataaaaaacaccgaagcgcttagcctcagtgttcttgatatgaactggtacttctatcataacatagggggcgctttgagtgtacaatccaagagaaataaacatcaaaaaagacttcactattcagcagaaaattgacccaggaaaagttcagatcattgttttagatgggaatcagggaactgcacatgttttagatgctccggagcacggcaaaacagtgattcaaactgtaaagggcagctttgcaagggttgatcatgagatagggtttaaggtgaaatgagaagaagatataatactttataaaaaggtaaacaagaaggaggatatctcctccttcggcttggatgtgcaggttattcctgttcaggtaaattgtcagctaatgtttctaataattgttgaggctcttctaaattcttttggggttcaggaaaggcttcaactgtttcagaaggtgcatctaaagatgggtggaattgggtaccttcatggagtaattctgcaaagattttaaccgattgttttatatgtcctattgattctgttgaataatttgctccttcagtaacattttttatttcggcatctgttattgtgtcaatacccttttcaattccatctagcaaagctttggaagtttcgacttgtagctttaattgctcattttgaagagctagcttttcgatgtttgccttagtaatgagtaattcttgagatcgctttgaaatgtttatagctgcatctataagttgtccaacaaatattactgcagctgaactgtttactaagatgtcaatccacattgaacctgtgtcaaaaccctgtaatttataatgtccattaatttcctcaagggtaataccattctgaaatgcattatttaattttttgatgaatttttctagttcttctaatgagttgtattgagggagttttacgctaattacgttctcattttgatcagaaactgactgatcaattaaaattccaaaaccacgtaatttttcttttacaatttttatatgattagtaatttgattagcgatgtgattatccacttcaatcttatcttcaggtacacgtgaataatatatacttcctagatctttaaatctctcaatatcatcatctaaaaaaccaagtttagacaactcgttaattgcatctaaagacttttgtaaattaagaacagtctttctgttgctgtgcggtacgtgcgaaacactaactccaatttgtttattataattgtcgagtaaattttttatttctctaactctcatataacaacctccactactttataataaaattttaccatatttaaggagggagttgaatttttttccttaggtaatgtgaattcattaaagcataaaatatccagttagtccaagacggaaagcctgcggacactgaacttacagtattacgctgtatgtttggtgtccgtttttattttgaaaaggaggatactttcatgaatcgaaaagaaattgaaaatctaatcaatagctatcactggatggtgaaagaggttcgtcgattgcaaagggtactctatggttcagtaattcccatgaagaattggggtgttgctcaatatggattagaagctactatgccaaaaggaagtcctgggaagagtcaggctgagctaaggcaaatggatatgagagaggaacgtcttttcaaacgtcttaagtattatgaagagcgagtatatgcagttgaattaggggctgaaaagatccatggtgagcagcataaagtcatttatgattgcatgatggagggtatgagctaccgcgcaataagtcttcaccttggcatttcaagggaaactgtacgcaaaatgaaagatgagttcatcagccaattatgccaagattgccactttgagcgtttgttgaatctgaaaaaatctgtagtgtaaaatgggaggcaggtcggcgcggcgaattattcctgcgtcaccactaaatttaggttttatacaacagtttcgttcgacaaattttgcgaatagtacctgtatcgctctcttttgccgataattagtaaaaggaggggatgaaattgattcaaatagattttggtacagtcattactagtgctataacagcagttttttttacaggtggaactaattatgttttacaaaagaagaatagaaaaggaaatgaaattttcacaaaaggctatatactaattgatgagatttataatattaacaataaaagaattgaaaccgctgctgcctttgtaccgttctataatcacccagaaggatacttagaaaaattacatactgattattttaaagagctatcggcatttgaactgattgttaagaaattttcaatactctttgataaagaactgaatatcaagttacaggaatatataaattatttaagagaagttgaagtggcattaagaggttttatgaacgatgatccaataattgaggtgaacttcaatcaagaatatattgagcggttgattgatgaaataactaatttaataaaaaaacatatttaagcttcttttgaggagcttttttattttcaaaacaactcaatctaaaaggaggcggcagtgaatgtagatggttgataagcacatacaggcgtataaggattacgccaaaggtatgaaatacaaggaccttgccgagaaatatggggtatctgtgaacaccattaaatcgtggaaacaacgccatggttggcaaagaaaaaagggtgcacccttaaaaaaaggtgtgcacacaaaaaaagtaggtgcaccactcggtaacaagaatgcgttaggtaataatggcggcgcacctaagggaaatcaaaacgctgtgactcatggattcttctctaagttcctgccagaagaaacgctatccatcatggaagggattcaagaacgttcgcctgtcgatatgatatgggatcagatacagatccaatatgccgcaataataagggcgcaaaagatcatgttcgtttctgataagcaggaaatgattaaagaactgaaaaagaaaaagtctgtgctatctgagacaaacgaagtcgaagaggaagaattcgaatttcaattttcttgggatcgtcatgcaacgttcttgaacgctcaatctcgtgcaatggcagagctcaggaatttaattaaacagtttgatgaattagcccattcggaagacgaacgacgccttaaattggagcatatgcgcttaaatatcaacaagaaaaaaatagagatcgaagaacttacagaagaagataaaccttttgagatcaccattgtaaacaaaggtgatgacagtgattaaacaggtaaatccacattttaaagaatttctctttgactggaatcaaaagtttcagtttcttgtgggtggttatggatcatccaaaagctatcatgtggcgctcaagattgttctgaaattgctcagagaaaagcgtactgcacttgttatcagagaagtgtacgacacacatagggactcaacattttcactttttgatgaacttgtaagtgatctaaaattagatcatatcgttagatgtgtatcttctccgatgcagattcgattttcaaatggcagcagaatcatctttaaagggatggataagccagccaaactgaaatcaatcaataatatttccctcatttggattgaggaatgctctgaagtaaaatatgaggggttcaaggagcttcttggacgtcttcgtcacccgacattgccgcttcacatgatactttcaacaaatccagttggagaggacaattggacttttaagcatttcttcaaggatgatagggagaagcgctttgtactggatgataaggaactttatgaaaagcggataatcgttagcaacgacacctattatcatcactcaacggcagatgataatcttttcctgccagaaagctatgtccagcaacttgaagaattgaaggaatacgatccagacctttaccgaattgcgcggaaaggtcattttggcgtgaatggaattcgggttctgccgcagtttgaagagcgaccgcatgaagaggttatgactgcaatctctaatattaaccgcccgcttaaacgggttggcatggactttggttttgtggaatcgtataacgccgtcgttagggttgctgtggatcatgaaaagaaatatctctatatctactgggagtattacaaaaatggattaacggatgataagacagccgaagaacttaaggaatttgcagagactaaggaattaatcaaggcggattcagcagagccaaagacaatccgttattttcagcaacacggtttcaatatggtgggtgcccgtaaatatcaaggatcacgccttcagtatacaaagaaaatcaagcggttcaggaagatcatttgctctgatcgttgcgagaacacgatttatgagcttaagccgcttgcttatgctaccgataagctggggaacatcatagaagacgagttcaccatagacccgcatacactgtcagctatctggtacgctctcgatgattatgaggtaaccgatttgaaagaagaatcaaaaggaagaccgcaaagatcaagaccaggaaggaggtaaagcatgtcaaaaaaatctgttaaagcacgagtgatcaaagcctctccacctactgaatcaacgaaacaaatttatgaagatgaatttgctgacagctatgacagcaatattttgcctcctccgtataacctaaaggaattaaaaatgattgctgagtattcaacaatcttacagcaatgtgttgatgcctacaggacaaatattgtgggctttggatttgatttcgagtattcttttgatgtgaattcgccagatgtgacaaatgaagaaaaaacagaagctgaaagtgaatggacaaagcttgaagagttcgttaaatatcttcactttgatgagtcagctgagactttactcggatttgttattgaagatagagaaaagacgggcaatggctttattgaggtcattcgaaacggtgaaaataagccagccggcattgaatacatggacgttcaaaatgtacgagtttgcaaactgtctgaaccaatcgaagttgattttacgtacttcgaacaaggacaaatgaaatcaatcaaaagagagaaacgattccgaaagtatgttcagatgattgacggccgtatggtttattttaaagaatatggtgatcctcgcactttaaatttagagacaggtcaatatgatgaacagaccccattggagaaacgagcaaatgaagtggtccatttcaaaataggaagcggtatttatgggaaaccgcgatggattggccatattgttaatttgtatggtgctcgtaaagctgaagagctgaactttatgtacttcaaacaaggaagacatattcccgctgccatcacaatagaaaatggaatgttgtctgaggactcatacacacaattgcaggattacatgaatgggcttgaaggagtggagaacgctcataagtttctattacttgaagcagaagggatagcgaaggggaaaaacattcatggtgatgaagagattgcaccagtgaaagttgatattaagtcacttgctgaaatccttcaagaagatgctttgtttcttgaatatgaccaaaagaaccgagataaaattagatcggcttttcgtttgcccccactttatacaggtgaagctcaagattacaacagagcgacagctgacacagcaagaaagattactgaggaacaagtatttcagcctgaacgaaaattaatcacaggtaaactgaatgctttatttctaaatgatcttgaaattcataaagtccgactccaactaaaagggccagactttagagatcctttagaaattgctaaggttctaacaccgtttataacagcaggtgcagtttctccgaatgatttacgcgatttggctggacgggtacttggtaagacgcttgaagaatggccagaagaagaatacaacaggccgcttggtaaaactaacgagtcgtccgtttccgatcctttggctgcactgtttaaatctaagaacggtactcctaatatgatcgggttattaaaagatatgcgggatgttctggaggatttgaagagatgaacaaaacggataagctattggagagtttaaatgtctttattcaaaaagccgaggaaaatcagtataagcaattgggggagatggtacctgactttcctggcaaatctaatatccccaaatatgtggaggaatatgaaaaaggcattgccagattgctcagacgccagcataagaagtttttagatggtctcaaaggttttgtaagcaaagactcagaagagacgttaaaagcccttctagtgttttttactcagaacctattcgcggaggatgacttcgaggaagaatttcaggaactgactgagggattcctgcaacagactattgaagaaatggctgaagtaatcatggattcaatagatccagaggtgccttttaaagtcttatccaatcgtacgattaattggattaaggattggtcaaagaagctggctgagatcatgaagttaaacacacatgaagtggtggaggacgtgctaactaatgctatcgagaacggttcatcaatccaggacattgagttgactctcaaagacatgccacaatttgatagggagcgggcgcgtaccacagccatcacagaagtgcttgccgcttcctctgccgcgcagcatgaatcatatgcacaatcgccggcagtaaagaaaaagaaatggcggcacagcggagggaagaagaacaatcctcgtgaaaatcacattgatcttgacggtacagtcattggagtagatgaagaatttcagataccgggcagtagcgaaacctgcatgtttccgagggatcctaaactatcaacaagggagcgggttaactgccattgtgttctatcgcctgtggtagatagtaagattttaggcttatcacccgaagaaaaagaagagattcaaagagaagtcttagcaaacatggaataaaatagtataatgtcctcattacatattaggtggggaaaatatgaattggatggagtttatctcttcaatagtcaaatcaatcatttggccggtagcaataattatcttggtttttaaattaaaacaaccggtttcaaatttgatcagtaccttggcgaaaattaaatataaggattgggaatttgaattcactattgaccaaaaattagataagattagtttccaattgaataaagagaatcaatatggaactgatgatcaaaatctaaaagattcattaaatttagaaagtaattctgaaatcactgaggaaacacattcccattataatgagaagacaagcattaaaggggataatgacttactactaaaaatggaaatgattcgtttatatggagcagtgaaaaatctttatgaaaaagtatcagaaaaagatgatgcggcagataaatctcaaggtataggcatgttatacatggttgattatttgaaacgccataaaattcttaatgattcatttgcggaaagcttacttgatataatgaatatagttcatgacttagagaaaagtcatatttcacaaagctacattatgaataaatttttctggaatgtagataagagtgtaaaaaggttaatggagataacaagcaattatgttgctgagaatacagctggtgagacttctaattagaagtcttttcttattttaaggaggtgaataacatgccaagagaattggtgaacgcaaaaatcacacatgtttcttatgtggataaggctgctaatcaaaagcagttctttattgtgaaatcagaaaaacaacctgattttcaaaaggaagtcagaatccttgcgaaagaggcagacgagcaaaaacttgtttacggtatcgtgtatgaacctgatacagtggacgcccacggagatttcatgacagctgcagaaatcgaaaaggccgctcatggattcctgaaagatgctcgtcaaatcgacaagcaacatgactttcagggtggtgttggtgaggtggttgagtcctatgtcgcaccggcagactttgaaatgaatggggaaaccattaaaaagggatcatgggtccttgtcacaaaggcttctgaggaagtatgggagcaaatcaaaaaaggcgaaattaccggttattcaatggcaggaactgctgagacgattgaaaaacaagaaaagcccgtttctcaagagaaaacagatgagaaagggctatttaatttgctcaaaaacttttttgttggaaaacaacagcaatcatatgaagagccagttgcaaaggcgggcagaaaattttccgcttcaaacctgcaagaaattaagaatgctcatgctgcccttggtaatttactgagtcaggtagaaacaaaagagggggaagaagaaatgacttcggaggaagtaactaaatccattcaagaagcattagagccaattaagaagcggctcgagacattagaaaaagaggaagagcttaataagaaagataaagaaaaagaagaagagactgaaaaagagggcgagaagttgaaaaaggcaatttcagaagctgttcaaccgctcgctgatcgtattgaagcaatcgaaaaaagtcgcggaacatctaagcaaactgaagaatcgggttccgaacaagttcaaaaatcaatctggtcagggttgttttaatggataaggaggatacgaatgagaaatcaagaggttattaataaagcagaaatgacgctttctactttagagagcggcgggattatgaatcctactcaggcttcaacttttattcgaatggtacaagatacgccaaccattttaagagatgcgcgagttattcaaatggaccatgacacacagaaaatcgagaagatcggttttggtcagcgtattttaagggcagcccaagagggagttgcgctaactaaagatcaaaagtcagttccatcaactagcacagttaacttaagcacaaaagaagtaattgctgaagttaacattacctatgacacacttgaaaacaacatcgaaaaagatggccttcagaatacaatcatgcaaatgatagctgagcgtgctgcggttgatattgaagagttgcttgtaaatggggatacatcttcctccgactcatatcttgcacaattagatggcatcagaaaacaagctacatctcatattgtcgatgctgcaggtgaggaactgacacgtcaaacatttaaacgaggatacaaagctgtacctcctaaatatttgcgaattccgcaggagttccgtttctatacatcgcctggtattgaggtcgaatggaaagatcgtgtagctgatcgtcaaacaaatttaggggatgcagctgttcaaggtggcctttcatctgcttttggtgttccaatcaaaggtattgcaaatttacagccttatacgattggagagggagatactgcagccgatgtttctgatatcatcctaactcatccgaagaatattattctcggattctctcgtaacattcggattgaagtagataaggacatccgtcgccgtatgtttatcattgttttgacagcgaaattggatagtgtttttgaagaagaggacgccgtagccaagatcgtgaaagtgaaggagtaggtggtctggtgtgtttactgcaaagcttattaaaggcaaaacatacaatgtgatgggaataccctttcgagcaggtgtcagtcaaacagtaccgaaaaagctctatgagtatttaaatgaaaatccatattttatactaacccaagagcttaataatcaaaaggatgatccgataaattatactgaatcggaattgaaaggtatgaataaagcagagcatgaatccattatttctaatcttggtcgcaatccgtctgacttcaaaaacgcagatgaaagaattgcctacatccttaagcaaatagataacaaaggggagtgacctatgctgttaatcactcccgatgaattaaagagttattcagtttttgagtctgtaaagaccagaactgacgagttgttaaaacaggatatccttgaggcaactgccgatatcattcttaaagttggacatgatttttcagatgcagagtatatccctttgcctgaaacggttcgactggctctattaaagttgtctcagttttatgctcttataaatggcgacgagtcaattattaaaggatatacaactgaaaaaattggtgactattcttatactctaggggatggcagttctcttcaaaaacctgatgtgtatgcattaataaaagattatgtgaaaccggctgaccctgatttagaagggattgaagcgaaagtgcggatgagatcaatatgagttatcaatccttattgactcacagatgtgacatttaccatctgcaggagaaaaaagaaaatagaaagcaaaaattcggggtgccggttgaagatgttcaaccggttttttcgtaccctgatgagccggacatagaaaatcagccgtgttattttacagagaagagtcagtccattatccaacaggagtcaaatgtatctatttatcaatctttccttgtgcatttccctgctactgctgatattcgagtaaatgacagggcggtttgggatggtactgcttataaattacagaagccccgcaaaatcaggaatcatcattgggaagtgacggcagtacgggaggttgaatacttatgaaaattcggggtctcgatcagttcatacaatcattagaccgggcttctcgtgggggactgaagaggaaatatgagcagtggcttgaatcaatgggttttgagttcttagatatcatccaagatgagatcattaggacgaagaccgtggacactcgccgcttgctcaattcctttcagaaaggtgaccaggataatatcttttcaatgacagaaggcagcttaaagttggatgttggaacaaatctggattacgcctcatacgtcaatgacgggcactttactatcgatccgtctaaaaatcaggatagacgatgggttccaggtcggtggaaaggcgaccgtttcgaatatgaccctgctgaaaaaaattccggcatgctgctgaagttccgatgggtagacggttcggggttttgggataacgccatggccatttttcagttgatgtttgagagaagccttgagcggaagctgcagcaatggatttatgaagaattttaaggcggtgctgccatgaatcaagaagtaggttcaattatgggctatctatacaaactgtatcctgttcaagtgtatgaagaagaaataccgcaggactttgctgttccgtctctttactttccaccggcttccacggtcgatggggtggacacagtatccacgtttcagaaagcatatgttttaaacgtaaaactctttcacgaaaacgtacagaaggctcataacgaagcggaacgaattgcggatacacttagaagcagaagaggcataattccgcttatacaagaatctggcgaggatactggggattttattcgcctatctcgaatagaaacgcgggtatcagacgattatgcgaccattgtcttaaactggacgagccgctattggtatgagcgggaagatcagcgttcaatagatggttttaaatttaaaagtggggtgaaatgatggccactaaaaaagagaaagcagaaaatgctttttatattaaggatttgcgagagcacagtcgagagctctttggggtaaaacccgaggtgtttgacggtgctctttttcatgttcataaaatgagtattacaaaatcggaagcgaagaagttgatttctcagtttcttcaaaaggaggtcaaatagatgaacggcggaactttcacacctggcaaggaaaaagagcgtgccggtatttactttaacttcaaaacgaccgcggagaaccgtgtttctgccggagaacgtggaacagtggcgctgccgatagcgtccagctggggtgaggttaagaaattcatttctatctcttcaatcgaggacttgaataaaaaagtggggttgaacattgatgatccttcgctgttgcttttacgtgaggcgatgaagaaggcgaatacagtcttgctttatcgcctaacggaaggtcttcgtgcttcagcagacattagcgaaggtgtaaaggctactgctctttatggcggcactaaaggtaatgacatcattattagtattacggagaacgttattgactcttcgaaagttgatgtcactacctaccttgatcaatctgaagtggataaacaaacagtgtctaaagctgaagaacttaaaccgaataaatatgtcacgtttacggggaaaggagatttaacagttactattccgttaaccggtacggcccctgaagatgttagcggtgctctccctgcaacttccggaatccgcttgtcaggcggaacagacaaaacaccgacaaatgccgattatacagctttcttggaagcggctgaaacggaatactttgacacaatcgctttacctgtagaggataacgagcaattaaaagcaacgtttgttgcgtttatcaaacggctgagagacaaccaagggcaaaaggttcaaggtgttctttcaaattacaagggagaccatgagggtattatcaatgtaacaggtggtgtcctacttgaggatggaacggagatcactcctgaaaaagctacagcttgggttgccggtgcaagtgcgggggctacatttaatcaatcacttacatttgtagaatacgagggagctgtagatgtccttaaccgaattgacaacgacgaaatcgttgaacgattgtcaaatggggaattcttgtttacttatgattctcgtgataaatcagtatcggttgaaaaggacattaattcactcacaagcctaacagcagagaaaaataagatgttccagaaaaacaaaattgtccgtgtacttgatgcaatcaataatgacctgacatcacaattgaaagcattgatcaagtctcgaaaagcgagcggcagtgatgttcccgctacaaatgacggactgcagtttgtaaaaacgctaattactcaatacttgagtgttcttcaagataacgagggcattactgattttgattcagagaatgacattacaattgctctgaataatgatcgtgacggcttcctgattgatcttgcagttcaaccggtggatgcagctgaaaaattctactttaatgttgaggtgaaataggaatggcattaaaagcgcaaaacaccatttcaggtaaagagggcaggttgtttcttgatggagaagaaatggcccatatcaaaacgtttgaagccaatgtagagaaaaacaaatccgaggtcaatatcatgggtcgtcggatgacggggcacaaaacgaccggagcaaatggaacgggaacagccactttttataaagtgacttctcaatttgttcttattatgatggactatgtgaaaaagggaagtgatccttatttcaccttacaagctgttctagatgacgcctcttcaggtcgtgggactgaacgagtcaccttgtacgatgtgaactttgattctgcgaaaatcgctgggcttgatgttgattctgaagcattggaagaagaagtgccgtttacctttgaggattttgatgtgcctgaacagttaaaatccacattctaatcactttcacgaaaaatcgccgactttaacgaagatatttacgaaaaaatgtggtaagattactttagaagtaattcaaccgtaccaaatggaaacatgtatttctttcaaaagaaatgcataaaataaaagagacccggttgccgccgggtcagtataaatgttggcccatcaagagggctggcttaacaacttcatgaaagtatttaggatagactttacccttttactttgccgagctcaaggggtgggtctatttcttctttatataagtcaacagggcaattataaatgacccgaaagcaagcataagcattaatgcttgaaatgttgacacgtgcatcaccccctttcatgagggagtgagccagaccgcccttgagatgttgaaagccaatattcatttatactaaaccatattgtaccataacactttcataatccgagggtttttaataaaagaaaaagggttaaggcttctatgatcaggtcattttgaactcatagataaaaaaagtaacaaataaaagatacaaataattatataatcaatatatattcatgttataatggtgccaagcaaaagtattgcaactactggcgtaagcttatagttggtaccacattaccacattaccacttgttaatgtgtgttactttcatgagaaatgctaaaatataaaagccagagtgtggcagcactctagcttttaaaaaagaaactaccctttaataggagggtcctcgtgtagacacttttcctttacagtaatgtaaataggatgagtgtctttttttctaagcatgaataataatgttaaaagagatattacccatgtcataatcccgcctattaaattggcaaagccgatcatgaccattagagattcataggtcgacataatttcacctcctttcatattcggaggataagctaaggtagcttcaagaatctattatacatgaattatatggaaagcacattcaaaaagtatgaatgtgctttttttcttgtccaaaactaaaagtaaaaggagttaataaacatgagtgaaaaacaaaacgaaaaagtatacgatctttcattctttatgccaggacaaacaattgaagcggaagaggtagaagttccgatttctaaacggtttgtagacaaagaaggcaatgttgttccattcattttcaaagcaattacgactgaacgaattgacgaacttgagaaagagaacaccacttacaaaaatgtaaaaggccgcggccgtgtgaaggagttggacagccaacgcttttatgctcgtattgcggttgaaacgactgtttatccgaactttaaagctaaggaactacgtgaggcttacaaaacagaagatccagtggaagtcgccaaacgtgttctttcagtcggcggtgaatatgcaaattggctgaacaaagcaattgaaatcaacggttttgatgatgatctcgaagaccttgaagaagcagcaaaaaactagtaaaagacggggacaaagaggctgtatacctttactatgctatgcatgagctcaaatacgccccgtcagaattaagagaactatatgaggctccgaaagcattcaaggcgctcttatatggattaatcggttttaagcttgagctgttagaaaaagaagcgaagaagggaggtaattaactatggctaaactaacagccacgtttgaattacatgataagatttcccgcaagcttcgaatgatacaaggcaatgctgaaagacttaagagggctgctaatggccctcttatttttgaggctgaagaccggactgaaagagttatgcggcaaattgatcgatcagccaaccgtttgacggctcgggctcgattgcttgaaatgggtttagatgatcgagtttcgaatggcttacattctatacgccagcaagcagaggatcttaccgaaggcagtcatgaggtgacggtttccgtaaatgatcaagctacaccacgttttcgtttgatccgtggaggtctcactgatttgaatagctcgcacgctgagccaactgtttcagtacgtgatcatgcttctaaccaattagatgagatccgtcgtcatgtgactgatgtagatagcgaacatgcagagccaactgtttctattaaggatagagcttcagcggctctggatgctattgaagcgaaaatagacagcttgaagggtgctaccattactctggcagttgcaggtggtttttctgcaggttcaattatgggttctggtaaaagcacaatgtctcaggatgcttatgtgtcagcaacttcaaacgttaataagaaagatgttgcaaaaatgacggatcagatctatttcaacaataaagcgggcagttctcgggaagaagtcagtttatctctaagaaacttatcgcaacagacaggggcgtctaaaaaagctctggctgaattgactgagtcatcaagtaagattgcccagcttatgaatgctgatcaggcagaggtagatcgtgctttcagttcaatgtataacaacttgaaattgtctgggaaacaaagcggagacttaattgcttatgtataccggaatgccggtgaccaggctgatgatttattagacacgatgaatgaatacagttccacctttaaagacttgaagctcacaggcggccaaattgcaaacgcgatgataaaaggaacaaagggtggagccagaaacttcgataacctagccgatagtatgcgtgagtttaacatccgccgaaccgaaatgtctgatagtcaagtggacgcatttaaaacactgttcggagccaaggaaactaagaaaatgttcaagggcttcaaagatggttcaataagcggagaggaaagtttatttagggtggcaaaagccctttctaaagtgaaagacaaaacaaagcgggctgctattgcgactgagcttatcgggacacaatatgaagaccttaagcagcctattttagatatggctgagggtattggtacaagtgccaaaacaagcggtgaattggaacgaagctttacgaaacttcgggataataacccgatgacaccggttaatgatgccatgagagattttgaaagcatatctaaggatatgggaacctctctgctaactggattaggaccggcctttgataaaatcagctcgttcattaacagtaaagaaggtcaggaaaaacttaaagagatcaaaaaagatattgctgatctaggtgaggagataggtgataagttaaacgtagccattgagtggagcgtcaaccattgggatgatttgaaaacagcgattaaagttgtgatcccctctttaattggattgattggttatttgaaaatacttcgtccgctgttaaaaggcataggtactgtcggaagtgatgcagcaggcgtaatccgaaaattaattccaaaacgtactcctaaagctggtactaatacgcaaagtgaaaggaggaatagaaacagtaatcgtaatgctagcacaaggggcagagaatccaaaactgccacaggtccaacgagtttacctcgaagcggcagcttgacatattgctgttgtagcgatggaggtaaaaatgatcgcattcgtagaagacgagggaaaagagttttaggtcgacgcggtaatccaaaccgaatgaacccttctgatagttcaattgctgtgtcatctgaacggttggagagaaggcgttccggtagaactgtaggtactaatccaactagagattcaagatcagcaataatcactacgagatcggagctatactcagctggtagagctgcaggcggtacatcgaagttcgggaaagtcttaagtcctctgaaaagtgttggcaagtttgcaaagggagtccctctattaggaacagcgttagcggcaaccgatttaattgggatgaataaagataatgttggtgaaaaaattggatcagctggcggtggccttgctggagcggctacaggagcagctattggcagtgttattccaggagtgggaacagctattggtggattagttggtggtatagcaggcaccatgggcggctcaagtttaggtaaagcgtttgatggttcagaagtaaagaagaaactaaacagtacattatttgatcaaaaatggtggtctgaaaaatggtcaggcattaagagtaatgcgaagacttccatcaatgggttaagtgatacatggtctaatgtaaaagaaaaggtgaagtccactttatttaatagtgaatggtggtctgaaaagtggtctggcgttaaaagctgggcacaaaacaaatggaatagtgcatcatctgtttgggagtccgtaaagggaaaaataaaatccactttgtttagtgagaagtggtggtcaggtaaatgggaaggcgtaaaaagttgggctcaaagtaagtgggacagcgcgtcttctgtttggcaatcagttaaaggaaagctgaaatccactctatttagcgagaagtggtggtcaggaaaatgggaaagtgtaaaaagctggtccaaaaataaatgggacaatgctaaatcaatatggaaaagtgttaagagttccatctcagaaaccctttttagtaagaagtggtggtctgaaaagtggcagagtgtaaaggaattgggaagcagtattttaggcggggtaaaagaagttggtggtaaagtagcttcaagtgcgaaaaaaactgctggtaaagcgtggggatatgtgaagagtggcgtaaattatttatttggttcgggaaaagaaaagccaaagaaacatgctactggtggttacattacgaagccaacaatatcttggattggtgaagctggtaaagaattcgttatccctgttgagaataataaaggtcgcggcaaaatgctcctttctcaagctgcttcgaaattagggatgagtgtggttgatgatatagcgtctgcttcatctgcaggaggtgaaccggcaacttccccgctagtccgtagtgcggcggtgactgcttctgtatctcctattattgacacatccagtcttgatgaacaagcaacatcatttggtcaacagttcacgaagagctttgatcaaggaattagagataatgttgtttctatggaagcatggaaacagaaaaacgttggacaaccaatgaacaatttaatctcttattctccgaattacggaaagcaagtggtcaatggttatgctaaaggtcaaaacagcacttcgaccggtacagatggcttcttgcagacgaaggttaaaatgccatttcagaacactgttaataaatcttcatcatggggaagcggaacgatcaaaggttttgcttccggacaaaatagctcacaaactggtactgatcaatacgtcagcactcatattaacaagccgtttatccgctctaaagaatcatcaaacggatggggaagcggtatgatcggtaattttgtttcaggcatgacttctaaggcaagtgaagtcaatgaggctgccaaggaactggcgaaaaaagttgagaaggcatttcgtgaagagctggatattcattcaccttcccgtgtcatgatgagtcttgggcgttttgcctctataggtattgtaaaaggtctggattctgttgatgtaaaaaagtttgctgaaaaacaagcaggctcactagctgccgcttattctggaatgggcgcagtaagcggaaatgtgaagcaatggctcatggctgctatcatggctacaaagacaccgatgagctggcttccagggctgatgacaattgctcagcatgagtcaggcggtaatccgaaggcaatcaacttatgggatagtaatgcgaaagcaggacatccatctcaggggctcatgcagacaatcccaagtaccttcaacgcacacaaattgccgggcatgaataacattcttaacccgattcacaacgctgctgctgcgattggctatatcaaaagcagatatggatcaattaataatgtaccaggcattagaagcatgagacatggaggtccatatgttggctacgctaacggcggacttattaccaaagagcagattgcccgtgtcggtgaaggaaacaaaagggaatggatcattccggaggagcgaggcatccgtggacgttatttattagcccaagcagctaaggcactcggaatggaagtcacagacccatctgaaaaaggtcaaactgaattatcttcaggtcaggtaacagctgccacaacgggtcgtaatcaaacaacgtttaaagctgcaggtggcaaagaggtcattattcagtttaatggcgatcagcattttcacaatgaccaagacatgaacagtcttgtagctaagattaagcaggcccttgtcgatgagcttgaacaggatatcaacattggaacgaagggagtcgttgcttttgactaaatccatatatgaattctggatttcacaagggaaggacaagctgcggcttccggtccttcctgaacaaattgatatatccaacacaattcaaaatgaatcagtaaaagtggctagttttggggagatcacttttattgataaaccgggagcgaaagaaatttcgttctcttctttttttccaaagaaacacagcccgcttgctgagtataagggatttccttctcctgaaaatgctattgcaaagatcgagaaatgggtgaaatctaaaaagccggttcaattcttaattactggaacgaaaattaatttaacttgcagtatcgaggttttttcttatacagagggccaaaaagatataggtgatcgtgattatgaaataaagctgaaggaatacaaaactgcttcgccgcggaagatcaagcagaagaaaaagacgaagaagaaacggccatctaaatcagctcctaaaacatacaccgttaagaaaggcgatacactgtgggaccttgccggcaaattttatggagacagtacaaaatggcgcaagatatggaaagtcaataaaaaggctatgatcaaacgaagcaaacggaatataagacagccaggacactggatctttcctgggcaaaaattaaaaataccgcagtaagcaggtgatgacatgatagaacttttcgtcattaaagaaacggaatggcttgagctggtaactgaaagtgtttccctcgaagggcaacggtatcaggcgccgcgatcgattacggccaagatcattacgaaacagggaacccattcatattacagcgtatctgaaggggatacagttttatttaagtggaagggcaaagaactgttccggggcattgtgttttctcgcaatccggaagaacactggatgacttttacggcttatgatatgctgcaatatttggtcaagaacaaagatgtttatgttttctcaaatcaacgtgcagacgagattataaaacggttggcgcgagattttcagattccgactacatccattgcaaatacaggttacaccattaaatcattagtgtttaaagatgatacgagcctttatgacatgattctaaaagccttgaaacaaacgaaaagccaaaccggaaggaattatcaattatattctgcgaaggggaagcttggccttcgcgcttggccagatctgtcagaagtatgggtgttggagacgggtgtgaacatcaccggctatcaatacagcacttcaattaatgacacggccacaaaagtaaagctccgccggcagaaagacaataaaacatacacagccactgcaagtgacagctcagggatcagtaaatatggtgtgcttcagtatgtcgaaacggtttctgataacattaaccaggcgcagcttcaggagcgtgcgaaagtcaaacaggcacagaaaaaaggtgttaaaaaagaactcaagagtattcaagcgattggcattccggatcttcagagcgggttgcccatctatatctcaattccggaagtcggggttaagaaaacatactggatcgatacagacaaacacgaatttaaaggatcgacacacacgatgaccattgatgtggttgagaaaaattctatccctgatggtgtttcctcatgagattaagtgaagcaatcaaacatttggctgtccgtgcagttgattctgagtcgccagtggatattctaccggctgaagtggtttccgtttcccctgttgaaataaggcttaatgaaaatgacaaattaataatacctgctgatttgattattgttccaaagcggctgcgggccggtgaagaagcattaaatacaggtgagcgtgtgatgattgtctccttaaaaggcgggcaatcattttttattctcgacaaaatataggaggtgtttggaatggctttgtctccggaaatcgagtttgaggatatagaagatgacagcgaagtcatagagacctcgcaaacctacaaaatagattttgaaaatggccgtatcacaaatgaaatcatcacaggccttgaagcgatcaagcagtttgtatatttgtctctccatactgagcgatacgcatattctgtttacagtcatgacattggaaatgaacttcaagacgtgctggcagataacgaaacaacagacgcatataagaaaatggagatccctcggctgatagaggaagcactgatctatgacgatcggatttctgctgttacagattttgaaatagaaaaacaaggcgaatcgttccgtgtctcctttacagtcgagactgacgaaggaacattggagatcgaggaggtgcttggcgaggatgtttgaagatcaaacctatgaatcgattatggatcgaatgttgaacagcatttcagcggacattgataaaagggaaggcagcgtgatttataacgcgttagctcctgtagccgcagaattggccaagtcttatatttggctcgatactgttctggaacttgtcttctcagacacggcccaaggggaatttttagatcgacgagctactgaagcaggcattgagcggactgctgccacaaaagcagtcagggcaggggagtttactgaaggcgtgaccattcctgtagggtctcgcttttatgttgataatctttattttcaatacacagctgacgggacgttggagtgtgaaacagcgggggaagcagggaacgcaaacatatccggtcagaatctattgtcattagacactatacctgggcttcaaaaagcgattgtgaaagagattctgattcctggacgtgaagaagaggatgatgacagtttaagagctagatattttacccgcgtgcgtcgagaagctgtcagtgccaataaagcacactataaacaatgggctgaagaagtagacggagtggggaaggtaaaggtctttccgctttggaacggggacggtacagtcaaaattgtcgtgaccaatgctaacttggaacctgcttccgatattttaatatcaaaggtgaaaaactatattgatcctgaacccggacaaggtgagggacaagcgccaataggtgcctttgtcacagtggagagtgcggtatggaaagaggttgagatttcagccgaggtacttcccgaggtcaatagctctatcgatcaggtaaagcaagaaattgaatcaggtgttttaaatctttttaaaaagattgcctttgaagataacgtcatccgtttatcgcagattaataatatcgtctacaattcaccttcagtaagtgattacgcagatattaaaatcaacggcgtggccgaaaatttggttctgagtgccgtcgaaatccctaaattggggcaggtgaacatcattgagcaaactcgatgaaatgactgcttacctgccgccgttccttaccaagttaaaggaaatggctgaacttcttaaagcggaagctccggaatttgagaagcaaaataacagcatctttgatctgacagatcagctgtttgttactacggcaacctgggggcttgaacgatgggaaaagattttgaacgtaccgcgggaatcaggtgacaccgatgagatccgccgattgcgcctaatctctaaaatgtccaatataccgccggcaacatatagggccattgaacacgcgttgaaccggttcctgaaaaatccgtcagctcaggttcggctgcttcccggagagtaccgttttaaggttgatattgatatagatgatatgcagcatatgagcgagctcatagaaacattggagaatatgaagccagctcatttggcatataccttgcgagctgctttgaatgagccactccaaataaaagatactgtcattttgaataacagaaggtatcgaaaagcaagtgagctaaaggtaggttattccgtcacgctcaataataacgaggtggtccttgtatgattacacagctttatagagagcgtacagctgcagatttgaaaaatagaatatcgaaagtgctgctgaatggaaatgaaacagaaattgtggaactcaccattcagggtgccgttgtcacggtgcttactcaacgagaggaagacatcaaacatattaagagtgttcagatacttgatgatcaaaacaacgtgattacggaaagaacaacagatttagacgttagtaataatagaacgctagattttaggattacttttgaggtggtttaacaatggcttatgatgcaaaaacagattggctcccggacgatccgattaatgaagatgatgtgaaccgttgggagaaaggcattcaagatgcgcataaagatttagctgtacataaaaatgacatgaacaaccctcacaatacaacaaaggcgcaaatcgggctagggaacgttgataatgtacagcaagcttcgaaaaaagaatttgaagagcatcgtaatgatttacaacggcacattacaccagtggaacgggagaattggaatgcaaaagaaacaattgtcggagctcaggaaaaagcggataaggctttatcggatgcaaaatattacgtggataccaactataaaaataacaatctgacgttaattactggagacaatgctattcaagatgcaagaacaggaggggaagaatatcctttaggactgaccttaatggacattgggcagggaaatactacaggctaccccttgggttatggcattgtcaaaaatgaaaaatataataattaccgtttcactcaatacttttacggaacagggaatgagtctgggacttactatgacagtacaggagtttggattagacactggtggagtggttcaggctggactccgtggcaaaagatatcaggttttgctcatgcgaatattggaactacaggtgttcagtatttaaaaaagattgatcacactaaaattgcatttaacagggtcatcaaggatagccataatgcttttgatactaaaaacaatcgatttattgctccgaacgatggaatgtacttaatcggggcaagtatatataccttaaattatacatcttatataaactttcatttgaaggtttacctaaatggaaaagcatataaaacactgcaccatgtaagaggagactttcaggaaaaggataatgggatgaatcttggtttaaacggcaatgcgactgtacccatgaataaaggagattacgttgaaatctggtgctactgtaattacggaggagacgaaacactgaaaagggcagtagatgataaaaatggtgtatttaacttttttgatatacaagaacttggaggccgaaactatccaagattttaggaggtaacgatgaatataggtgaagctattctttttaaatacccaacagctgatcccacaaaggattttattgtccagaataatggtgatggaactccctcatatatagcagagtggaatattagggcacctatacccacggaagcagagttaaaaacttggtgggaagagcttcagagtacatctgcatatgaaccaccagttcaagtggatctacttgcaagagagttgtcacaggaaaaactggctcgtaaacagcttgaagaattaaaccaaactttgggaagcgagctttcaaaaataaagttgcaactgcttactctacaaggagggcaaggttcatgaattattgggtgctggctttgcattataactgggcttcttctgaaatggtgaaacaggcaattcatctcaaagattgttcgcccgaagatttacaggaaggaatagagaaaaaactcattacagctgaacagtataaagagatcacaggagaagccatttagggcttttttatttttccttaaaggaggtggttccgttgtaaacccatgctcaccactaatgatctacaatagcaaggaggatttataatggcatcatatagttttcaattttcaacagatgcaactggtaagccgggggcagccaagccatacagagaaggaaacagagattttgttgtgccggtagcttcaatctccggtaattcagagctgctgacgaacgcagttttaaaagccactgaagtctacacgcaatatggacaagatcgattaggtcaggttttaatttcaaaagtaaaaggtcacgcttattctgatcgtgaaggtaccttattcattgaagaaagtaacgatatgaattcatggaccacaatctcttcattggttgttaaagcaaatacgcttggcgagactgagtggattcatttaactaaacgatatttccgtttcagatacgcaaatggtaacctgcagcaatctgaattcttactttaccagtcattgggcgcaggtgaagaggatataaacattaaccatactgttcctattacagcagttgctccgttctcagtccagttagataaaagcgggttaactaatgatggtcgtttaaaagttcaaactgaaggcttgaatcttagctcattagacactcaatcaaaaacaatggatattgtctttcacgataaaacagaaaccataggtgagggtaacccattcaccgttggatcattcaaaacgttgctcattgaggtttatgggacggctgagacaagtgaattgaagttctggggtaaatccttatcgggaacaaaaagagcccttagagggcagaaagtggatgacggaacgtttgccactagcacaaaaggaaaatcagaagcttggtcttttagcattactggctttaaagaaattgttatggagcttacagctttaacaaatggaaacttttcagttagagggacggccgtctcataagatccggctgtccttttttatttgcctcggaggaggtgattagaatggaggagacaagtttgtttatcaattttgaaacattagatttagcaagagtatatttatttggaggggtgaagtaccttgatttacttctagtacttagcataattgacgttttaacaggagtaatcaaggcatggaaattcaaaaaactgcgaagtcgaagcgcatggtttggctatgtccgcaagctactcaatttctttgcggtcattttagcaaacgtgattgatacagtactcaatttgaacggtgtcttaacctttggtaccgttcttttttatatcgctaatgaaggtttgtcaataactgaaaacttagcacagattggtgttaaaataccatcatcaataacagatcgattacaaacaattgagaacgaaaaagaacagagtaagaataacgcagacaaagctgctggctaagccagtggctttttttatcttactgacagaaggagagagggtatatggccattaaagttgtaaagaatctagtctctaaatcaaagtatggattgaaatgtcctaatccaatgaaagctgaatatatcactattcataacactgcgaatgatgcttcagcagccaatgagatttcttacatgaagaataactctagctcaacaagttttcactttgcagtagacgataaacaagtcattcaaggtattccaacgaatcgtaacgcttggcacacaggagatggaacaaacggtacagggaatcgcaagtctattggtgtcgaaatttgttatagcaagtcaggaggggtacgatataaggcagcggaaaagcttgctattaagtttgtggctcagctacttaaagaacgtggatggggtattgatcgagtccgcaaacatcaagactggaatggtaagtattgcccgcaccgcattttgtcagagggaagatggattcaagttaagactgcaattgaagcagaattgaaaaagttgggcggaaaaacaaactcaagcaaagcaagtgtagctaaaaagaaaacaacaaacacaagcagcaaaaaaacgtcatatgcgctaccatccggtatttttaaagtgaagagcccaatgatgagaggggaaaaggtaacacaaattcaaaaagcactggctgcactatacttttacccggataaaggagcaaaaaacaacggcattgacggcgtgtatggtccgaaaacagcagatgcaattagacgattccagtctatgtacgggcttactcaagacggtatttacggaccaaaaacgaaagcgaaacttgaagctctcttgaagtaaataaatagtctccttgagtatctttctcaaggagatacttatgtttattttgttacagatagttcaaaattattctaatatttgagtaaaaagtattatttttctagtctgaacataatgttatcatttacatgtaaataatttaaaagaaagggattgatttcatgtttaagaaattacttttagcaacatctgcattaacattctctttatcattagttcttccgttggatggacatgccaaagctcaagaggtaacattacaggcacagcaggaagtcacttatcaaactcccgttaaactatccgaattaccaactaatacaactgaacaatctggtgaatttcacacaaatggtattaaaaaatggattgctaaagaagcaatgaaggcaacagccagtgcgcttcgacatggtgggagaattgttggtgaggtagtcgatgagttaggtggatcagcaggaaaaacattcgcaaaacatactgatgatgtagcagatgctttggacgagttagttaaacgaggtgacgttgtggaggacgcaattattgacacggtttcctcatatctaattgatgctggtgtaaaatcttctacagctagaactattgcaagtgtatttactttcttagctttttaattgaggtgatttgaattggtaacagtagaagaaaggcttgacaacctagaaaaaaaagtcgagaagcaggcttttcaactaaggttagtccaacaattagcagctgattatgatcggtttggcttatttgatcaagttttggcctatgatttaagtgaaaaacagtatcaagaattaagagagttaacgagccagtacactgataagattaaaaatggcgaagaggtctctcttcataactttactgaagaatttaaaagaattttgaaagatattgaaaaagaagtggatttcgaaaagtttatttctctctggttaaagggaccagaagaaggttttggattttctaaagctttacataaccatttctttaattaaagataaggaccagccacataataagctggtctttctttattttccctcaagttcgaactcctatgaacagaataccaggtatctatccttccaaatatattgttattagcttgagggtttgtgtgtttttcttcattaatcatagaattctccttacctcagtcattttcttctattatttgcagctgatttcaaattaaataaaataagcccttctcattgagaggggcttataaagtgactcttctttattaaagtcattaaacaacagattctctctttatatcaaaaatatcaatctgttttgattccagaagatcttgtaaataatctgagccgtgtttttcagctacttgcaattctccttcggatataggtaaagccattagccaagtaacatttttgttactaaattcaagtagttctaaatcttcctcccataaaaatgggggaacgaacataatatgtttcatgtcggtttcctgatcatacatactaatcacatttttaaaaataacacctggtgcacaagtgaaatttgagttgattatattaaaggcacaagttgataaaacattagcatatatgtctgaagctgactccattgcagctacgatttctatccgcaacggagtgccattcacctcataattaatagaatgatccgacaaacctagagttgaatatgacgtgataccttcctgaggctggtcactaaccgataaaatatctatgctgctattcttgttatcatcccaatatttcgtaaccttcggtttccccccaaaagctcctaaaactgttctagcaattactttattttcttgtgttacgcccattagacaatctctccttaatctccaaagtaatcatccgtcatatcttcccctttatgactcctattggaggaaggtaattcgggttgatagtggtctggattattatgttcatctaaaaattgctttcgactaatatttctttccatcgcactttgttgatgttttctaaattcataacctggtttatgacccatatcccatggttcatcttttttcattacttgttttgttaacgggtctttaacagatccggttgaatccttagcattttcccaaaccttatctctaacgcctttacggaaataagttggtcttttgtacgttttaggaactttaggttttttgctggtgttagtcgatgcttcgctaactcgagaacttgattttgcattaagctttttgttaattccgcgagctccgaaaggaaccaacattgccattgcaccactaaggctctgttcttgcctctctttggagactttattcccgaacatatcgcgtcctgttatagcttcactaaaaccatttgcagaagcaagtccataaagtcctttgctggagttttgaagggcatggaatgtcttaggtgttttatatacatcgagagctttgtctgctctatacaatgctttacttgttgaataaacagcttttccacctttagctaatttacctgcccatcctacgatagggatgtatcctgccgcagccattgcaccggcagcgacccgttgtccagcagttagcttttcgccggtaacaggatcaaccccatcagcggctcttttataatcataatatccagagacctctcctgtaaaattacaaacagcatcccaagacttttcataccatggtctgttcgccagttcttcttgttcttttgcaattcttctttgttccgcctgttggtccttaaaagagatgtagtctgttgattgtttctttacatcctcagtcatcttgtgaatctcactgtctctataagccttcgcattatagtgaataggagaggcgcttttgccttttgctgtcgcattcattaaagcttgataatcagcttgaatcatttgttcatttgcttctgatagtccgtattctgatgttaagttttggtcaacttcatccattttctcaatggcttcttttcgtttcttttcggcagacgaaagttcatttttaaaagtttctgtcgagaacagatccaaaggcagtatatcgttgatatcatttaatatatctttcatggcttttttctgttcagacataatggattttgatttggtgtaggcgttagcaagctcatgcgctaaaaaggtttcttctatgtaggcatctgataagttggcatcttctaaaaaaccaggaatactcgttaagaaagaaattttcatctcaattaaatcaatccattggtcagcaatgccagcttgatcttcataaaatgatttaatgttattagcgcctttgcctgaaaactcgctatcatctaaatctgcaacagctttgaacgctttctttaatttgaccattttactttttaaatctttgtattcctgtgctcgcttttcagcctcggtgagcaaggttttggcttcaaatactttcatgatcatatcctttcatttaatcgtcataacaaaatattaccatggaagaatgatgaaactaactgttatgtggatcaaatggtggaaatgaatcattcgatctgtgtcattttacctatttgttaatcctttcaatgaaaggggactttccaattgtaacatcgccatcatgaaaaaattcgataacgtagccagattcactaaacataaaagtatccgatccaacggcagttacatcatcaattacgtttaatgcatgctcaagactggtttttaatgctggctgttctccgtaaccccaaagaataataatgttcctatctttaaaatggtgtttagctagccaatcgtaaatctcttcctcgtaatctatagattgatgacaacaaacttcttcccacttgattcgtccccaagatgtaagggaaaactgtttgaaagcagttcataatattttgccgttaattcttctgataagatttctttgtttttccctagagcttctaagcattcatcaaataagtccaaaatgttcacctcaaaagctttaagtatgatagattttttcagtattagaaataagaaaaagccgttatgaaacggctaaagggaatcagaactaatgttgtttatcgaattaaacaaggaattcatgagtaggtgcgagagttacattccgggatgcttccttcatttcgccattatacatagatccgaaaaaggcaagtccaattaaaacggcggataaactgataaacaatttagatttcatacatgcattcccctttcgatatttgcttttgagcatataccatcttcttgaaacagatgatactatcctctatttttccattataatcgaaaaggttgcctcctaacaatgccagctcttccagataagggtatcctttgccgttctctaaacgagaaaaaatgttgagaagtttaggtgtatcgccatttcttatataaagaacgtctaatgcttcaaataagttcataaatagttcgtctttaaaatctacagcacttctgattcctttgcggaagcaatccattgcttgttcttttttgccttgtttaaaataaatcaacgctaggtcatgataagcttgcggaagtacgtcagagttaatttttctgtattgaaccaaggcttgttcgatgtaacgagcagccttatttaagttgtccattttgtgatagcaattgccgagattgaaaaacgcagtggcatagatatgagtatttttacttttaagcagctcggcaccttttaaagcttcttgaaggtgggggagagctttttcatgattttcaaggtcatcgtagttaccggcaatgacaaaatggcactgaatacgacgaacagagtaaagctcgtgtttcttataaatgttgtatgaaagctcagcgtaatgcatcgaaatgtgtgtcattttcatatgataatagacttcagacagtttaaaataaaactcagctttttcaatcttgtcggagattgtaggaattttgcgttcagcttttttgtaatatgtaatggctcttgtgtattcaccgtttctaaactcatacatcccgcggaagaagttataataatatgcccgcatattgtctaattttttcttatggccctcaattttatttaaatattctgaaagttccattcggttttcatcagatggcagcgtgtattccaacataattttatggcgaaaggccattagttgataataaataagcaagtcttgatcttcttccataacctctatatcacgttctatttcagcttttaacatttcagcatcagttacgttgaatttttgaatatgcctatgccattcattaatcttcattcccacttcagctgatgtgattgatatcaagatattcacccttcccttaactctactagtactgtaaatattaacaagttttcgttcgcagaaaaaggaaatagggcaccgcaatttaaattttcggtgagaccgcaataactttttgctttagagagttatgaaattccctcctgggagtaccatgacttggcatcaaaaaacagggaatttcggtcattcttgtgatagtttaaaattgaaaacatccagaaagtccagcgttagtcgttttgagggctgagtgtgcatgtacagctaaacgcagaactgattctggatttttcttgataagaaaattacttacctacccactaaaacttaaccaattaattaattaatattcatttggatatatgaaaaagtaattagacattcacctccttcgtgctcccgcaatacattatgataaatgccttcggaggtggatttattgactgagttatatgctaaaagtgatcttgaaaaaattaaagaaacgctacctggttggcaattagattcgtttaactatttgaatgaaaaaataggtgataaagaaaataaatttccttgtataccgggaaggcaagcatttttaagcgaccagctgcgaattgcttttgtcggtgatcctaggaatcccgagactgcgaaggaattagcgccattgcttactcggtatggaactatttcacgagagacaggaaagtatgcatcattaactgtaatatttcatacaccagaagaattactgactgattacaaaattgaggattacgaatcgttgttttggcagttgctcaattcattgagtatggaagatccagctgattggccagatgatataccagaaaatccagataactttcaatgggaatactgttttaatggagaaccatattttgttctgtgtgctacaccggctcacagcaaaagaaaaagcagaagttttccttattttatgttgacgtttcagcctagatgggtttttgaggatctaaatgatactactgcatttggacgaaatatgagtaagcaaattcgaaaaaggcttgaggcatatgatgaagtacctatccatccgcatttaggatggtatggaaaaaaagacaatctggagtggaaacagtacttcttgcgagatgatgaaaatcaagtgtcacaatgcccttttatgaaaatgaagaacttattcaaaaagaaaaggtctgattaaattgtttaaaaccttatgtggaaggatggattgaatggcttatatcttcacataaggttttaattgatgataaatctgtgtgctctgactaaatacgtattatctcgaattattatcgattctacatattcacaaaaattatttaatgtttttttacttgaaattagaaattagcgtttatgatctccgttgctgtagtagcaaagtagcgatggaggaaataataaaaatggaaaacctctatctggttacacaagcttttagcgggttttacaattaatcaaaataaattgatttatttgcttgcattaatttaaaaatcatgagtataataaatacatcaaaaaaaattgattaaagaaggcgatatgaatggatgagacgaaatcagaactgctacggaaatatgaacaaaaatttaaggctcttgctgatcagaaacgattagagatcatgtatgaactttgtcaaaggggaaaaacctgtgtttgtgatctgactgagatttttgaggtgacgcaatctaaactttcttatcatctaaaaattttattggatgccaacttaataacgaaagagacaaagggaacatggagttattatgatctaaatgatgaggaagtaaatggtttattatcagaagagctttgttgtatatttagaaaaaaaggtgaaggagattgctgctaaaaaaattttttaggtattatatcaaatttttttgattaatatataagagggggaattaaaatgaaatatgttcatgtaggggttaacgttgtcagtttagagaaatcgatcaatttttatgaaaaagtttttggagtaaaggctgtaaaagtaaaaacagactatgcaaagtttctattagagactcctggactgaatttcactttaaatgtcgcagatgaggtgaagggaaatcaagtgaatcattttggattccaagtagatagtttggaagaagttttgaaacacaagaaaaggcttgaaaaagaagggttttttgcacgtgaagaaatggatacgacttgttgttatgcagtccaagataaattttggattactgatccagatgggaacgagtgggaatttttctataccaaatcgaacagcgaggttcaaaaacaagattcctcctcttgttgtgtaacaccgccaagtgatattacaacgaactcttgctgttagtaaaaaaggtgaggataaagtaatgaaacgtttatcttttttagaccgttatttaaccatctggatttttcttgcgatggcattggggataggattaggttttatatttccgagttttgttggtggattaaacaaattacaagtaggaactacatctatccctttagctattggattagtattaatgatgtatccaccactagcaaaggttcgatatgaagaaattggacgggtatttaaagatattaaagtgttaattttatctttagtgcaaaactggatcatcggaccgactctcatgtttattttggctatcatctttttgccagataaaccggagtatatgattgggcttattatgattggattagctcgctgtattgcgatggttattgtttggaatgacttatcaaaaggtgatacggaatacgcggcaggattagttgctttcaactcaattttccaaatgctttttttctcagtttatgcttacatttttgtaacagttattccgcaatggttagggatggaaggagcagtagtgaatattacgatggcagaagtcgcaaaatcagtattcatttaccttggagttccttttattgcaggaatggtgacacgttatatttttgtaaaagtgaagggcaaagaatggtatgaaaaagtgttcattcctaagattagtccaattacgttaattgctttgctatttacaattatcgtcatgttttccttaaaaggtgatgtaattgttagcttgccgttagatgttgtccgagttgcgattccattattgatttactttgttttaatgttctttgtttccttctttttagggaagaaaatcggggcaaactatgctgtaactactactttagcttttacagcaggaagcaataactttgaattagcgattgctgtagctgttggtgtatttggaattcattcgggtgcagcatttgccgccgtaattggtccgcttgtagaagtgccagtcatgatagcacttgttaaggttgctttatggtttcaacgaaaatactttggaagtcactcgatgtagaggtggaatatatggagaataaaatcatttactttttatgtacagggaactcttgccggagccaaatggctgaaggatgggctaaacaatatttaggtgatgagtggaaagtgtatagcgcggggatagaagcacatggattaaatccgaatgctgttaaagcgatgaaggaagttggtatagatatctctaatcaaacgtcagatataatcgattctgatattctgaacaatgctgatttagttgttacgctttgtggagatgctgctgataaatgcccgatgacgcctccacatgtaaaacgtgagcattggggttttgatgatccggcaagagcacaagggacagaagaagaaaaatgggcgtttttccaaagagttcgtgatgaaatagggaataggttgaaggaatttgctgaaacagggaaataaataaactcttttgttaaaggatgcatatttatatgtgtcctttttttattaatgtctagctatacgaacttgacaccagtgaaatgtcattaactatctaacaatgaaaaacactactccattgtactctcaaataataataaatcattgaaaactataataagcgaatgttgaggcatagaaaataaaatcttttctattgaggacctaaaggagtgtagaaaagtcacaacaactttttttaaattttttgcatattcattgaaacgtttaataacactatagtttaatttaaaatctcctcatttggacaaacagctgttacatagcattacccaaggggtgatgcattttatgaaagtgataatcatcgagggaccgcaagctgacaaatgcattaacgattgctatcattatttaataaaactttataggaaggagattcagggtgatagcaatatatgtaagggtatcgaccgaggaacaagcgatcaagggatcgagcatcgacagccaaatcgaggcctgtataaagaaagcagggactaaagatgtgctgaagtatgcagatgaaggattttcaggagagcttttagaacgtccggctttgaatcgcttgagggaggatgcaagcaagggacttataagtcaagtcatttgttacgatcctgaccgtctttctcggaaattaatgaatcagctaatcattgatgacgaattgcgaaagcgaaacatacctttgatttttgtaaatggtgaatacgccaattctccagaaggtcaattgtttttcgcaatgcgcggggcaatctcagaatttgaaaaagccaaaatcaaagaacggacatcaagcggccgacttcaaaaaatgaaaaaaggcatgatcattaaagattctaaactatatggctataaatttgttaaagagaaaagaactcttgagatattagaagaggaagcaaaaatcattcggatgatttttaactatttcaccgatcataaaagcccttttttcggcagagtaaatggtattgctctacatttaactcagatgggggttaaaacaaaaaaaggcgccaaagtatggcacaggcaggttgttcggcaaatattaatgaactcttcctataagggtgaacatagacagtataaatatgatacagagggttcctatgtttcaaagcaggcagggaacaaatctataattaaaataaggcctgaagaagaacaaatcactgtgacaattccagcaattgttccagctgaacaatgggattatgctcaagaactcttaggtcaaagtaaaagaaaacacttgagtatcagccctcacaattacttgttatcgggtttggttagatgcggaaaatgcggaaataccatgacagggaagaaaagaaaatcacatggtaaagactactatgtatatacttgccggaaaaattattctggcgcaaaggaccgcggctgcggaaaagaaatgtctgagaataaattgaaccggcatgtatggggtgaaatttttaaattcatcacaaatcctcaaaagtatgtttcttttaaagaggctgaacaatcaaatcacctgtctgatgaattagaacttattgaaaaagagatagagaaaacaaaaaaaggccgcaagcgtcttttaacgctaatcagcctaagcgatgacgatgatttagacatagatgaaatcaaagcacaaattattgaactgcaaaaaaagcaaaatcagcttactgaaaagtgtaacgaaatccagtcaaaaatgaaagtcctagatgatacgagctcaagtgaaaatgctctaaaaagagccatcgactattttcaatcaatcggtgcagataacttaactcttgaagataaaaaaacaattgttaactttatcgtgaaagaagttaccattgtggattctgacaccatatatattgaaacgtattaaagaggggtgtatgcaccccccttttgtaattacaatctcattttcaatacacctcgctgcatacgtcgccagctttgtcccttttccagcggaatagctttcaattcctttaataagcccgatcgttccgatggagattaagtcctctgcatcctcacctgtattttcgaactttttcacaatatgggcgaccaagcgaagattatgctcaatcagcatgtttctggcatgttcatcccctttagccatgagctctaagtattttttttcttcgctgcttgagagcggttgtggaaaggcattgtttttcacgtaagatactaaaaagacaagctctttaacaacaaagccgagcgctgcgaaaacacctgtcaccatcgtcacctccacaaaagtatgtaggcaaaagcctatatgtaaatgtatgtgaccgggaggctgtctgtgtctgtaccgggaaatttctcgcgggggagtccggctttggtaagcagcatactaacttcaaatgttaaaaatattcttcatcaagcgcccatacattgaaatgaacaaaggtatggggggatggggatgaaaaaatggatggcaggcctgtttcttgctgcagcagttcttctttgtttaatggttccgcaacagatccaaggcgcatcttcgtatgacaaagtgttatattttccgctgtctcgttatccggaaaccggcagtcatattagggatgcgattgcagagggacatccagatatttgtaccattgacagagatggagcagacaaaaggcgggaggaatctttaaagggaatcccgaccaagccgggctatgaccgggatgagtggccgatggcggtctgcgaggaaggcggtgcaggggctgatgtccgatatgtgacgccttctgataatcgcggcgccggctcgtgggtagggaatcaaatgagcagctatcctgacggtaccagagtgctgtttattgtgcagtagtaaagaagaggctctttcttgagcctctgttgttacaatccttcgccgagctgaattttcgggggataggtttctgcttttcgccaatattggcgtgtgccttcgtcccgtacaacgatgcccagctgtgccagttcgagacggaattcttcaatatcgtctttttcttcgtcctgcagtgctttgtgacgagcttttaataaggcatgggcgccttgcgataggtctggtgcatcaggaatccatcggcgaaattgatctttaaacggatcaccatctgttgcccattcgtaatgatgctgtctaaaggccttctcaacgtttactggtttttcatcaatttcttcccgtaccaattcatatccggctgttcccaggaggacaagccgtttgtgatccataaatacaagagcgatgtcatcggaatgaattgtttgcactttttttcctttgatgaattccactgtgtgatctgtaattttgacagacagcagcattgcaataacagaatgagcgaaccaaatccccgcacacataccgagaagagcagtgataaatgaagctgtagatccctgaaaagaggtaatgagccgaagtggtccttcaagagggatccaggggagggataatgcccatttcgcaatctgcggaataaaatacccgattgcaaaaccgatgattgcaagtgcagcgtataaaaagaatacagcggttttcgtaactccaataagagtatgagattgattctgcaacatgtcaccttctttttactgaaaaaatcgaattccttcccatattttaacttaaactgatggtaaatcaaggataaagcgataattatggatataaagagattcagtaatagaactggcaggcgccgtcggtcatgaaaaataaaatttacatgcgcagacgatgtaagccccatttgttttctgcgtatcacaatacaatccatagggaacataaagagtaaaggctttttagacaatcaggaggaacagatatgaaaatcggattaatcggcttagggaaaatgggcataaacataggaaagcaattcattgaccgcaatcatcaagtggttggatatgatgtaaatcaagcggctgttgatgaactgaaagcatacggggctgaggggacaacaaatcttaaagagttcatttctttattacacccgccgcgcatcctatgggttatggtaccgcatggcattgtcgatgctgttttgcgtgatgtatcacctttattaagtaaaggcgatatgattatcgaagctggaaactctcattataaagaatcaattcgccgctacaatcaaatgaaagaagcgggtatccattatctcgatgccggaacgtcgggcggaatggaaggcgcacggcatggagcctgttttatggtggggggcgatcatgaagcatgggagattgtggaaccgctttttcgtgatactgccgtcgaaaatggttatctatacgctggtgaagcgggaagcggacattttttaaaaatgatccataatggaattgagtatggaatgatggccgcgattggtgaaggattcgaagtgcttgaaaacagccaatttgattttgactacgagaaggttgccagagtgtggaatcatggttctgtcattcgttcttggcttatgggactgactgagcgagctttcgctaaggatgcgaaactggatcagatcaagggcattatgcattcctcaggtgaaggaaaatggacggtggaaaccgcgcttgatctgcagacggcaacgccggtcatcgccatgtcactaatgatgagataccgttctttaacagacgatacgtttacaggaaaggtggttgctgcgcttcgaaatgaatttggaggccatgcgacagaaaaaagtaagggggccaacaagcctccttatttttttggcaccttcagaagatgagggaactttttataaatgaccagcatgatgatcagaatatatgtaccgtaaatgctgatagacaataatttattgctggtgaaattggcacctgcaatagtgacaacaacaatattggggattttccctattaaagacgcaaagaaaaaaacatgccagcgaacctggctcagcccgcagatcacgttcattacaagtgaaggtatgacaggtatcagccttcctaataaaacagcggtaaaagcgtttttgttgaaggaagcctcgtagctttgtatggcaggataggcctgaactttttttctggcccaatctctaaaactgtacctggcgagaaaaaacagcaatattgtaccaagcattgagccggtcagtgtaatccaaattccatttgcagtcccgaacactgcgccatttaaagcagcaatcaaagcaaacggcactattgggaaaaaaacatcggcagcaatcagcagcatactaaataaaacggaaaacatccctcctgctttgattgcatcaagccaagcttctttctgaaaaaaaccaactgaaatgatagcgataatcacaagtatacctattactttttttaacatgtctatggtcactcccaacttaggtgatgtcaggagtcaaaacctccgtcatctaaattagtataactggtgccatttcagctgttcaactgaaaaccaggttaagaacacaattcttttttacctcataaaaaaggctgtccatctctctgttttctgcattcttattaatagggagggatagaaatggtaaccataaaaaaggattttataccggtatcaaatgataatcgtcctggctatgcgatggcgcctgcttatattacggtgcataatacagcgaatacagccaaaggcgctgatgcgaaaatgcacgccaagtttgtgaaaaacccgaacacatccgaaagctggcattttacagttgacgattcagtcatttatcagcatctcccgatagatgaaaacggctggcatgcgggagacggtacaaacgggacaggaaaccgcaaatcgatcgggattgaaatctgtgaaaatgctgacggcgattttgaaaaagcaacatcaaatgcccagtggctgatcagaaagctgatgaaggaaaacaatattccgttaaatcgtgttgttccccacaaaaagtggtccgggaaagaatgtccgcggaaactcttggaccactggaactcttttctaaacggaatttcttcctcggatacacctccaaaagaaacttcaccatcatatcctctgccgtctggggttataaagctcacttcgccttatcgaaagggcacaaacattctccagctgcaaaaggctttagctgtacttcacttttaccctgataagggagccaaaaacaatggcatagatggagtttacggaccgaaaacagcgaatgccgtcaagcgttttcaactcatgaacggattaactgcagacgggatttatgggccaaaaacaaaggccaagcttaaatcgaagttaaagtaaatgcaggatttaacggataacctgtttccagtgcggattcaggttattttcttttctttggtttgtgtgtttttcagattggaaagaagggaattttaaaaaatcatcagctgcgccgcaatgaaagcagaatgatattcactgagggggacacgttaactataggaaaaaacagtgatagcgaaaaactcttcattgaacgaagagaaacagaggtataacattaaagtgaggcttttgggggtgtaaagatgaaacattttatcatccttttccttctgctgttcgttacagcaggatgcgagggaaggggatacgaagacgttgtagcatttggtgacagtaatacgcgtggctctaattgggattatcgcgattatccaaaagcacagcagtgggtcaatatattaaaaacagctgagcgcggtaaccttgatatactcaatgcgggaatcggcggacagacgacagaggatgcccgtctccgatttcagacagatgtgctggatcaaaaaccgaagtatttgtttattatgttcggaaccaatgacgctgccatactgactgaggggaaaccgagagtgtcgaagcagcgttttagagaaaatctggtttattttattgaagaaagcagaaaacacgggatcaagccaatcttaatgacgtgtatcccaattatagaaggtaatgggaagcatcatttgttttactattccagatatcaagcagctgcttttgaaccaaaaggcggagcaaggaaatggcacaactcatataacgatattacaagagatgtgtcgaagcgcctggatgtccctcttgtagataactggaagcattttatagaagcagacggcggaaaagcaactgatgaagcgcttatccaatctggtcttatagatccttctggaaatcatatgacacctaaaggggcaaggatcgtatatgaaggaatacaagatgggcagatcctgcagcgttgagccggacaaccgcctagtccgatttatttctcctacataggctgttataaaaccttattaaggaggcgcttcacatgtatggcgcaggcagagcatatggatacgcttttattgttgttttagttgttgttctccttgttgtgggcggcatatactggttagcataataaccggccctttaaaacacctctttttaggggtgttttttgctgaaaatagtagtaaagcgcgcagccaaagtgatataatatcagtcatctgagtaaaaaaaggaaatacgcccggaaaaaatagacaaattcctattaagaagatacggaaataatatgtccgagcgatcttctttttatttcgttttcaattaactcaataaagtcacggtttaaattcatttcggtggctttgaaataagattctattagtaattcatcagacagttttctcatgctaggaacccaattaatgggagaggcacctccttaaaagttggaatcattcatgattttaacgcatacaatgataagttgcattcatctgaggttgaagttatctttaatctaccatgaaatgcatataagaacaatcgttctgttatccacaccaaaaagtggataacttgtgagtatcgtgtttataatttgtctaaagagtgatgtaataagagtggatagtgtgtgtaaatttatccacacctggtgaagaaacccaatttttgtcgaaatttttttgctcagtttttctttaggcgcaagttcgatttttttcgacaatcattttgaaagaaagaaaaagggaagggtgcgggttttgttaaaaaagtttttttacctgacgagtttgtaaaaaatatttttcatattacacctgagaaattaaaggaacgaaatgtaaaaggaattattactgacctggataatacgcttgttgaatgggacaggccgaacgcgacgccgcgattgatcgagtggtttgaagaaatgaaggaacacggcattaaagtgacaattgtctctaataataacgaaagaagagtgaaacttttctcagaaccgcttggaatcccattcatctataaagcaagaaaaccgatgggtaaagcctttaatagagcggtgcgcaatatggagctgaaaaaagaggactgcgttgtcatcggagaccagctgctgaccgatgtactcgggggaaaccgaaacggctaccatacgattttggtcgtgccagtcgcttcctctgacggattcattacgcgctttaaccgccaggtcgaacgcagaatactgagtgctctcaaacgaaaagggcacattcagtgggaggagtaagaaatggaaaaggttgtttgtatcgggtgcggagttacgatccaaaccgaggacaaaacaggtttggggtacgcgccgcctgcatcgcttacgaaagaaaatgtgatttgccagcgttgcttcagactgaaaaactataatgaaatacaagatgtctccttaactgatgatgattttttgaacattcttcacggtattggagaaacggactctctggtcgtaaaaattgttgatatttttgattttaacggcagctggattaatgggctgcagcgcttggtggggggaaaccctatcttattagttggcaataaagcggatattttgcctaagtcactgaaaagagagcgtctgatccaatggatgaagcgtgaagcgaaagagcttggcttaaaaccggttgacgtatttttggtcagtgcgggtcgcggccagggaatcagagaagtaattgacgcgattgagcattaccgcaacggaaaagacgtctatgttgtcggatgtacaaatgtaggaaagtcaacctttattaaccggattattaaagaagtgtcaggtgaagaagatattattacaacatcccaatttcctggcacaacccttgatgcgattgaaatcccgctggatgacggttcatcgctttatgatacaccgggaattatcaacaaccatcaaatggcgcattatgtcaataaaaaggacctgaaaatattatctcctaaaaaggagctgaagcctcgcacattccagcttaatgatcagcaaacactgtattttggcggacttgcaaggtttgattatgtgtctggggaaagatctccttttatttgctatatgccgaatgagctgatgattcatagaacaaaacttgaaaatgcagacgcgctttatgaaaagcatgcaggggaattgctcacacctccgggtaaagatgaaatggatgagtttcctgaattggtcgcccatacgtttacgataaaagacaaaaagacagatatcgttttctctgggttaggctgggttactgtccatgacgctgataaaaaggtaactgcatacgcgccaaaaggcgttcatgtatttgttcggcgttcattaatttaagaaaaggggagaggtgtatgaaaaagctgtacggggttatcggaaatcctattggccattctatgtcacctgatattcataacgcatcattgaaagacctcgggcttgacggacattatcatgccttcaaggtagaagagaatgatctggaggatgcggtaaaaggaataagagctctaggcgtacaaggaatcaatgtgactgttccgcacaaggtttccattatggattatttggatcatattgatgagagtgcaaaagtgctcggtgccgtaaacacggtcagaagagagggagataagcttgtcggatacaataccgatggggaaggcttcgtgaagtcattaatgaaggtattagacaagcccatctctgaactgtcattcttaatgatcggcgctggcggagcggcgagagccatttttacaacaattgtccgaaataccccgaaaaaatttgacatttgcaaccggacgttagaaaaagcaaagcggcttacagaagctactccctcgtttcacaataaagaagtattaagcataaaagaagcagaagaacgtcttgagcagtatgatgttatcatccatacaacgtctgtgggcatgtatccgaacgtggacgatgtgccgctttcattacagcgtgccgcgagcagtgccgtcgtatgtgatatcgtgtataatccaatacagacggcacttttaaaagaagcaagccaaaaaggcttgaaaacactcgatggtgtgggcatgtttgttgaacaggcagcattgtctttccaattgtggactggacaagagcctaatattgaaaaaatgagatctattgtaataggaaaattaggaggaacagaatgttaacaggtaaacaaaaacgttttttgcgttcaaaagcgcatcatttaacgccgatttttcaagtaggtaaaggcggagtaaacgacaacatgattaaacaaattgctgaggcgcttgaagcgagagagctgattaaagtcagcgtgcttcagaattgcgaagaggataaaaacgatgtagcggaagctcttgtaaaaggaagccgctctcaattggtgcagacaatcggcaatacgattgtgttatataaggaatcaaaggaaaataaacaaatcgagcttccttaaaggtggttgaaatgaagaaaatcggaattttcggaggcacgtttgaccctccgcataatggtcacctcttaatggcgaatgaggtgctgtaccaggcggggcttgatgaaatttggtttatgcctaatcaaattccgccgcataaacagaacgaagactataccgacagctttcatcgcgtggaaatgctaaagcttgcaattcaatctaatccgtcctttaagctggagcttgttgaaatggaaagagaagggccatcatatacctttgataccgtttctttactgaagcagcgttatccaaatgatcagctgttctttattatcggcgctgatatgattgaatatttgccgaaatggtataagctggacgagctgctgaacctcattcaatttattggagtaaagcgccccggttttcatgttgaaaccccttatccgcttctctttgcagacgttccggaatttgaggtatcatcaactatgataagggaacggtttaaaagcaagaagcccactgactacttaatccctgataaagtgaagaagtatgtagaggagaatggtttatatgaatcgtgaggaggcacttgcatgcgtgaagcagcaattgaccgaacaccgatatatccatacggttggcgtgatgaacacggcgatcgaacttgcggagcgttttggagccgattctaaaaaagcggaaatagcggcaatctttcatgattacgccaaattccgcccgaaagaagaaatgaaacaaattattgcgcgtgaaaaaatgcctgcgcatttattggatcataatccggagctctggcacgctccggtcggcgcttatttggtccaaagagaggcaggggttcaagatgaagacattcttgacgccattaggtatcatacctcaggccgccccggcatgacacttttagaaaaagtcatttacgttgccgattacattgagccaaaccgggcatttcccggtgtcgatgaggtgcgtaagcttgctgagacagatttgaatcaagcgctgattcagtccattaaaaatacaatggtttttcttatgaaaaaaaatcaaccggtttttccagacacatttttaacgtataactggcttgtgtctggcagctgaacaggaggaatttgtgaatgaaccaaaagtccattttaaagatcgcagctgcggcttgcgatgataaacgggcagaggatattttagcactggatatggaaggtatttctctggttgctgattattttctgatctgccacggaaattcagataaacaggtacaggcgattgcccgtgaaatcaaggatcaagctgatgaaaacggcattcaagtcaaaaagatggaaggctttgatgaagcaagatgggttctcgttgatctaggcgatgtagttgtccatgtcttccacaaggatgaaagaagctactacaaccttgaaaagctgtggggagacgctccgctcgcagatcttgactttggaatgaatcaatgatttatcaaggctttgcaagcgtgtatgacgagctaatgtcacacgcgccttacgatcaatggacaaaatggattgaagcatctctcccggaaaaaggccgtattctcgatctggcatgcggcacgggggaaatctccatccggcttgccgaaaaaggcttcgaggttacaggcatcgatctcagcgaagagatgctttctttcgcccagcaaaaggtatcgagtagccagcctattttatttcttcagcaggatatgagagagattaccggctttgacggtcaatttgacgctgttgtgatatgctgtgactcattaaattatttaaaaacaaaaaatgatgtgatcgaaacctttaaaagtgtttttcgggtattaaagcctgaaggcatcctgctgtttgatgttcattcatcttttaaaattgcggaagtctttccggatagcacatttgctgaccaggacgaagatatcagctatatttggcagagctttgccggaagtgacgagctttctgtcattcatgatatgtcgttttttgtgtggaacggagaagcgtatgatcgttttgatgagacacacgagcaaagaacgttcccggtggaagaatacgaagaaatgcttaagaactgcggctttcagctccatcgcgtgacagctgattttacggataccgagccatcagcacaatcagaacgcctctttttcaaggcgcagaaatcaaaaaccatcgtttcctaaaacgatggttttttaaaatgcttttttatgcttttgcagtacagacgaacgtatgacatactcgtctacacatgaaactgctttttcactgcggaaatatcctcctcgtacttcatatgagtattttgaaatacccggtgaaacatatcctgcacaccgctttccagcgctttaatgccttctcctgttacaccgcctttaacgcaaaccttttcctgtaatgcaggcagggtatacaattcggtttctaacagttttcccattccgacaagcatttccttacacatcaaaatcgcgtcctgtttagacactgatgtttccgaaacagctgcatctataaaccgctgaatcagatagctcataaaagcggggccgcagcttacgatgtctgatgcaaccctcgtgatgtcactttcaatttgcagcggatgagagatatgctgcatcagctcattgattttcgcttttgcagattcgccgcagcttgtgccgaaagtgacgagagaaacacctgccagcgctctgttcgtaatacttgggatcactcgcgccacttgacacggcacatattgttcgagctgttcggtttgaacggggcttgtaattgaaatgagaatatgatcttttcttaaataaggtaacgctcttgccagtaaaggatatatatcaagcggcttaacacaaataaaaatcatctcgttttcagaaacgagcttttcgagactttcggtaacgtttatgctgttgtagcggttttttatgtgcaacgctttttcaattgtgcggtttgtgattgtcatgtttgagggatcggccgcttttgattcaataaatgattcgataaggatcgtacccatatttcctgtgccgataaagcctatcttcaatggtttcccctcctttgagctattatcctctaaaccatatgtgttatgaaaataaaatatgacgaaagcggggaacatgcacgatgaattggttgaatcagcataagaaagcaattattttagcggcttctgcggctgttttcacagcgattatgatctttctggccacagggaaaaataaagagccggtgaagcaagctgtaccaacagagacagaaaatacagtggtaaagcaggaagcaaacaacgacgagtcaaacgaaacaattgtgatagacatcaaaggtgctgttcagcatcctggcgtttatgaaatgcgaacaggggacagagtatctcaggcaattgagaaagcgggcgggaccagtgaacaagcagacgaagcgcaagtaaatttggcggagattctgcaggacgggacagtggtgtacatcccgaaaaagggagaggaaacagcagtgcagcaaggtggcggagggtctgtccaaagcgatggagggaagggagcgctggtgaatatcaatacagcaaccttagaggagttacaaggcatctcaggggtggggccatccaaagctgaagctattattgcataccgggaggaaaacggtcgtttccaaacaattgaagatatcactaaggtttcaggaataggtgaaaagtcatttgagaaaataaagtcttccattacagtaaagtgatttgacggtcatgcattatgataggtaaactaaaggtcaggcaacacaacatttggagggaacaacgtggaacgaatttcatggaatcaatactttatggctcaaagccatttattggcgctgcgcagcacatgtccgagattatctgtcggcgctactatagtcagagacaaacgcatgatagcaggaggctacaatgggtcaatcgcgggcggcgtacattgtgcagatgaaggatgcttaatgatagatgatcattgcgcaagaaccattcacgctgaaatgaatgcgattcttcaatgctctaagtttggggtgccgactgatggagccgagatttatgtgacgcattatccgtgcattcaatgctgcaaatctattattcaagctggtatcaaaacggtttattatgctgaggattacaaaacacatccgtatgcgcaggaattatttgaacaggcgggtgtaactgttgaacaggttgaactcgatgaaatgatcgttgatctgaaaaacagagaaaagctttcatttgtagcgggtctaatagggaaattggctgatgccggtttagcggaggaagaattgaaaaagatacatgaacaggcgaatacacttttcacgagctacgtgtgatgaatgcgtaattcgcgcttattattgcctatggcggcagcttcggcaacggctggaattactgccgccgcttatttccccgctatttttcttttcatcctctttctcctcatcattttaatcaaaacgaggcacgcttttcttattattgtttgtttcttctcttttatattgttttttgtactgtatgcagtcacagattctcagaatgtctcttcctatcggcagggaacctatcaattcaaggcagtgattgacactattcccaaaattgacggcgaccgtatgtctatgatggttgagacacctgataaggaaaaatgggctgctgcgtatcgcattcagtctgctggtgaaaaagaacagctgttatacatagaaccaggaatgtcatgtgagttgactggtacattggaagaaccgaatcacgcaactgtgccgggtgcatttgattataacgagtatctttatcggcagcatattcattggaactactctgtcacgtctatccaaaactgcagcgaacctgaaaatttcaagtacaaggtgctcagcttgagaaaacatatcatatcattcacaaacagccttctgcctcctgattcgacagggattgtacaggcacttacagttggtgacagattttacgtggaggatgaagtgcttaccgcgtatcaaaagcttggtgttgtccatctcttggcaatatcaggactccacgtggggattttgacagcaggtttgttttatatcatgatccgccttggtataactagagaaaaggcgtcaattctgttgctgttatttctgccgctctatgtgatgttgaccggcgctgctccttcagtgctacgcgccgctctcatgtcgggtgtttacttagctggaagtcttgtcaaatggcgtgtccgctctgcaactgcaatttgcctttcgtacatcgtccttctgctcttcaatccttatcatctctttgaagccggttttcagctatcgttcgccgtcagtttttctttaattctatcctcttctatttttcagcaggttaaaacctccttggggcagctgacaattgtatcactcatcgctcagctgggctcgcttccgattctcctatatcattttcatcagttttctatcatcagcgtaccgatgaatatgttgatggtaccattttataccttctgtattttgccgggagctgtagcaggtgttcttctattaagtctttccgcttcgtttgggagattgtttttcagctggtttgatttattgataagctggatcaataggttaatcacaaacattgcagatgttgatgtgttcacgattatgatcgcacatcctgcacctgttttgctttttttattcacagtcacgatcatcctattgcttatggcgattgaaaaacgctccttgtcgcagttgatggtaaccggaggcatttgctgcacggtgatgtttctgctctttatatatccgtgtcttagttccgaaggagaagtggatatgatagatattggacagggtgacagcatgtttgtaggtgctccgcatcagcggggtcgtgtcttaattgataccggcggcactttgtcttactcgtcagagccttggcgcgaaaaacagcatccgttttcactgggggaaaaggtgctgattccgtttttaactgctaagggaatcaagcagcttgacgctttaattctgacgcacgctgaccaagatcatatcggagaggcggagattctgctgaagcatcataaagtaaagcgcctcgtgattccgaaagggttcgtttctgaacctaaagatgagaaagtgctgcaggcagccagggaagagggagtggcaattgaagaggtgaagcgaggcgatgtgttgcaaataaaggatttgcagttccatgtactgtcaccggaagcacctgatccggcaagcaaaaataattcatctctcgttctgtggatggagacgggcggtatgagctggatcttgacgggtgatctggagaaagaaggggaacaagaggtgatgaacgtgtttccgaatataaaagcagatgtgttaaaggtggggcaccatgggagcaaaggctctaccggtgaagaattcatccaacagcttcagccgaaaacggccattatctcagccgggaaaaacaatcggtaccatcatcctcatcaaaaagttctgcaactattacagagacattctatccgcgtgctgcgaacagatcaaaacggaacgatccaatatagatacaaaaacagagttggaaccttttctgtctatcctccatatgatacatcagatataacagagacgaactaaaaaagactgccgagaaatcagcagcccgggcagtcgctgttatgaaccaactaggtgaataaccgttgccatgacaaacaagaaggcgaaaaatccgaaggacacaacaaaaccaacagctgaatctacagcatcatttcgtttgctttgaacgtttttttcaaaatcattcaactttatccctcctgactgacttaagtataatggaattgttttgaaaaatctagaagctaaggtaacgttttctgttctggtgattatcgcctttttacaagctgtcccgggggcttgcgaacaggcgtttaatataaatggggaagcagcagtcaggcttcctctttactattttgcaaactcaatttaggatagaaggggatgatgaaagagaggaagtcgtacaacaatggtatttgatgtgtggaaaagcctgaaaaaaggagaggtccatccggtttattgtttatacggaaaagagacatatctgctgcaagaaaccgtcagcaggatcagacagacggtcgttgatcaggagacaaaggatttcaatctgtccgtttttgatctggaagaggacccgctggatcaagcgattgcagatgctgaaacgtttccgtttatgggggagcggcgtcttgtcattgtgaaaaatccatattttttaacaggtgaaaagaaaaagaaaaaattgagcacaacgtcagtgcgcttgaatcatatatacaatcacctgcgccttacacagtctttgtcctgcttgctccgtatgaaaagcttgatgagcgaaaaaagctgacgaaagcgttaaagaagcacgcgtttatgatggaggcgaaggaattaaatgcaaaggaaacgacagactttactgtcaaccttgcaaaaacagagcagaaaacaatcggcacggaagcggcggagcatttggttctgcttgtgaacggtcatctgtcatcgatttttcaggagattcaaaagctctgcacgtttattggagatcgtgaagaaattacgctggatgatgtaaaaatgcttgttgctagaagccttgaacaaaatatttttgagctgatcaataaaatcgtcaaccgaaaacgaacagagagtctgcaaattttttatgatttgctaaaacaaaatgaagaaccgatcaaaattatggcgcttatttcgaatcagttccggctgattctgcagacgaagtacttcgcggaacagggatacggacaaaaacaaatcgcttctaatctaaaagttcacccatttcgggtaaagctggcgatggatcaagcaaggcttttttcagaggaggagctccgtttaattattgaacagcttgccgtcatggactatgagatgaaaaccgggaaaaaggacaagcagctcctgctcgaactgttccttttacagctgttaaaaagaaatgaaaaaaacgatccccattattgaggatcgtttttatattatgcagaaagtccgttcacttttttcgctagtcttgatttgtatcgagctgcggtatttttgtgtacaagacctgttttcactgctttatcaatacgtttagctgcttcagtaagagcagttttcgctttgtcagcttcgttgttggcaacagaagcttcaacttgtttgattgcagtacgcatagcagatttgattgtcgcgttatgaacgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacacacctttagattgcaatataaatgtaaagtatttttcattgaaggttctctttttagcatgatttattcagcaaatggcaacaatataggtacttaatgtgaaggaggcccctgtatgaaaaagagtgagctggatgtgaatcagtatttgatacggaccgatttggcagtggaaacgaaggaagcaatggccaatcagcaggctgtgccgacaaaagaaattaaaggctttattgaaaaagagcgtgatcacggcggcattaaaatccgcacagttgatgttacaaaggaaggcgcagagctttcgggaaaaaaagaagggcgctatttaacgcttgaagcacagggaatcagggagaatgattcggaaatgcaggagaaggtctctgctgtctttgcggaggaattctcagcttttcttgaaaaccttaatatctcaaaagatgcgagctgtttgatcgttgggctcggcaactggaacgtgacacctgatgcgcttggaccgatggcagtagaaaatctgttggtaacaaggcacttgtttaagcttcagccggaaaacgtacaggagggttacaggcctgtcagtgcttttgcaccgggtgtaatggggataacaggaatcgaaacaagtgacattattaaaggtgtgattgagcaatcgaagcctgattttgtcatcgccattgatgcgttggcggcgcgggcggtggaaagggtcaacacaaccattcaaatatcggatacaggcattcacccggggtctggagtggggaataaacgaaaagatttaagcaaagacacgcttggtgttccggtgattgctatcggtgttccgacagtagttgatgccgtgacaattgccagcgacacggtggactacatattaaaacattttggcagagaaatgaaggataacaggccatcaagatcgcttgttccggcaggcatgacgtttgggaaaaagaaagtgctcactgaagacgatcttcccgatcaaaagcagcgccaatcgttcctaggtattgtcggaacccttcaagaagatgaaaaacggcagctcattcacgaggtgctttcgcctttagggcacaacttaatggttacaccgaaggaagtcgattcatttatcgacgatatggcaaatgttttagcgaacggattaaacacagcgcttcatgaaaaagtgtcacaagaaaacaaaggctcctacaatcactaaacagttctacttcctctagcttgttcatagagtaattactagacaagcgctggagggattcaatgagaaataaacgcagaaacagacagattgttgttgcggtaaatggagggaaagcggtaaaagccatctttctatttatcgtaagccttatcgtgatttttgttctatccggtgtgctgacgtctctccggccggaacttaggccgtcgtctgactctttttatgggattgctgaagaattgccgggtgacgtatttgcacatttgctgcagatggaaaaccattatttcgcttctgacctctctcaaacagacagctcatttcatctttctcgtctttctttaaagctggcgacgagcattaacctcgaagatccgcggagctttctcggtcgggagctgccaggatttgcacaatttgataccgagattttgttagctggacaaggaacggattatacgaatatgcctgcggaatcgccgccgccgtctaaggtgatggaggaagaaagagaagcgaatttggcagagattgaaaaacagcaaacgcaatcagataatgcgcaaaaagatccgccgaaacaaacaacaggtgataaaaaggtcgtgtttatctatcacacgcacaatacggaatcatatctccctctattaaaaggcgagaccgatcctgacatggcgcgccattctaaagccaatgtcacgcttgtaggagatatgttcggacaagcgcttgaatcccagggaatcggagccacagtgaataaaaccgatatacagtcaaaattgaataaaaaaggcttaaactatgccaggtcctatgatgaatcaaggccggtcgtgaaagacgccctcgcttcaaacaaaaatctgcaatatatcattgacatccacagagactctcggcgcaaaaaagacacaaccgcaacgattaaagggaaaagctatgccagggtagcctttgtcgtcgggaaaaaaagcaaaaacttcgaagaaaactataaaattgcgagtgagcttcataaactgatggagaaaaaataccccggacttagcacaggtgtcttttccaaaggctcgccaggcgataatggtgtttacaatcaggatttaaccgatagagcgcttttgctcgagtttggcggagtggataataatctcgaagagctgcagcgtgcggctaacgcggccgcggacgtattcagcgaaatgtactgggatgctgaaaaggtcaacgcagcgagcggggagacgaaaaaacaataagaaataggtggttgatttgattgcatactttggaaagtgcttactgcttgtcacgatcatgtttttaggcgttctgttcggcatgcagcaggcaaaccacgggatgctgagtatgaaaggctatcatgacccttcactgaagggggcgtttacgctcaccgacggaaaagataatgaaaaagaagcctcaatcctaggagaaacagtcacggcaaaagatttagtagaaaaacaaaaagagctggaaaaggtggagacattcaatatgttttcaaaagccggaaaagcgctttcggacaccgtaaccaatactgcccagtcaatgtatgaatggatacgggatatgaatcaataagtacgtgaaagagaaaagcaacccagatatgatagggaacttttctctttcttgttttacattgaatctttacaatcctattgatataatctaagctagtgtattttgcgtttaatagtaggagtgatagattgtgacagataaagaaaagcgtttagagaggcaatcgagaatacggaatttctctatcattgcccatattgaccacggaaaatcgaccttagcggatcgtattttagaaaaaacgtcggcaatcactcaacgagaaatgaaagaacaattgctcgattctatggatcttgaacgtgagcggggcataaccattaaattaaactctgttcagcttaaatataaagcaaaagacggagaagaatatatctttcatctaatcgatacgccgggacacgtcgacttcacgtatgaagtatcccgaagccttgctgcctgcgagggagcgattcttgtcgtggatgcagcccaggggattgaagcgcagacgctcgccaatgtctacttagcgcttgacaacgatcttgaaatccttccggtcatcaataaaatcgaccttccgagcgccgagcccgaacgtgtgcgccaagaggtagaagacgttatcggccttgacgcatcagaagccgtgcttgcttcagcaaaagccggtatcgggattgaggagattttagaacaaatcgtagaaaaggtgccagctccgaccggagatccggaggcgccgctcaaagcgctgatcttcgactcgctttatgacgcctaccgcggtgtcgtggcttatatcagagtcgttgaaggaacggtaaagccgggacaaaaaatcaaaatgatggcaaccggcaaagaattcgaagtaacagaggtgggcgtgttcacgccgaaagcaactccgacaaatgaactgacggtcggtgatgtaggcttcctgactgcctcaatcaaaaatgttggtgacacacgtgtcggtgatacaataacgagcgctgccaatcctgcagaagaagcgctgccgggataccgcaagctaaacccgatggtgtactgtggtttgtatccgattgatacagcgaagtataatgatttaagggaagctcttgaaaagcttgagctgaatgattcctcccttcaatatgaagcggaaacttcgcaagcgcttggattcgggttccgctgcggatttttaggcatgcttcacatggagatcattcaggagcgaattgagcgtgagttcaacatcgacctgattacgacagcgccaagcgttatctatgacgtgtatatgacagacggcgaaaaggtcgttgtcgacaacccgtccaacatgccggatcctcaaaagatcgaaagggttgaggagccatacgtaaaagcgacgatgatggtgccgaatgactatgtcggcgctgtaatggagctttgccaaggaaaacgcggcaatttcattgatatgcagtatttagacgcaaaccgtgtcagcatcatttatgatatgccattagcggaaatcgtatatgagttttttgatcagctgaaatcaagcactaaaggctatgcgtcctttgattatgaactgatcggctacaaaccgtccaagcttgtgaaaatggacattatgctgaatggtgaaaaaatcgatgccctttcctttatcgtgcatcgtgattacgcatatgaacggggaaaagtgatcgttgaaaaactgaaagaactcattccgcgccagcagtttgaagttccggtacaagccgcaatcggccagaaaatcgtggcccgctccaccataaaagcaatgcgtaaaaacgtattggctaaatgttacggaggggacatctcgcgtaaacggaaacttcttgaaaaacaaaaagaaggaaagcgccgtatgaagcaggtcggctcagttgaagtgccgcaagaagcatttatggcagttctgaaaatggacgacagtccgaaaaaacaatagaagccgccgcagtcttgtactgcggcttctttctgtaaagaaggtgaatccgttgaaatcagcttatatccatatcccattttgtgagcatatttgccactactgcgatttcaataaatattttattcaaagtcagccagtcgacgagtatttaaacgcactcgaacaggaaatgataaatacaatagcaaaaaccgggcagcctgatctcaaaacaatctttatcggaggaggcacgccgacctccctgtctgaggaacagcttaaaaagctgatggatatgatcaaccgcgtgctaaagccctcaagcgacttatcggaatttgcggttgaagcgaatccggacgatttgtccgcagagaaattaaaaatattaaaagaagcaggcgtaaatcgccttagctttggtgtgcaaacgttcgaagacgatctgttagaaaaaatcggccgagtgcacaagcaaaaagatgtattcacctcttttgaaagagcgcgggaaatcggttttgagaatatcagtcttgatctcatgttcgggcttccggggcaaaccctcaagcatctggaacattccataaacactgctttatcattggacgctgagcattattccgtttactcccttattgtagaaccgaaaacggtattttataatttgatgcaaaaagggcggcttcatcttccgccgcaggagcaggaagctgaaatgtatgaaatagtgatgagcaagatggaagctcacggcattcatcaatatgaaatcagcaactttgctaaggcaggcatggaatctaagcacaatctaacgtattggagcaacgaacaatatttcggtttcggagctggcgctcacggatatattggcggcacacgaacagtgaacgtcggacctgttaagcattacattgacctgatagctgaaaagggttttccgtacagagatacacatgaagtgacaacagaagaacagattgaggaagaaatgtttttaggtttgagaaaaacagccggtgtcagcaaaaaacgattcgcagaaaaatacggccgttccctggatggacttttcccaagcgtgttaaaagacctcgctgaaaaagggctgattcacaattcggagtctgccgtttatttgactcatcaagggaaattattaggcaatgaagtttttggcgcttttttgggtgagttataattgacatttttcttgtggtttgatacttttgttatagaattagcactcgcttattgagagtgctaacagaggtgatgatgatgttaacaaatcgtcagctgctgatccttcaggttataatcaacgattttattaaatcggcacagccggtgggatcaagaactctttcgaaaaaagatgaaatcacatttagctctgcaacaataagaaacgagatggctgacttggaggaattgggctttattgaaaaaacccattcatcctcaggacgtgttccgtcagaaaaagggtatcggtactatgttgaccatttgctgtcacccgtcaaattgacgaaaagcgacctggaccaaatccactcgatcttcaaagagaaaattttcgagctggagaagacagttcaaaaatcagcgcaaattttgtccgatctgacgaattacacatccatcgtactcgggccgaagttgagtgagaattaccttaaacagattcaaatcattccgattcagcctgatatggcggtagcgattctcgttaccaatacggggcatgtggaaaacaaaacgattaactttccgaccaaaatggatctgtctgatattgaaaaactggtaaatatactgaacgaccgtttaagcggcgttccaatggatgaactgaatgagcgcatatttaaagaagttgtcatgtacctaagacagcacattaaaaactatgacaatatactcgacgcgcttcgttcaacctttcattccacaaatcacgttgaaaagttgttttttggcgggaaaatcaatatgctgaaccagcctgagttccatgatatcacccgagttcggtcgctgctttcattaattgagaaagaacaggatgttttaaagctggttcaatccccgcacacgggaatttcgattaaaatcggaaaagaaaacgactatgaagagatggaaaattgcagtctgattacggcttcttattccgtagaccagaagcagatcggctcaattgcgattatcggcccgacccgcatgaattattccagggttgtcagcctgcttcagcatgtgacttcggacttgtcaaaagcattaacaagtctgtatgatgaataagggaattttggcaaattttatcgaagggcagcacctgtccttctccttacactttgagggaggtgaacacaatgtcagaagaaaaacaaaccgttgaacaaaacgaaacagaagagcaagaaatcattgaagaacaagctgccgctgatgaacagcaggaagaaacaaatgaaagcgaacttcttcaaaaccaaattaacgaattgcaaggtttgcttgaggaaaaagaaaacaaacttttgcgtgttcaagcagactttgaaaactataaacgacgcagccgtttagagatggaagcgtcccaaaaataccgttctcaaaatatcgtgactgatttgctgccggctcttgacagttttgaacgagcgcttcaggttgaagccgacaatgaacagacgaaaagtttgctccagggaatggaaatggtccaccgtcagctcgtagaagccttgaaaaaagaaggcgtcgaagccatcgaagctgtagggcaggaatttgatcctaatctgcaccaagctgttatgcaggctgaagacgaaaactacggctccaacattgttgttgaggaaatgcaaaaaggctataagctgaaggatcgcgtcattcgcccttccatggtcaaagtgaatcaataattacatagcaggaggttattcaagtgagtaaagttatcggaatcgacttaggaacaacaaactcatgtgtggcagtgcttgaaggcggcgagcctaaagttattgctaacgctgaaggaaaccgcacaacgccatcagttgttgcatttaaaaacggcgaacgtcaagtaggggaagtggctaaacgccaatctattacaaaccctaacacaattatgtctatcaaacgtcatatgggtactgattataaagttgaaattgaaggaaaggattacactccacaagaagtgtctgctatcatccttcaacaccttaaatcatacgctgaaagctatcttggcgaaacagtatcaaaagcagttatcacagttcctgcatactttaacgatgctgagcgtcaagcaacaaaagacgctggtaaaattgcaggtcttgaagtagaacgtatcatcaacgagccgactgcagcagcgcttgcatacggacttgataaaacagatgaagatcaaacgatcctagtatacgaccttggcggcggtacattcgacgtttccatccttgagcttggcgacggtgtattcgaagttcgttcaactgccggcgacaaccgtctgggtggggacgattttgaccaagttatcatcgatcatctggtgtctgaattcaaaaaagaaaacggcattgatttgtcaaaagacaaaatggcgcttcagcgtttgaaagacgcagctgaaaaagcgaaaaaagatctttccggcgtatcttctacgcaaatttctttaccgtttatcacagctggagaagcaggaccgcttcaccttgaacttacattaactcgcgctaaattcgaagagctttcttctcatttagtagagcgcacaatgggtcctgtccgtcaagcgcttcaagatgcaggactttctgcaagcgaaatcgacaaagtcatccttgtcggcggatcaactcgtatccctgccgtacaagaagcaatcaaaaaagaaactggaaaagaagcgcataaaggcgtaaacccggatgaagttgtagcgcttggtgctgcgattcagggcggcgttatcacaggtgacgtaaaagatgttgttcttcttgacgttacaccgctttctctcggtatcgaaacaatgggcggtgtgtttacaaaactgatcgaccgcaacacgacgatcccaacaagcaaatctcaagtgttctcaactgctgctgataaccaaacagctgttgatatccatgttcttcaaggtgagcgcccaatgtctgccgacaacaaaacactcggccgcttccagcttactgatatcccgccagcaccgcgcggcgtgcctcaaatcgaagtttctttcgatattgacaaaaacggtatcgtaaacgtaagagcaaaagacttaggcacaggaaaagaacaaaacattacaatcaaatcttcttcaggtctctcagatgaagagatcgaacgcatggtaaaagaagcggaagaaaatgctgacgctgatgcgaagaaaaaagaagaaatcgaagtccgcaacgaagcagatcagcttgttttccaaactgagaaaacattaaaagatcttgaaggcaaagtggacgaagaacaagtgaaaaaagccaacgatgccaaagacgctttaaaagcagcgattgagaaaaacgaatttgaagagatcaaagcgaaaaaagatgagcttcaaacaatcgttcaagagctttctatgaagctttatgaagaagctgctaaagcacagcaagctcaaggcggagcaaacgctgaaggcaaagcggatgacaacgttgtcgacgctgaatacgaagaagtaaacgacgaccaaaacaaaaataagttctttttagtgtcagccccgcttccggagctgaccgaaaagaacacatttcataatctgattcaatgattagaaagtcaaagtcaggcatctcttggctttgactttttttcttgcccgggataaaaggaattgaaaaatcataattcaaaatgatacaatctaatttatgtgagaaattcgggagagtgaagcgagatgagtaagcgtgattactatgaagtgctgggagtaagtaagagcgcttcaaaggatgaaattaaaaaagcttatcggaagctgtcaaaaaaatatcatcctgatattaacaaagaagccggatcagatgaaaaatttaaagaggtaaaagaagcatacgaaacgctgtcagatgaccaaaaacgtgcgcattacgatcaatttggtcacactgaccctaaccaaggcttcggcggcggaggttttggcggcggcgatttcggcggttttggtttcgatgatattttctcaagtatattcggcggaggcacaagacgaagagatccaaacgctccgcgccagggtgctgatttacagtatacgatgaccctgtcgtttgaggatgcggctttcggtaaagaaacaaccatcgaaattccccgcgaggaaacgtgcgaaacatgtaaaggctcaggtgcgaaacctggaacaaatccagaaacatgctcccactgcggaggctccggccagttaaacgtggagcaaaatacaccgtttggaaaagtcgttaacagacgggtctgccaccactgtgaaggtacaggcaaaatcattaaaaacaaatgtgcggactgcggcggcaaaggaaaaatcaaaaaaacgcaagaaaatcaatgtgacaattccagccggtgtagatgacgggcagcagcttcgtctctcgggacagggtgaaccaggaataaacggcggccctgccggggatttatttgtcgtgttccatgtacgcgcacacgagttcttcgagcgtgacggcgatgatatttactgtgaaatgccgttaacgtttgctcaggctgctcttggagatgaggtagaagtgccgacgctgcatggaaaagtgaaattgaaaattccggccggtacacaaacaggaacgaaattcagattaagaggcaaaggcgttcaaaatgtcagaggctatggacagggtgaccagcatatcgtcgtccgcgtcgttacgccgacaaatctgactgataaacaaaaagacattatccgcgaatttgccgaagtcagcggaaacctgcctgacgaacaggaaatgagtttctttgacaaggtaaaacgcgcgtttaaaggcgattaattattggatgaggagttggtagttttgaaatggtccgaattaagcattcacacaacacatgaagcggtcgaacctatctcaaatatattgcatgaagctggtgcaagtggggttgtgatagaggacccgcttgatttaattaaagaacgtgagaatgtgtacggggaaatctaccagctcgaccccaatgattacccagatgagggtgtcattgtcaaagcatatctgccggttaacagttttctgggcgaaactgtagacggcatcaaagaaacgattaataatctccttctttacaatattgatttgggcagaaaccacatcactatttctgaagtaaatgaagaagagtgggcgactgcctggaaaaagtattatcatcctgtgaaaatttctgaaaagtttacaattgtgccgacgtgggaggaatatacgccggtccatactgatgaactgattattgaaatggacccgggaatggctttcggcacagggacacatccgacaaccgtactctgcattcaggcgcttgaacgctttgtgcaaaagggtgataaggtgattgatgtcggcactggttcgggaattttaagtattgcggctgcaatgcttgaggctgaatcggttcatgcctacgatcttgatcccgtggctgtagaaagtgcacgcctcaatctcaagctgaacaaagtcagcgatattgctcaagtgaagcaaaacaatttgttagacgggattgaaggggaacatgatgtgattgtggccaacattttggctgaagtcattcttcgctttacttcacaagcgtacagcctgttaaaagaaggcggtcactttattacgtcaggaatcatcggtcataaaaaacaagaagtaaaagaagcactggaacaagctggctttaccattgtagaaatcctttcaatggaagattgggtcagcattattgcgaaaaaataacagttagtaggtgtcacagcgtatgcaacgatattttatcgagctcacgaagcagcaaatagaggaagcgccgactttttcgattaccggcgaagaagttcatcatattgtgaacgtgatgagaatgaatgagggagatcagattatctgctgctctcaagacggcttcgaggcaaaatgtgaacttcaatctgtttccaaagataaagtgtcctgccttgtgatagaatggacgaatgaaaacagagagcttccgataaaggtctatattgcgagcggccttccgaaaggagataagcttgaatggattatccaaaaggggactgagctcggagctcatgcctttattcctttccaagccgcgcgttctgttgtcaagctggatgacaaaaaggcaaagaaaaagcgggaaagatggacgaaaattgcgaaggaagcggctgagcaatcgtaccgtaacgaagtgccgcgagtgatggatgtccattcttttcagcagcttcttcaaaggatgcaggatttcgataaatgtgtcgttgcatacgaggagtcatcgaagcaaggggaaataagcgcattcagcgcgattgtaagcagccttccgaaaggatcatctctattgatcgtatttggtcccgaaggcggtttaacagaagcggaggttgaacggctcacagagcaagacggtgtgacgtgcggccttggaccgagaattttaaggacagaaaccgctccgctatacgcgttgagtgcgatttcttatcaaacagagttattaagaggtgatcagtaatggcaactgttgctttccatacgcttggctgtaaagtcaaccattatgaaacagaagcaatctggcagcttttcaaagaagcgggctatgaaagaagagactttgaacaaacagctgatgtatatgtcattaatacatgtacggttacaaatacgggagataaaaaaagccgccaagtgatcagacgcgccattcgtcaaaatcctgacggtgtcatctgtgtcacaggctgctacgcgcaaacctcacctgctgagattatggcgatccccggtgtcgacattgtagtcggaacacaggaccgtgaaaaaatgcttggctacattgaccaataccgagaagaacgccagccgattaatggcgtcagcaacatcatgaaagcaagagtatatgaagagcttgatgtgcctgctttcacggaccgcacaagagcgtcattgaaaatacaggagggctgcaataatttctgcacattctgtatcattccgtgggcgagaggcctgctccgctcccgcgaccctgaagaagtcattaaacaagcgcagcagcttgtcgatgccggatataaggaaattgttcttacgggtattcatacaggcggctacggcgaagatatgaaagattacaacttcgcgaagcttttgagcgaattagacacccgtgtggaaggcgtgaaacggatcagaatttcttcaatcgaagccagccaaatcactgacgaagtgatcgaggtcttagaccgctcagataagatagtgaatcatttgcatattcctatccaatccggatcaaacacagtgcttaaacggatgagacgcaaatatacaatggaattctttgcagaccgtttaaataaattgaaaaaagcactgccaggcttagctgttacttctgatgtcatcgtcgggttccctggagaaacagaagaagaatttatggaaacctataactttattaaagaacataaattctctgagctgcatgttttcccttacagtaagcgtacaggaacaccagctgcacgaatggaagaccaagtggatgaaaacgtgaaaaacgaacgtgtgcaccgcctgattgctctttctgaccagcttgcaaaagaatacgcttctcagtatgaaaatgaagtgcttgagattatccctgaggaagcgtttaaggaaacagaagaagaaaatatgtttgtcggttacacagacaattatatgaaggttgttttcaaaggtacggaagatatgatcggcaaaatcgtaaaagtcaaaatcctaaaagcaggttatccttacaacgaaggacagtttgtccgtgtggttgaggatgaaataactgaacacatgcgtttgtcttcttaacctaaaaaatcggtgcattaaaatgtaccgatttttttatttagccgggataagaaggtgaatcaatcggtaaaacaagtttgtaagcggaagaaataaaagagctgtcaccacattaaataaaaggctgaaatgcgcgatcttttgtgcgggatcaggtgataactgctctacaaagccggtcgctgcggtcagaaaaggcaatactagagccacccctagcacgttaaataccacatgggcatatgctgtctgtttcgccgcatatccgccggatacagcagccatgacagctgtaatgcatgtcccgatatttgatccgagtacgacgctcatcgcctgtgtcagtccgataatcccttcattcataaaactcatcaaaatgccgatacagacagaactggagtgaatgatggcagttaacaccatgccgatgagcaaagcggaccagtttgaatcgttaacatggtatagaacgtcggcgcccgttttcagctttgtcagcggcccggcaagatggctgaatccgctgatgcaaaagaagatgatgcccagtccaaggaagcttgttcccagctgtttcaaaggatacctgccagtcagaaaaaacaataaacctcctattaaaagaacccaaatcacaatatccattttgatagcaataaattcagttgtaaaagtagagccaacatttgtccccagaatcatcgggatcgtccgcttaaaagaaagaacgcccgcacttacaaagccgatgacaatgaccataaaggctgagctgctctgaagtatccccgtaaatacaatactgataagaaacgcttttaacggatggtctgtaaataaaagcaaacgttcttcaatttttgagtacgccattgaaattaagccctttcgaagcatgttcatgcctgcgagaaagaataatataagagcagtaaagctaatcagaattaacatcctattcaccaacccctttctttcattatatagacaggcagtcgcactcatgacggaaaagtgaactcacttagttgacctgactgatggcttatattataatgtcaaagtacatgtttatatgtgtaacttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgtgaattttatgaaaaacctagcgtaaagcgcaagaaaaagtctgaagctgctagaaaacgcaaattctaaaagagggtggatttatgagtcttcttgagcgtctcaaccaggatatgaagctgtatatgaaaaaccgtgagaaagacaaactgactgtcgttcgaatggttaaggcttcacttcaaaatgaagcaattaagcttaagaaagacagtttgaccgaggatgaggaactcactgtcctttctcgtgaacttaagcaacgtaaagactccctccaggaattttcaaacgctaatcgtttagatttagtagataaagttcaaaaagagctggacattttagaagtttatttacctgagcagctgtcagaagaagagctgcgtacaatcgtaaatgaaaccatcgcggaggtcggtgcgagctcaaaagcggacatgggcaaagtgatgggggcaattatgcctaaagtaaaaggtaaagctgacggaagtttaattaataagcttgtgagcagtcaactgtcttaaatggcaaagaaaaggacatctttctaagagagatgtctttttttatacataaaaaaatgaaacctttgatacatttgttacgtatgaagagaaggcacttattataaaaggaaggagggatacaccgcccttgcttcaaatcaaaggattccgtgctgctcttttgggtatatttttactttctttattaggcgtacagctgaacgcaaaagcagaaaaacaaactgtttatgtgatcccggttgaaaaaaatgtcgaacagggtctcgcctcgtttttgtcccgttcgttacaagacgcaaaggatgcacatgcagaccatattattcttgatatcaataccccggggggattggtcaaatctgctattgatatggccgatttgataaccgaaagcgagatccccgtaactgcatatgtcaacaaacgcgcgttgtctgctggtgcatatattgcacttcaagcagatcacatttatatggcgcctggcggaaaaatgggagccgccgcgattgttgatggccaaggcaatgccgctgaccaaaaagctcaatcactttggctggcagagatggaagatgccgcagtgaaaaataaccgcgatccaaaatatgcgctcgcaatggctgacccagatatagatgccaaggaagttggcgcgcctaagggagatctgctgacacttaacgcagacaaggcgattgaggtaggctattcagaaggcactgctgacaatttgtccacgctcgtaaagaagcttgggttcgaaaaggcgcagatcagctatgcaaaggagagctttgcggaaaagacggcaagatggctgacgaatccggtcattgtccctattctgctgacaatcgcttttttaggtctgacggtagagcttttttccccgggtgtcggcctccctggaacggctggactcattgcgttattgctgttcttttacgggcatcttgcagccggccttgccgggtatgagacggttctcctctttatagcaggggtgattctcattctgcttgagatttttcttcccggaggaatcattggattactgggcttgggagcgattattgcgagcctgtttttagccgcggggagcttcactgtcatggcggtttctctcttgatcgcctcagctgtttcgattacagcttttattttactgacaagggtgttgggaaagcgtatgaaattctttaagaaattgatattaaatgattctacaaacacggagagcggctacgtttcaaatcaaacgcgcacggacttaatgggaaaagtgggtataacctttacaccgctgcgtccttccggtaccgtgattattgatgatgaacgccttgacgttgtatcggagggatcgtttacagaaaaagataaaaaagtaaaagtgataaaagtagaaggctcacgcattgtcgtgagagaaatttaaatagaaacgaggagaagttatatggatccgtcaacacttatgattctggcaattgtcgcagtagcgatcattgttttggcagtattttttacatttgtgcctgtaatgctttggatttcagctttggcagccggagtgaaaatcagcattttcactctagttgggatgaggcttcgccgcgtcattccgaatcgggttgttaacccgctgattaaagcgcataaagcgggacttaatgttggaacaaaccagcttgaaagccactatctggctggaggtaatgttgacagagtcgtcaacgcgcttatcgccgctcagcgagctaacattgaactcacattcgagcgctgtgctgccattgatcttgcaggccgggacgtgttggaagctgttcaaatgagcgttaatcctaaggtgattgaaacaccgttcattgccggcgtcgcaatggacgggattgaagtgaaagcgaaagcgagaatcacagtaagagcgaatatcgagcgcctcgtcgggggagcaggggaagaaaccattgtagctcgtgtaggtgagggaatcgtttctacaatcggttcatctgataatcataaaaaagtgcttgaaaaccctgacatgatttctcagacagtccttggaaaaggattggactcaggaactgcgtttgaaattctctcaattgatattgcagatgtagatatcggcaaaaacatcggggcaattttacaaaccgatcaggccgaggctgataaaaacatcgcgcaggcaaaagcggaagaacgacgtgcgatggctgtcgctcaagaacaggaaatgcgtgcccgcgtagaagaaatgcgcgcgaaagtagtagaagccgaggcggaagtgccgcttgcgatggcagaagctttgcgtgaagggaatattggcgtcatggattacatgaatatcaagaacatcgatgctgacacagaaatgcgtgattcattcggcaagctgacgaaagacccttcggatgaagaccgcaaatcataatctctctaagaagggagaacgctgatggaagatttactgaccaatccgcttattattgcagcgatcatcggaatcatttctgcgattttcggcaaaaagagcaaagaagaaaagcaaaacagccaaaaaagaaaaaaacctcaacacgtgcaatctgcttctcctcaaaagaagcagtcaaaagaagatgcccctgcacctatccctaaccgtatggaacaggcaagacgggaagcggaagaaagacgcagggaaacagcaagaaacctgaaagggctggaacgagatcttgctgctgccaaacaaaaaacagtatacacaaaacaaaaaatgcttcaggtgaataaagacaccgtcgtacaggggatcgttctaggagaggtgttcggacctccacgggcgaaaaaacctcaccgtacgatgcgcccggcccgtaaaaattaaagtgttagaacctcctttcaaatcatacatatgagatgaaagggggttctttttgtatggggcaaagaaagaatcgtatgaaagcttggctgacaagagcattggaaattcccccggacgttatgatggatctgccgaggattacaatggttggcagacttcatatctacatagaaaaccacagaggccttttgcttttcagtgagaatgaagtgcggctgatgctgaagcagggccagtgcatcatatctggtaaaaattttgtcatcaaggcgattcttccggaagagatacttttggagggtacgattgatgtcgttcgatatgttgagtcataaagccgagggggaaatgttgtgaaaaataaatggctgtcttttttttcgggtaaggtccagcttgaattgacgggaagagggattgagcggctccttaatgaatgcacaagacaggggattccggtctttcatgtcaaaaaaaagaaagaagccgtatcgttatatatacagcttcaggatgtacatgcctttcggcgggtaagaagtaaatttaaatgtaaagcccgatttatcaatcggaagggatttcccttcctgttgctgaaatcaaagctgaatatagggtttacgatcggttttgcgatttttttcattcttttgtttttgctgtccaatatggtgtggaaaattgatgtgacaggcgctaagcctgaaacagaacatcaaatgaggcagcatcttaatgaaatcggcgtcaaaaagggccgtctgcagtttttaatgatgtcgcccgaaaaaatacagaaatcattaaccaatggaatagacaatatcacttgggtcggagttgatctgaaggggacgaccattcatatgaaagttgtggagaaaaatgagcccgaaaaagaaaaatatgttagcccgcgcaatattgtcgccaaaaagaaagcaaccattacgagaatgtttgtgcaaaaaggacagcccatggccgccatacacgatcatgttgaaaagggacagctgcttgtttcgggactgatcggcagcgaagaccatcagcaggaagtcgcctcaaaagcagaaatttatggagaaacctggtatagatcagaagtgacagtcccgcttgaaacattatttaacgtctatacgggcaaagtaaggacaaagcacaagctttcttttggttctttggcaatcccgatctgggggatgacgtttaaaaaagaggaattgaagcatccaaaaacagaacaagaaaagcattcgcttcattttctcggatttaagctccctgtatcctatgtcaaagagcaaacgagagaaagtgaagaggctttgcgaaaatatacaaaagaagaagcagttcaagaaggcattaaattgggtaaacaggatgtagaggataaaataggcgaaaacggcgaggtgaaaagtgaaaaagttttgcaccagactgttgagaatggtaaagtaaagttgattattctctaccaagttatagaagatatcgttcaaaccacacctattgtcagggagactgaagaatgacagaacatttacttgcgatgaatcaaaaactgaaaaacccggacgaggcgctttcactcttcgggaaccaagattcttttttgaaattgatggagaaagatctgaatttaaatatcattacgcgcggcgagacgatttatgtttcaggcgatgatgaatcgtttcagattgcagacaggctgctgggatcgctcctcgctttaattcgcaaggggatagagatctctgaacgtgatgtgatttacgccatcaaaatggcaaagaagaatgaacttgaatactttgaaagcatgtatgaagaagaaattacaaaaaacgcaaaaggcaaatcaatccgtgtaaaaacaatgggacagcgggaatacgtggccgctatgaagcggaatgaccttgtattcggcattggtccggcgggaaccgggaaaacgtacctggctgtcgtaaaagcagtccatgctttaaaaaacggacatatcaaaaaaatcattttaacaagacctgccgtggaagccggtgaaagccttggttttctcccaggtgacctaaaagaaaaagtagatccttatttgcgcccgctgtatgacgctctccatgatgtgcttggggcagatcatacagaacgtctgatggaaagaggcatcattgaaattgctccgctcgcatatatgaggggacggacgctcgatgatgcttatgttatacttgatgaagcacagaataccacgcctgctcaaatgaaaatgtttttgacgagactgggttttggctctaaaatgatcattacaggtgacgttagccaaattgatctgccgaaaggcgtcaaatcgggacttgcagtagcgaaggagatgctgaaaggaatagacggcatttctatgattgagctagaccagacagacgtggtcagacatccgcttgttgcgaaaattattgaagcatacgataagcaaaattaatgctgaatgacccgatcgcgcgttatcgggtcatttttatgattgcttatgggcttgatgtttcaagaggaggttcttgtgttgaaaaagaaggctaagaccaaaagcagctcaaaaaaatggagcagttttaaaaatgcccgctccatgcatgtactgctgtatcttctgctggctgccattatgtttgctttgctctttgtacatgttaagccggaaacacttgatttagacctgttttcagtcagcgacaagaccatttacgctccggcaaccgtagaagatcaaaaagccacagaggaaaaaaagcaagccgctgaggacgcggttgaagatcaatatacattaaaaaaagaatatacagacaatcggattgaccttgtgtcatcaatattcgacagtattagtgaagtgaaaaaatcatcggaagaaggcagtaaatcaccatcggaaaaatcaatggtcaaatctgtaaaggacaaattgacatcagatgtgaatgattctatatcggaggattccatcaagacattgctgaaagcagacagtgaagacttttcttttgtcagagatacggtcattaccgcggtaaatacggtcatgagcagtgaaatcccttcggataaactatctgatgcaaaggataaggtagaaaaagagctaaagagcaattctattccgtctaaatacttgggagccgcgacagaaatcgggcgttttgctattattccgaattacgtcttcgatccgaaagcaacagaggcaaaacggcaggaagcctcagataatgtccagcaggttcaaatcaaacaggggcaagtgctcgtggaagaaaatgacctcattgatcgggaagtgtacaggaaacttgagctgaccgggttattaaataactcaaatctctttaaaccgatcagcgggctattgattatgatcggacttttcattgcaacacttgtatattattttgaaaaacagaaacaaaatctgaagtttaaaaaccaatccattctgttattctccataatcacaacacttttgcttgtgatcatggaggttgtcagtttgtttcagaagatggagtataataatatcggctatctggtccccattgcggccggcgccatcttaatcaaactgctgatgaatgaacgcattgccattttgggaagtatcattcttgcgatttgcggaagtatgatgtttaatcagggtgtgacaggaacattcaattatgtcatagggatttattatttgatcagcggcatttcaggtgtattatttttaggaaaacacaatgcaagatcaaagattttgcagaccggacttttcgtggcgtttattaatatggttgtcgttctatccttattattgatccagaacactgcgctgtcgggtcttgaaatcggcacgttaatgctcatgggggttgtgtcggggtttgcttcatctgtattgatcatcggtctgatgccgttttttgagacgggctttggcattttatccaccatgaggctgctcgagctgtctaatcctaaccatccgctattgcgcaaaatactgacggaaacaccaggtacatatcatcacagtgtaatggttgccaatttatcagaggcagcctgtgaagcggttggggctaatggtttgcttgcaagagtcggcgcatattatcacgatctcggaaaaacaaagcgcccgcaatattttattgaaaaccaaatgaatattgacaatccgcatgacaagctgtcacctcagttgagcaaaaatattattatctcgcatacgacagacggtgcgaatatgctgagaagctataaatttccgaaagagcttgtcgatattgctgagcagcatcatggaacctcgcttttaaagttttttactataaagcgaaggaaaaaggcgaccagattacagaggaagagttccgttatccgggaccgaagccgcagtcaaaggaagccgcaattatatcagtggccgacagtgttgaagcggccgtcagatccatgcacaatccaaatcctgaacgaattgaaaagcttgtccggggtattatatccgataagcttcaggacggacagttcagtgaatgcgatttgacatttaaagagctggatacaatcgcaaaaacgctctgtgcaacattaaaaggaattttccactcccggattgaatatccggaggctactaagaaggtgaaatagatgagtttactgattgatatcgttgatgaaacgggaagcgtctcagaagagatgctcaaagaagtagaaaatctgcttcaatttgccgctgagcgtgaaggcgttcaggatcaggctgaagtttctgtcacgattgtttccaatgatgacatacatcagattaacaaagaataccggggaaaggatgctccgacagatgtcatctcatttgctcttgaagaagagggagaaggcgagatcgaaatcgtgggcgccgaaatgcctccggttttaggtgatattatcatcagtgccgatcgcacaagagagcaggcagaggagtataatcattcttttaaaagagagctcggatttctagctgtacacggatttctgcaccttttaggatatgaccatatgacgaaagaggaagaagaggagatgtttactaagcaaaaggaattgctggacgcttatggactcaaaagatcatagaaatgagctgaatcgattcttcaaaagcttcgtgcatgcaggccggggcatatgggaaacagcgcggacggagcggaatttccaatttcatgccgcagccgcctgcgctgttctcatttgcggcttccttgtagagctcagcattattgagtggatgattatattccttttgataggtggtatgttttcgcttgaacttttaaatacagccattgaacatacggttgatttaataactgacaaacatcaccctcttgctaaagcggccaaggacgctgccgccggggctgtttgcgtttttgccgtgatttcgtgtatcattggtttacttatttttttgccaaagctgtaatggctgaaaattcttacatttattttacatttttagaaatgggcgtgaaaaaaagcgcgcgattatgtaaaatataaagtgatagcggtaccattataggtaagagaggaatgtacacatgaacagacaagaattaataacagaagctttaaaagcgcgtgatatggcatatgcgccgtattccaaattccaagtaggagccgctcttcttaccaaggatggaaaagtgtacagaggctgcaatattgagaacgcggcatacagcatgtgcaattgcgccgagcgtaccgctttatttaaagctgtttctgaaggggatacagagtttcagatgctggccgttgcggctgacacccctggaccagtatctccgtgcggagcctgccgacaggtgatttctgagctttgcacaaaagacgttattgtcgtactgactaatttacaaggacaaataaaagaaatgactgtggaagaattattgccaggcgcattttcatcggaggatttacatgacgaacgaaagctttaaatcaggatttgtatccattattggaagaccaaacgtaggaaaatctacatttttgaacagagtcattggacaaaaaatcgcgatcatgagcgataagccccaaacgacgagaaacaaggtgcaaggagtactgacgacaggcacatcacaaaccatttttattgacacaccagggattcataaacctaagcataaacttggggactttatgatgaaagtggcgcaaaatacattaaaagaagtcgatttgatcttgtttatgatcaatgctgaggaaggctacgggaagggcgacgaattcatcattgagaaattgcagacgatgtctacgcctgtattcttaatcgtaaacaaaattgataaaattcatcccgaccaattgcttctgctaattgacgaataccgcaaacgttatccttttaaggaaattgttccgatttctgctttagaaggaaataacatcgaaaccttgctcgcgcagatcgaagcgtatttgccggaagggccgcaattctatccgagtgaccaggtaactgaccaccctgaacgatttatcatttctgaattaatcagggaaaaggtgctgcatttgacgagagaagaaatcccgcacagcattgcggtggccatcgaatccatcaaagggcaggacaacggttctgtgcacgtagcggcaacgattgtggtcgagcgggattcccagaaaggcatcgtgatcggtaaaaaaggaagccttctaaaagaggttggaaaaagagcgagagcggatattgaagcactgttgggctcccgtgtctaccttgaattgtgggtgaaagtgcagaaagactggcgtaataaaatgtcccagcttcgcgattttggctttaaagaggacgaatattaatctcttcccgtgtgtgtcattatctcacaggaacagggatacattagcaaattttgtttaacatgaaatggaggacatctggtcaagataaaggtaagaatttggagtttaggtaagctagtttaactacagaaaggtgggtttcttgtgttgaattttacctggaacgtattttctcaaacaggaaatgttgatacgtatcttctttttaaagaactggaaaaagagaacatggaaagacccgaagaactagaagatgagctagcccgatttgattatccaattttataaacctcttggccgctcctgcttgaggaaggtgcggaaatgctgacaaaatgtgaagggatcgttcttcgcacaaatgattacggagagacgaataaaatcgtaacattactgacaagagaacacggaaaaataggtgttatggcacgaggcgccaaaaaaccgaacagccgtttatcagcagtcagccagccctttttgtatggttctttcttaatgcaaaaaacatcgggcctcggaacgcttcagcagggggaaatgatcctcagcatgagaggcatcagggaagacttgtttttaacagcatatgctgcctatgttgctgagttagtcgacagaggcacagaagaaaaaaagccaaatccttatttatttgaattcatattagaatcattaaaacagttgaatgaaggaacagatccggatgttatcaccttcattgttcaaatgaagatgctcggtgtcatgggcctgtatcctgagctgaatcattgtgtacattgtaaaagccaagacggaacctttcatttctctgttcgtgataatggttttatatgccaccgctgttttgaaaaagatccttacaggataccgattaaaccgcaaacggcaaggctgttaaggctcttttactattttgatctgtcgagactcggcaatgtgtccttaaaagaggaaacaaaagctgaattaaagcaagtgattgatttatattacgaagaatattcgggattgtatttaaaatcaaagcgctttttagatcaaatggaaagcatgaaacatcttatgggtgaaaacaaaagttgacatttggtccatctttttatatgatcatttattataaaatatgttgcagtgagagaaagaagtacttgcgtttacctcatgaaagcgaccttagggcggtgtaagctaaggatgagcacgcaacgaaaggcattcttgagcaattttaaaaaagaggctgggattttgttctcagcaactagggtggaaccgcgggagaactctcgtccctatgtttgcggctggcaagcatagagacgggagttttttggttgctgccgcagtcaacttatgaaagaaaagtggaggtgcttgaaatgaatattcaagacatgattctaaccttgcaaaagcattggtccagtcagggctgtgtgcttatgcaggcttacgatgtagaaaaaggagccggcacgatgagcccgtatacatttttgcgcagtatcggtcctgagccgtggaaagtggcttatgtagagccttccagacgtccggcagacggccgctacggggagaacccgaacagactgtatcagcatcatcagttccaggtcattattaaaccgtcacctgataacattcaagagctgtatttggattccttgcgtgctcttggaattgatccgcttgagcacgatattcgctttgttgaagacaactgggagaatccgtctttaggctgcgcgggtctaggctgggaagtttggcttgacggaatggaaataacacaatttacgtatttccagcaggtcgggggattagagtgtaaacccgtttctgtagagattacgtatggaattgagcgtctcgcgtcttatatccaggataaagaaaacgtgtttgacttggaatggacgtcagggtttacagtaaaagatttattcatgatggctgaatatgagcattctgtttatacgtttgaaacatcagacgtcgatatgctgttccaattgttcagcacatatgaaaaagaagcgatcaagcaaatggacaacggacttgttcatccagcatatgactatgtgctgaaatgctcgcacactttcaacctgcttgatgccaaaggtgcgatctctgttaccgagcggacgggctatatcgcaagagtgcggaatttagctagaaaagtagcaaaaacctactatgaggaacgagaaaaactagggttcccaatgcttaaaggggagggttcttctcatgagtaaacaggatttacttttagagatcggattagaggaaatgccggcgcgctttttgaatgaaagcatggttcagcttggcgacaagctgacaggctggcttaaagaaaaaaatattactcacggtgaagtgaaactcttcaatacaccgagacgtcttgctgtgttcgttaaggatgtcgcagaaaagcaggatgatataaaagaagaagcaaaagggcctgcgaaaaaaattgcccttgatgcggacgggaactggacaaaagcggcaatcggcttttcaaaaggccaaggcgcaaatgtggaagacctgtacatcaaagaagtaaaaggcatagagtatgtattcgtgcaaaaattccaagccggccaagaaacgaagtcgcttctgccagaattgagcggtttaattacaagcttgcatttcccgaaaaacatgcgctggggaaatgaagatttgcgttatatccgaccgatcaaatggattgtcgcattatttggacaggatgtcattccattttcgatcacaaacgttgagtctggacggacaacacagggacaccgtttcctcggacatgaagtgtcaattgaatcaccttcagcttatgaagagcagctcaaaggacagcatgttattgctgatcctagcgtccgaaagcaaatgattcaatctcagctggaaacaatggctgctgaaaacaattggagcattccagttgacgaagaccttcttgatgaagtgaatcatttagtagaatacccgacagctctttacggttcatttgaatccgagtttctgtcaattcctgaagaagtgcttgtcacgacaatgaaagagcatcagcgctacttccctgtcaaagacaaaaacggtgacctgctgcctcactttatcacagtccgaaacggcaacagccacgcgattgaaaatgtggcccgaggcaatgaaaaagtgctgcgcgcacgtttatctgatgcttcattcttctacaaagaagatcagaaactaaacattgatgcaaatgtgaagaagcttgaaaatatcgttttccatgaagagcttggttctcttgctgataaggttaggagagtcacatcaatcgcagagaaacttgccgttcgtcttcaggctgatgaagatacattaaaacatgtgaagcgggctgctgaaatttctaaattcgaccttgtgacgcatatgatatatgaattccctgaacttcaaggaattatgggcgaaaagtatgcgagaatgcttggcgaagatgaagctgtggctgcggcagttaatgaacattatatgcctagatcagcgggcggagaaacgccttctactttcaccggagctgttgtagcaatggcggataagcttgacacaatcgcttcattcttctctatcggcgtaattccgaccggttcccaggacccttacggactgcgccgccaagcaagcggtattgttgcgattcttcttgaccgcaactggggaatttcatttgaagagctgcttactttcgttcaaaccgataaagaaaatgaactgctggatttcttcactcagcgcttgaaatatgtcttgaatgctgaacaaatcagacatgatgtcattgacgccgtgctggaaagctctgagcttgagccgtactctgcgctgcataaagcacaagtactggagcaaaagcttggtgcacctggctttaaggaaacagccgaagcgttaggccgagtgatctctatcagcaaaaaaggagtccgcggagacattcagcctgatctgtttgaaaatgaatacgaagcaaaactgtttgatgcctaccaaacagcgaagcaaaatctgcaggaaaacttcagcaaaaaagattatgaggcggcgcttgcttcacttgcagccttaaaagaaccgatcgatgcttacttcgatcatacaatggttatagcggataatgagtcattaaaggcaaatcgtttagcgcaaatggtaagcttggcggatgagatcaagtcctttgcgaatatgaatgcccttattgtaaaataaagagagaaaaggcggttgctgtgtgatcggtaatcgtcttttccccatttataagttttttgtttgattacaagatatttacgttataatatggattgttatttctttacatagctatgaagtgaaaaggtggtgagtacgatcgaactaaataaacggcaagaacatattttgcagattgtaaaagaaaacgggccgattacaggggagcatattgcagaaaagctgaacctaaccagggcgacattgcgcccggatttagccatactcaccatgtcaggattcctcgaggcgcgcccgagagtcggttatttctatacgggaaaaaccggcacacagcttttggcggataaactcaaaaagcttcaggtgaaagactttcaatctatccccgtagtgattcacgaaaacgtttctgtgtacgatgcgatttgcaccatgtttttagaagatgtaggtactctgtttgtggtggaccgcgatgctgttttagtcggggtgctttcacgaaaagacttgctcagagcgagcattggccagcaggagcttacatcggtccctgttcacatcatcatgacaaggatgccgaacattacggtgtgcagacgcgaggattatgtgatggacattgcaaagcacttaatagaaaaacaaattgatgcactgcctgtcatcaaagacaccgataaaggctttgaagtgatcggcagagtgacaaaaacaaatatgaccaaaatacttgtcagtttatctgaaaatgaaatcctataagattgcaaactaacggggggataatatgaataaccgcatcatctatgttgtatcggattccgtcggtgaaacggctgaattggtagtaaaagcagcactcagccaatttaacggatcggcggatgatactcatgtaagaagaattccttatgttgaagatataggcactatcaatgaagtgatttcacttgcaaaggcagacggcggcattatctgttttacactcgtggtgccggaaatcagagaatatttgatagccgaagcggaaaaagcaaatgttttatattatgatattatcggcccgttgattgataaaatggaaacagcctacggtttaacagcgaaatacgaaccggggcgggtgcgccagcttgatgaagattatttcaaaaaagtggaggccatcgagtttgcagttaaatacgatgatggacgtgatccaagagggattttaaaagctgatatcgttttgatcggcgtgtcaagaacgtctaaaacaccgctgtctcaatatctcgcacacaaacgcctgaaggttgccaatgttccgattgtaccggaggttgatccgccggaagaactctttaacgttgatccgaaaaaatgcatcggtttaaagattagccctgataaactgaatcatatcagaaaagaacgtttaaaatcactcgggcttaatgataaagcgatttatgcaaatatcaacagaatcaaagaggaactcgagtatttcgaaaagattgtggatcggatcggctgccaggttgttgatgtttcaaataaagcggttgaggaaacagcaaatattatccatcatctcaaaacaaaaaacatataactcaggacgctctatcctgggtttttggctgtgccaaaagggaataatgaaaaacaatagcatctttgtgaagtttgtattataataaaaaattgtgataaaatgattaattttaggtttaaggatcgtgtgatacgaataaactattatgggtaagatgtcaagaatttctcccggaaatttttcgacaaattcatatacatccacaataataaaggatgtgcgattttgcttgcttttatgcaggagtttaatggagggatggagaattactcttcttaatgaacaagaaaagacgatttttgtcgatgctgatgcttgtccggtaaaagatgaaattttacaaacagcatccgagtatgaagttcaagttctttttgtcgcttcatttgaacattatcagctttccagaagcaatgaagaaaaatggaagtatgttgatcctcataaagaagctgctgatttatatatcgcaaatcacgtgaaaccgggagatattgttgtgacgcaggacatcggattagcatctctgctgttgaacagaaatgtctctgttatgtcggaaagaggtcgtctttacaaggaagacacgattgattttgccctagagggccgtcatttttccggcaaacaaagaagaaaaggcgtatatgccaaagggcctaaaaaattgaataaagaagatcgagaacgatttattacactgctgcaaaaaatcctgtcgaacgatgaagggattttgcactaaagcatcgaataatgtacgacggagtgttataagatgggaaatcggataccagatgaaattgtggatcaggtgcaaaagtcggcagatatcgttgaagtcataggtgattatgttcaattaaagaagcaaggccgaaactactttggactctgtccttttcatggagaaagcacaccttcgttttccgtatcgcccgacaaacagatttttcattgctttggctgcggagcgggcggcaatgttttctcttttttaaggcagatggaaggctattcttttgccgagtcggtttctcaccttgctgacaaataccaaattgattttccagatgatataacagtccattccggagcccggccagagtcttctggagaacaaaaaatggctgaggcacatgagctcctgaagaaattttaccatcatttgttaataaatacaaaagaaggtcaagaggcactggattatctgctttctaggggctttacgaaagagctgattaatgaatttcagattggctatgctcttgattcttgggactttatcacgaaattccttgtaaagaggggatttagtgaggcgcaaatggaaaaagcgggtctcctgatcagacgcgaagacggaagcggatatttcgaccgcttcagaaaccgtgtcatgtttccgatccatgatcatcacggggctgttgttgctttctcaggcagggctcttggcagccagcagcctaagtatatgaacagtcctgaaaccccgctctttcataaaagcaaactgctttacaatttttataaggcccgccttcatatcagaaagcaggaaagagcagtcttatttgaagggtttgctgatgtcatatcggccgtaagctcggatgtaaaggaaagcatagccacgatgggaacgtctcttacagatgatcatgtcaagatcctgagaagaaacgtcgaagaaatcattctttgctatgactctgataaagccggttatgaagccaccttaaaagcttcggagcttctgcaaaaaaaaggctgcaaagtcagagttgcaatgattcctgacggattggaccctgatgattacatcaaaaaattcggcggggaaaaatttaaaaacgacattattgacgcaagtgtcaccgtaatggcgttcaaaatgcaatatttccgaaaaggaaagaacctgtccgatgaaggcgaccgcctagcttacattaaagacgtactgaaagaaatcagcacgctttcagggtctctagagcaggaagtctatgtaaagcagcttgcttcagagttttcgctttcacaggagtctttaactgagcagctgtctgttttcagcaagcaaaacaaacctgctgacaatagcggtgaaactaaaacgcggcgagcgcatctgacgacaaaagcaaggcaaaaacgtttgcgtccggcgtatgaaaatgcagaaaggctgttactcgctcacatgcttcgagatcggagcgtcatcaaaaaagtgattgaccgggtagggtttcaatttaatattgatgagcaccgggcattagccgcttatctttatgctttttatgaagagggagccgagctgacgcctcagcatctgatggccagggtgacggatgatcatataagccagctcttgtccgatatattaatgcttcaggttaatcaagagcttagcgaagccgagttatcagattatgtaaaaaaagtgttgaatcaaagaaattggtcaatgataaaagaaaaagaggcggaaagagccgaagcagaaaggcaaaaagattttttaagagctgcttctttggctcaagaaatcgttacattgaaccgatctttaaaataactggagaactgatgaggagcatttattggcaatgattccttgcggaggagcaaatagatcgcttaacctcatcatgaattgtcatttcattattcgcacattgttaaaggcagttcacatagaaaacgcctgaatggaccgaataagaatcataccgcttatagaattcgttgcaagctttggaaggagggatccataatggctgataaacaaacccacgagacagaattaacattcgaccaagtaaaagagcaattaacagagtctggtaaaaaacgtggcgttttgacatatgaagaaattgctgagcgtatgtccagctttgaaattgaatcagaccaaatggatgagtattatgaatttttaggtgaacaaggtgttgaattaattagtgagaatgaagaaacagaagatcctaatattcagcagcttgccaaagccgaagaagaatttgaccttaatgacctaagtgtaccgcctggcgttaaaatcaatgacccagttcgtatgtatttaaaggaaatcggtcgggttaaccttctttctgcaaaagaagaaatcgcctacgctcaaaagattgaagaaggtgacgaagaatctaaacgcagattggctgaagcgaacctgcggcttgttgtcagtatcgcaaaacggtatgtcggacgcggtatgctgttccttgatctgatccaggaaggaaacatgggcctgatgaaagccgttgaaaaatttgattatcgcaaaggttataaattcagtacgtatgctacgtggtggatcagacaggcgattacacgcgccattgccgatcaggcgagaacgatccggattcccgttcatatggttgaaaccattaataaattaatccgtgtgcagcgtcaattactgcaagacttaggcagagaaccaacacctgaagaaattgcggaagatatggatttaacgcctgaaaaagtacgcgaaatcttaaagattgctcaagagccggtatctctggaaacaccgatcggtgaagaggatgactcgcaccttggtgatttcattgaagaccaagaagcaacttcaccttctgaccacgccgcatacgagctattgaaagagcagctggaagatgtgcttgatacgttaactgatcgtgaagaaaatgtattgcgtcttcgattcggtcttgatgacggccgtacaagaacattagaagaggtcggcaaagtatttggagtaacgagagagcgtattcgacaaatcgaagccaaagcgttgcggaaactaagacatcctagcagaagtaaacgtttgaaagatttccttgaataagatggaacgggtcttgaagatccgttcttctttttttaaaaagatatatggataatatgcctttattttactgaaaaatgatgtcatttgcaaatgaacattgtggtgaaaaatttcaaaatctaattccatattttctattgtaagcgtatacaatacattatacaatagaataaaaaggatattagagatttaggcatgtttctattcaattttgtataaagtgtgaataaaaaacttttgtatagcaatccatttactttttgtaaaaataagttagaattagaagtgtttacatagggggaaggatcaaaaagggggaagggaaatgaaatggaacccgcttattccatttttgctgatcgctgttttaggaattggtctaactttctttttatcagtaaaaggacttgatgactctcgggagattgcgagcggaggagaaagcaaatctgctgaaaagaaagatgcaaacgcttcaccagaagaaatttacaaggcaaactgcatcgcatgccacggtgaaaattatgaaggtgtttcgggtcctagcttaaaaggtgtaggggataagaaagatgtcgctgaaattaaaacaaagatcgaaaaaggcggtaatggaatgccttccggtcttgttccggccgataagctggatgatatggcagagtgggtgtcaaaaattaaataaaagaactatttttctctttatacattcacaggccgccgagatgttctcgacagccttttatttttgactgctgcgtgcagacccgcatcaaaagaaataatttcaaaatcatttgcttcagcttggattccgggctgattttttatatgatagtaaaggaaaaaatgattgagaaaagttgtgatgacaagtgaacgaattaaaattatctaaacgattgcaaacagtagcggagtacataccgaatggagcggtgatggccgatatcggctctgaccacgcctaccttccttgttatgcggtgctgaatcataaagccagcggggcgattgccggagaaataacagacggcccatttttgtctgcaaagcggcaggttgaaaaatcaggcttaaactcgcacatttctgtaaggcagggagacggactggaagtgattaaaaaaggtgaagctgatgccattacgattgccggaatgggcggggctttgatcgctcacattttagaagcgggcaaagacaaattaacggggaaggaacggctcattttacagccgaatattcatgctgttcatatcagggagtggctttataaagaaagatatgcgctgatagatgaggtaatccttgaagaggacggaaagtgctatgaggtgctggtggcagaagcgggagacagggatgcggcttatgacggtatttctttatcagccgggatgctcgttggccctttcttggcaaaagaaaaaaatgctgtctttttgaaaaagtggacacaagagcttcagcacactcaaagcatttatgaacagatcagccaagcggcggatacagagcaaaacaaacaaaaattaaaggagctcgccgatcgaatggagctgttaaaggaggtaatcgatcatggctaaaagtgtaaatgggcagcagatcatccagctgtttgaacaattttccccgaaagcctatgcggttgaaggagataaaatcggcctgcaaatcggcaccttaaacaaaccaattaaaaatgtgatggttacacttgatgtgttagagagcgttatcgatgaagcgattgaaaaagaggttgacttgattattgcacaccatccaccaattttccggtcgctaaagcatatttcaacagatcagcctgccggaaggttaattgaaaagtgtttgaagcatgatattgctgtttatgcagctcatacaaatttagacgttgcggacggcggtgtgaatgatttgcttgctgaagcattagagctgagtgagacggaagtgctggcacctacttatacggatcctctgaaaaagctggcagtttacgtgccgaaggaatatgaagagcaggtcagagccgcgctcggaaatgcgggggccggccatatcggtgaatacagccattgcgcgttttcatctgaaggaatcggcagctttaagccattggacggagctaagccttttatcggtgaagtgggagagcttgagcttgttcatgaagtaaggcttgagactgtatttcctaaaagcgtcgaaaaggctgttatcaatgcaatgataaaaagccatccatatgaagaagtcgcttacgatatctatcctgtcgaacagactcccgccgaaaaagggctcggccgtgtcggaacccttaaaaatgagatgacgctcaaggaattcgctttatttgtgaaagacaagcttgacgtcaatggtgtcagaatggttggggatgctgacagcatggtgaaaaaagtagctgttcttggcggagatggaaacaagtatattcatcatgcaaaacgaaagggagccgatgtttacgtcacaggagatttatacttccatgtggcccatgatgcgatgatgcttggcctaaatgtggttgatccgggccattacgcggaaaaaatcatgaaagaaggcgtcacgagaaaacttacatcaatgtgtaatgataaaaagtttggcgtgaatatctttgtttctgaaacagatacaaatccatttacatttctataaaaaaactgaggcttttacagcctcagttttttgcttttacttttggaagtatttttttgagcggtatattatgttcagttgtccaagttgatggatcttcgtgatcaaactgctctaaaaagcgaatgacttcttttgtgatcggcgtcggtgttgaagctcccgctgtaactgcaacggtattaacgcctttcagccattcgagcttcaattcgcttaagtcgccgatccggtatgcttttgtcccggctatttcctctgacacttgagcaagcctatttgaattgttgcttttcgggtctccgacaacgattgttaagtccgctttttttgcctgctctgatacagcttcctgccgcacttgagtagcgaggcaaatctcttggtgatattcgacatgaggatatttttctttgacaagctccataatgtcgtgaacatcccattgagacattgttgtttgattcgtcacgattaacttctcagattggatatcaaggttctttacatcttcttctgtttcaactaagtgaacgatctccggcgctacgccaacggctccctcaggctctggatgcccttttttgccgatatagatcacgtgatatcctttttctttcatctctaagattagattatgagtttttgtcacatccggacatgtagcatcaattgcgactaaccctttttcttctgcgattcttctgacttcgggagaaacaccgtgcgcagtgaaaatgacagttcctttgtcaacctgctttaagatgtccagacggttagagccgtccaatgtaaaaatcccttcctcttcaaacgcatcagtgacgtgtttattatgaacaatcatcccgagtatatagatgggtcttggcaagcttttatctagcgacgcatttttggcaatgaccatagcatcaacaacaccatagcaatagccgcgcggtgaaattttaattacgtccattttcggttgtcctccaatactgaagtgagtaaaggcaatataaaaagccgtaatcaaacggctctattcttgcattcttctgatctcattatagccaatctcacttaagatatcaaagaatgttaaatatataatctcggttttgaactgcctgatgttcttttcggagcaggagaggcagcttcctttttcttcggggcagatgtttttaattcttgttctttattgtcagttgttttagatttctttgggagagaagaactttttggttttgattttttgttcccatctgaggtttttgtttcagtctctttttctttttctgatgattcttctgaaacggattgtttttcactttcctcattggcctctgtctcagtatcatcacttttacttaattggctgtacagcttcatcattgctggcagattgcggactaatgggccgtactgctggatcataggggtgacttgctgcgccatgccgagtactttttgcacatttccaagcatactggataatgatgcaggattggcaatattttgaatgccttgcaggccagcacctccgctcgctgctgcacctgctcctggaattccgggaaccccggcgctgccagcgcctcctccgccggggaggaaccttgacagcattccttttaagcctccgcctgcacctgcaccatttctcgctccggcatttgcctgaggaagaaattgtccggcttgctgaaaaccttgctgctgtgctccaaatgaaggtcctcgcatattaggcggtcttctgcccatcattcgctgatttggcatggggcggggcggtccgggctgtgggtaatttctcattggctgctgcggtgaaaacatacttgtacctcctttcagctctctctgctattagaatatgcatgggctgcggtatttgctttacataactgaataaaacaaacgccttgcaaacgtggtgtttttaagcaaaatcgggtataatgtgatgatggacacataatgtgccgctttaaggagctgggaaaaatgaaagaaacgaaatttgaactttatgaattgaaaccatttattatagatgcagtacatcgccttggtttttacgaaccgactgatatccagaaaaggctgattcctgcagtgttaaaaaaagaaagcgtcatcggccagtctcagacgggtactggaaagactcacgcttatttactgcctttattaaacaaaatcgatcctgctaaggatgtcgttcaggtagtcattacggctccgacaagagagcttgccaaccagatttatcaggaagcgcttaaaatcacgcagggtgaagaaggaagtcagattcgctcgaaatgttttatcggaggcactgataaacaaaaatcaattgataaattgaaaatacagccgcatcttgttgtcggtacacctggacggattgctgacttaatcaaagaacaggcgttaagtgttcataaagcggaatctcttgttattgatgaagcggatttaatgctggacatgggattccttgcagatgtagattacatcggttcccgcatgcctgaggatctgcaaatgcttgtgttctcagcgaccataccggaaaagctgaaaccattcttgaagaaatacatggaaaatccgaaatacgcccatgtggagccaaaacaggtgactgctgcgaaaatcgagcatatcctcattccttcgaaacatcgtgacaaggacaagctcctttttgacatcatgtcgcatctgaatccatacctggggattgtgtttgccaacacgaaaaatacggctgaccatattgcccagtatctgactggcaaaggcatgaaaatcggcttgctgcacggcggattaacaccacgtgagcggaaaaaagtcatgaagcagatcaatgatttggaattcacatatatcattgcaactgaccttgccgcaagaggtattgatattaaaggtgtcagccatgttatcaactatgagctgccggatgatctcgatttctatgttcaccgtgtgggcagaacggctcgtgccggctcatcaggacaagcgatgaccatttatgagcttactgatgaggatgcattagtaagacttgaaaaaatgggcatcgaatttgagtacttagagcttgaaaagggcgaatggaaaaaaggcgatgaccgtcagcgccgcaaaaacgtaaaaaacgccgaatgaagcggatgaaattgctcatcgtctcgtgaaaaagccgaagaaggttaagcctgggtataaaaagaaaatgagctatgagatggagaaaatcaagaaaaaacagagaagaaaccaatctaagaaaagaaagtaggggaacctgttgctgagaataggctcacacgtctctatgagcggaaaacatatgcttctggctgcaagccaggaagcagtctcttatggggcgaatacgtttatgatctatacaggcgcaccgcaaaatacgcgccgaaagaaaattgaagacttaaatatagaagcaggccgggcacatatgcaagaaaacggcattgacgagattatcgtacacgcgccttatattattaatattggcaacacgacaaatccgtccacttttgagctgggtgttgattttcttcgttcagaaattgaacggacagcggccatcggagcgaagcaaattgtccttcatcctggcgctcacgtaggggcaggagctgaagccggcatcaaaaaaattattgaaggcttaaatgaagtgattgatccgaatcaaaatgtccagattgcattagaaacaatggctggaaaaggatcagaatgcggcagaagctttgaggagcttgcgcagattatcgaaggcgttacacacaatgagcagctgtcagtgtgctttgacacgtgccatacacatgatgccgggtataacattgtcgaagactttgacggagtgctaaatgagttcgataaaatcattggcattgaccgtattaaagtgcttcatatcaatgacagcaaaaatgtcaaaggtgcgagaaaagaccgccatgaaaatattggctttggtgaaataggttttgacgcactgcaatatgttgttcaccatgagcagttaaaagacattccaaaaattcttgaaacaccatacgtcggtgaagataaaaagaacaaaaaaccgccataccgttttgagattgaaatgctgaaagaaaaacaatttgatgatacattgcttgaaaagattttacagcaataaaaaatgggggataacacccccattttttagcttgtaaattgtttgaatagttcattaactgtttgagctgtttctttcgatgtaatcgtctctacttgtttcagcagccgcattcgttcactctcattaaagatgtttacatttttcccgtataacaggttcgctacttcaacggcctgcgatcttgttaagctgattccgtattgttttgagtacttcagcaaatcatcagcagtagcctgattaagccgctgcaaaataattctttgaaataaaatcatcggtcattccacctccagacttaatgtatgggcaaatcagtaaaatgtgtcagtgtttaatggtaaaatagatttataatgtatttaaaatagttattgcaggaaaggagattttatgaccccaacaaaacaacataagaaagaaacatttacccattttattttcagggtctttatgattctggtaggagctgcatctgcggctgtaagtattgaattatttttaatccccaatgattttattgatggcgggattatcggtgtatctcttattttagaccacctctttatgtcaaacccctttctgaatttcgcttttttcgttgtcatattaaatattccttttatgatcttcggatataaatatatcggtaagacctttctagtctctacgtttatagggattgtcgggcttgccgttattgaatcctcacttcaccatgtagaagccattacaacccagcctattttggctactgtgttcggaggtcttttactcggctttggcgtcgggcttgttattcgaaatggaggttcaatggatggtacagaaattctcggtattttgctgaccaaaaaactcccgttttctgtaggtgagttcgttatgttcatcaatgtgttcattttcatttgggcagtttttgtgttcggtcctgagcaagcgatgtactcattcatgacttattatattgcgatgaaaacgattgatgccgtgatccaagggcttgatgaaacaaaagctgtcattattgtgtctgagcagtatgatgagatttccgacgcgattttgcaccgtctcggtcggggcacaacgaagctgaaggggaaaggcgggtatacggacgaagaaaaagacgtaatttacgcggttgtcacaaggctggaagtgacaaagctcaaatcgatcgtgtttgaagttgatcaaaatgcattcataacaattatgaatactcatgaaacgagaggcggaaaattcaaaaacgcaatccactaggctttcatttacttttattcattttatgggtataattttatctgcagtaaagaaaatggcttgctggacagacagctgccattttctttttcatacatgtgatacgttcttaagcaaagcgaaaagggggacccttcatgaacgtccaagaagcgctgaacctattaaaagaaaacggatataaatatacaaacaaacgggaggatatgctgcagctttttgctgattcagacagatatcttaccgctaaaaacgtactgtctgcactgaatgatgattatccaggcttaagctttgatacaatctacagaaatctttctttatatgaagaacttgggattttggaaacaactgagctgtccggtgaaaagctcttccgatttaagtgttcattcacccatcaccaccatcattttatttgtcttgcctgcggcaaaacaaaggaaattgaatcatgtccgatggacaagctttgtgatgatttggatggctatcaggtcagcgggcataaatttgagatttatggcacatgccctgattgtacagcggaaaaccaagaaaacactactgcgtaaaatgcgtatatatgaaaaaggggcccggtttgggctcctttttcagttattgacgcgtattaagtgatgcttgttgttgttcatccattgaacggcttctagccagttgtttactctgatgatgtttgaatcaatcggaagctgattataaggggaattgaacaaaatcaccggtatcccggcttctttcgcaatcatcatggcgttcccgtgatgatcctcaaaaaacaggtcgatgttatgattcttgaccgcttcaactttgtgatgacccccaacaagttcgatgtggtcataatgaatgttttgtctgtcaaaccattcataagtaatatcagttaaatgagtccgtctcgctgtaatataaataagcttgtgctcctctttgagaagatcgagagactgtttcgcatgctgtgcaagcaatgcttccttatatatgatcgcttcattttgattcatccaatcccaaaattcttcctgggtaatgtttaacagctttgttaaatcataatccgtcatatcgtttaatgaaatggaaagattaaacgaacggttcaaataagggacgaatgtatcctgagccgtgattgtgccgtcaatatctattcctaagcgtaacatgcccacactccttcagtttcatcccttcaagtgtaacataaacaattgacattaacagaaaagtttagcaaacatgaatcaggcaaaatggatcaaactataaaagctcctttaataaaacagaagggggaattgaaggtggcaaacgattacgaaaagcgtgataacaacagttactatgttgatcatggatctgaagggacaaatattacccgcgacaatgacggtttttttgaggaaacagctgctgaaatcgcagagccttatcgtgctgctgaccgcagcaatgaccaagacaatgatcgcagcggcggcaatgtcaatgaaggacggggaatagggtacatcgctttagccttgtccatcatttcattgtttgtactgcctgttttattgggagctgctggtattattgtcggctatatcgcaagaagaagaggtgctcaaggccttggagcctgggcaatgggtatcggtgtcgtttcattagtgcttggaatatttattattccatttttctaacacaaaaaagcttgacgggttcccgtcaagctttttgtgtttcttcttttaattttgctttttcagcttcaagttttgcgtagtgttcctcagcaagaatgtcaatttcttttttgagttcttctaccatcgtttcctctggaaccttacggacaattttccctttccggaacagcagcccttcaccgcgtgcgccggcgattccgatatcagcttctctcgcttcaccaggtccgtttacagcgcagccgagaacagcaactttaatcggcgcttttatcttagaaatatactcttccacttcattggcaatgctgattagatcaatctcaatacggccgcaagtcgggcatgagatgagcgtggcagcattggaggctaagccgaaagatttcagaagctcccttgctacttttacctcttctacagggtctgcgcttagtgaaatgcgcatggtgttcccgatgcctttgcttaaaatggcgccgagtcctgctgcgctctttactgtgccggcaaacagtgttcctgactcggtgatcccgaggtgaagcgggtagtcaaacgctttcgctgctttttcataagcctcgattgcaaggttcacgtcagaggccttcatgctgacaataatatcgtgaaaatcaagatcctcaagaattttaatgtgatgaagtgcgctttctaccattccatcggcagtcggataaccgtatttttctaaaatccgtttttccaatgaaccggcgtttactccgattctgatcggaatgcctttgtctttggccgctttaacaaccgcttcaactttttcgcgccggccgatattgccggggttgattcggattttatctgcgccgccttcaatggctttcaacgcaagtttataatcgaaatgtatgtcaacaacgagaggaatggaaatgcgctttttaatatccgcaatggcgtttgccgcccgttcatccggacatgctacccgaacgatttggcatccggcttcagccaaacggttaatttccgcaaccgttgcttctacatcatgtgtttttgttgttgtcatgctttggatgacaacttcattgttgccgcctattgttaaaggtcccactttgacgggacgcgtttttgtacgatgtgtgatttcactcacttgcaatcgctccttaattgtagttgccgcttctagatataacaattctagtatggtttatgtgaatttattttacaaattacattgtaacagtgtcttcgccgaactgacaagaaattaacgttaaattaagggtagaccgggaatttatacgctgttccggcttgaatggcgttagctttcacatttggattcagtgcttcaaaatcctttacaatgtcatccggagaacctgctgatccgactatcgacataaccgtatcacccggctttaccttcaccgttttataagccggttcttgtacagccgtttttgctgatgcttcatagacagggaggtcctgaatgggtatggttccaattttaaggtcataaaaaagaataaaaagtataaaaacaatgctgcatactaaggtgagacgcttcatcgcttttcctcccgcatacgaaattttataccatagtatgcttgtccatttcgattcatgacaaaagaaaagagactgcgaatgctcggtttttatacaggcgcttttttgacaggatttcttcgactaaacattaacttcagatagaaaatagaaaatagtgcaaaattagatcaaaaagaggcttttataatataaaactcgtattccattatttacaatgaacaatggatctgttaggataattatgtaatagtttaaaggaggatctacaaaatgaagcaaggaaaattttctgtgtttttaattttgctactaatgttaactttggtagttgcacctaaagaaaaagcagaggctgcaagcagtggttggcaaccggtaagtggtatttctggttgtaaaataagagttattacagatgcttatacatatactaagagtgcaacatctattgatgcttacgccgaaacaaatggaaaatgcggtaaactaaattataagagctttggtgtatctatagttgagggtggggacattggcccgcaatattcagggtacttttcaagtagaactccaaccaaaaagttttacttcagtaaattaccaaaaccgacaggaacaccttgggcagtaggtttatcagtatataaggggaaagctaagggagctgcatttgtatacataaacccacaaaaaagataacagttcaataatgagaatagaaggaaagaagataattctaacttgttgatgatttaattctgaaagctaggtgccctattggtacctggctttttaaatagcaactatcttatgtaaatatgttgtgaaaggatgcaaaatattttgccatatgattttaactagtctattagttaaaatttaacattattcttattttgttaaaaacatatgtcaaatgctgttaagaacttctttcatgttacatcttactacttctgatattattgtccagagcttgttcttgagtaattgtagagctttttttataaatgtatctgtttaagctctatacattttattaaatatcccttaagtaaaaagttaatgcaaatgctttcacactctctacttaaaggataaaaataaatataatttaacttttattaattacttttttggacggaatctcttttaaaacgagaaacaggatgacaaaattgacaaaccagttcagcaaaaattcacttggtacggttgcttctagtgcccgcatgattgtaaagaatacagttgaaagtgtgatggaataagcagaaagcttccagagctgatgataggataaatgttttttctgcgaattcttaatgattaacccgataagcgctaaaaacgatacttcaataaattttcccgctgctgttacgagaaaaataagagctgagagaacagttacaatcatcgctttattttggtttaaacctgcaatgacatcttttttctgtaactctgacggcatcattgagtaagacatttcttgggcttgtccgtcaatggccaaaacaaatttgttctgaaggatgccgattgcgttttgctttgcttcaatttgttcagtgccataggagtctgtcggatcgaacacgataacgaaaccatttgcctgagattccgtggcttttttctcatccgtttgaagtttgccgtttgaaattgtgaaatcagggaaatctttgtttaaaacagttttaaagccgttcattgattttacggtccctgtacttacataataagcggtagggattgcaaacaggacagagagcaaaaatacataaagaatcgcttttccgattccttgaaatcttgtttttgcaatatcacggggagagtatgtacttttaatgaaaagctgaaacacattcactatcttcacttcctagctaaactaatatatgttgcttattgtatcgttgcatgcgtgtgaatacaaggaagacatgaagaagacagagtaaaatgggaggatggaagctatggatatgttgtattggctgttgattgcagcggtttttatcattgcctttatcgggctggtgtatcctgttattcctagcgtagtatttattgttgccggatttgtattgtacggatttttattttcattcagtccgtattcttatatgttctggcttgttgaggcagtttttgccgcagtattattcgcagcagattacgtgtcgaatctgcttggagtaaaaaggttcggaggaagcaaagctgccatatggggaagcacgatcggtttattaatcgggccttttgtcattccggttgcagggatcatattggggccgtttatcggggctgtttgcgcagaacttatcgtccatcagaaggacttaaagtcagcgtttaaaattggcctcggctcactcattggttttttaacaggggttattgcaaagggcatcatacagcttttgatgatcggttactttttatggacggtcctataagaaatgctggcggcaggtttaatggggcagattatcggttaaagtgaaatatgtccgctgaaatgagccaaatcgtgagctttttcattgattacaaagcattcttttgttacattgaatgaagaaaggctcgctgtgaagcggcatttcagtacatatatactaaggaggaattatcatggcttacgaacttccagaattaccttatgcgtacgatgctttagaaccgcatatcgacaaggaaactatgactattcaccatacgaaacaccacaacacatacgtgacaaatttaaacaaagcggttgaaggaaacactgctcttgccaacaaatcagttgaagagcttgttgcagatcttgattctgttcctgaaaacatccgcactgcagtccgcaacaacggcggcggacacgcgaaccacaaattattctggacacttttatctccaaacggcggaggcgaaccgactggcgcgcttgctgaagagattaacagtgtatttggaagctttgacaaattcaaagagcaattcgcagcagcagcagctggacgcttcggttctggctgggcatggcttgttgtgaacaacggtaaacttgaaatcacaagcacgccaaaccaagattctccgctttcagaaggcaaaacgcctatcttaggtcttgacgtttgggagcatgcttactaccttaactatcaaaaccgccgtcctgattacatttcagctttctggaatgttgtaaactgggacgaagtggctcgtctatacagcgaagcaaaataatggcacaaacaaggtcctcattatgggaccttgtttttttatgtcttctttttacatatctcggtttgagtgagacagactaagggatagtaaaggggagtcagtaatgagcaaactaaaaaaagtgataggcgatgtagacgtaaacaaaggcttactctttctgctgaccattggcgggctttactcgctgggaattgcactgtccaatacatttgttaatgtgtatctttggaagcagtcagggaaatttattgatttggcgatatataatttatccattgtgacaatgcagccgataaccttttatttggctggacggttagccaaaaaaatagacagggtattcattttaaggttcggcgtcatttttttagctgccttttatttaagtgtgcttttagccggagaaacggcggccagccgcctcgtgctaatcggcgcggtgctcggagttggctatggcttttattggctagcgtttaacgtgctgacctttgaaataacagagccggatacacgagactttttcaacgggtttatgggcattctgtcttcctctgcaggaatgatcggcccgattgtagccggattcgtgatctcaaggcttgaaaataatacgggttatacagtgattttcagtctctccctcagtttatttgccctggctgtcgtgatgagctttttcttaaaacggagagaatcaaagggccgttttatgctgagcaaagtatttggagagcgccatagcaatatgaattggcggagaatcacgaatgcgcatttttttcagggtttgagagaagggatttttgtctttttaatcagtgtgtttgtatttattgagacaaacagcgagcttgctctcggtacattcggtcttgtcaattcagctgtttccttctttgcctactactttgcatccaggctgattaagaaaaaggcgagaaaaaaatcgattttgctgggcggacttattttgtatggcgcgctgtttttgattctgttccatatgagcttttcgacattattaacgtacggcgtttttattgccatcggctatcctctgttgcttgtgccatatgtatcacttacatatgatgtgatagggcgcgcgaggcatgccagaaaagcaagaattgaatatatcgtgcttagagaaatgttcttgaacgccggcagaattgtttccattttgtgctttctcctgattgtggcccttctgaaagaggatgtgggaattcctttgtcacttgcgatattgggtataggacatcctttgatttattactttgtcaaggatattcgttttaaggagaaagaaggggaaaatgaaaccatggaagaagacggccaaaaacgggtaacagaaccgacccttttaaaaggcgagagataatttttttgccaaaaaggggttatctgtagaaaaaagtcgaaaaaacctttaaaatgaaaactggcactcttacttgagtgtcttttctttctgtaaatagaaaaggtgatgttatgaggagaaataaaccaaaaaagcaaaatcataaagagaaaaagaagtcgcttccgatccggctgaatattttatttttagctgcctttgttatatttacctggattattgtggaactgggcatcaagcagatcgtgcaaggtgatgattacaaaaaccaagcgaataagcaggaacaaagtgaagtcagctcagcggtaccacgcgggaaaatttatgatcgaaactttaatgccattgtgacaaataaggctttaaatgcaatcacatacacgagatctaaatcgaccacgcaagaacagcgcttaaagatcgcaaaaaagctgtctgacatgatcaaagtcgatacaaaaaagtaacagaacgggataaaaaagattattggattttgactagaccgaaagaagcgaaaaagctcattagctctaaagaaagacagcaggttgaagacaaaaaaatatccgatgacgatttataccagcttcagctaaaacggattactgataagcagctgaatgaattgacggataaagatatgcagatccttgctatcaaaagacagatggattcgggctatgcattgacccctcaatatatcaaaaacgaagatgtatcagcgaaggaaatggcagtggtaagtgaacatttagacgaactgccaggtgttgatgtcacgtccgattgggaacgtgaatatccttataaaaaccttcttcgctcagtgctcggaagtgtttccagctctaatgaaggattgccgtccaacttgctcgaccattatctgtcgcttggctacagccgaaatgacagggtcggaaaaagctatctggaataccaatatgaaagccttctgcagggccaaaaagcaaaagtcgaaaatatcacagattcaaaaggcaatgtcacgggaacaaaaacggtatctgaaggcaaagccgggaaagatcttgtactaacaattgatattgatttgcaaaaatcagtggaaaaaattattgagaaaaacttaaagctgctaaagcaagacctagtaccgaattgttggatcgtgcattcgttgtcatgatggaccctagaaacggcgaagtgctgacaatggcagggaagcagattaaacgagaaaatggagcctataagtttgatgattatgcattaggagccatgacttcatcctacgctatgggatcagctgtaaaaggtgcaaccgttttgaccggtcttcaaactggagcgattaatttgaatactgtatttaaggatgaaccattgtatatcggccaggataaaagagggaaaaaatcttggcaaaacttagggccggttggtattcaaactgcattagagaagtcatcaaacgtttttatgtttaaaacagcaattgcagttggtaaaggtgaatataaacctcaccaagcattgcctttggatacttctgcatttgataccttcagaaattatttcagtcaatttggattaggagtaaaaacaggaattgatctaccaaatgaaatgacgggatataaaggtacaagcagattatctggtttcttgcttgatttcgccattggacagtatgatacttatacaccgctggaattggctcaatatgtctccaccatagcaaatggtggctaccgcatgaagcctcagcttgtaaaggaagtcagagattcaaatgcgaaaaaagggatcggcgcagtcgttgattctgttcagcctgaagtattgaataaagtcgatatgaagagtagctatattgaagaggtccaagccggttttagacgggttgccactaaagggacagctgcaggtcaactggcttcagcatcgtataaaccagctgcaaaaacaggaacagcccaatcattttacgacggaccggataaatcaaaaacaggaacagacacttataatacgacgcttgtggcttatgcaccagctgacaatcctgagattgctatttctgtcgtagttccttggacttacattgattacaatcaaagatactcaattacaaacgaaatcggcagggaagtaatggataaatattttgagctgaaatcgaagcaggacaaagaaggtactcagcaaaagaataaagacaaaattgaagaaaatgcagaaaacacaacgtcttctgataactaaaaaaaacgctcacatgatgtgggcgttttttttatacaaaaaaacgcactgatttacaaaaccttaacattcggttcaaaccctttttacatagaacctttactctatacgtgtaggacaaattacacattatacgcagggggaattcaggaaatgaaaaaaaacaaattggtgcttatgcttctgatggctgcttttatgatgattgcagctgcatgcggaaatgcaggagaaagtaaaaaatcgaatagcgattctgcaaaaggagaagaaaaggcatcaggttctttaaccatttctggttcatcggcaatgcagccactagtacttgcagccgcggaaaaatttatggaagaaaaccctgatgctgatatacaggtacaagctggcggttctggaacagggctttctcaagtctctgaaggagctgttcagatcgggaattcagacgtttttgctgaagaaaaagaaggcatcgatgcaaaagcgcttgtcgatcatcaagtcgctgtagttggtatggcagcagctgtaaaccctgatgctggtgtaaaggatatttcaaaagatgaattgaaaaaaatcttcactggcaaaatcaaaaactggaaagagctcggcggcaaagaccaaaagattacacttgtaaaccgccctgattcttccggcacacgtgctacatttgtgaaatatgcgcttgacggagcggagcctgcagaaggcattactgaagattcctccaacacggtgaaaaagatcattgctgatactccgggagcgattggatatcttgcattctcatatttaacagatgacaaagtaactgctctatctattgacggtgttaaacctgaagcgaaaaatgtagcaactggcgagtatccgatctgggcttatcaacattcttatacaaaaggtgaagcgacaggtttagctaaagaatttcttgattatctaaagagtgaagacattcaaaaaagcattgttactgaccaaggctacattccggttactgatatgaaagtgacacgtgatgccaacgggaagcaaagctgatcttaataaaaagaggagtgcggggacaaccgtttctcctcttaacacattcataggagtgtaaaacaatgataaacaatagagaaaatatgtctgtgagcgagcgcttaatcagctctaggcaaaatcggcaattggatgaagttcggggaagaatgatagtcacagcttgtgcactgattatgattgcggcatctgttgcgattaccattttcctcggcgttaaggggctgcaatcttttcttgtaaatggtgtaagcccaattgaattcttaacgagcttaaattggaatcctacagatagtgatccgaaatacggagtgctgccatttatttttggctcatttgcagtaacgattctttctgctctaatcgctgcgccgcttggcattgcaggtgcgatttttatgacagagattgccccgaattggggaaagaaagtgctgcagccggtgattgagcttttagtcggtattccatctgttgtttatggattcataggtcttacagtattggtgccgtttatcgcccagttcaaatcgagcggaacagggcacagtttattggcgggaacgattgtcctttccgtcatgattctgccgacgatcacatcgatttctgctgatgcaatggcttctcttccgaagagtttacgagagggttcttacgcgcttggtgccacaagatggcagacgatcagaaaagtacttgtgcctgcagcttttccaacattgatgacagctgttgtgttaggcatggctcgggcgttcggtgaagctttggctgttcagatggtcattggaaatacaagagtattgccggaaagcccgtttgacactgcgggaacgctgacaacgatcatcacgctgaatatgggccacaccacatacggaagtgttgaaaacaatacgctgtggtcaatggggcttgtgcttctggtgatgtcattcttgttcatcctgcttattcgctacttgtcatctaggaggaaagtgtaatgaaccgcaaaataacagataaactggcgaccggaatgtttggtttgtgtgcagccattatcgctgccattttagtaggtttgttttcctatattattataaacggtgtttctcagctcagttttcaatttattacaacaaagtcgagcgccattgcagctggaggaggcatacgagatcagctgtttaactccttttatattttgtttattacaatgctgattacaatcccgctcggtgtgggcggcggagtcttcatggctgaatacgcgcctaataacaaagtaactgacttcattagaacatgtatagaggtgctttcatctcttccgtctattgtcattgggatgtttggattattgatgtttgtcaacttaacaggctggggttatacgatcataggcggagcgcttgcgttaactgtttttaaccttcctgtcatggtgcgtgtgacagaagacgcgatccgttcagtccctaaagatctgaaggaagcctctctcgctttaggtgtatcacgctggcataccgtaaaaacagttttaattccaagtgcgattccttctatcatcacaggagcaattttagcgtcaggaagggtgttcggggaagcggccgcattattatttacggcaggcctgacaacaccgcgtcttaattttacggagtggaacccgttttcggaaacatcaccgcttaatattttcaggcccgctgaaacacttgcggtccacatttggaacgtcaatacacaaggaatgattccggatgctgaagcgattgccaacggtggttctgccgtgctggtgatttctgttcttgtgtttaatctcgcggcgagatggcttggcacgatgatctacaaaaagcttacggcaaattagaacggaaagaggcgaaaaacatgtctgaacaaatggtaaaagaaaaacctgagcgagctgttattgttccgaagcagaaccacgtgcttgaggtcaaagatctgtccatttattacggaaataaacaagccgttcatcatgtaaacatggatattgaaaaaaatgcggtgactgctttaattgggccgtcgggatgcggaaaatctacttttttgagaaatattaaccgaatgaacgatttaattccatctgcaagagcggaaggtgaaatcctttatgagggattaaatatattgggcggcaatattaacgttgtcagcttgagaagagaaatcggaatggttttccaaaaaccaaatccatttccgaaatcgatctatgcgaatatcacacatgcattgaaatatgccggagagcggaataaagctgttttagatgaaattgtggaagaaagtttaacaaaagcagcgctctgggatgaggtgaaggatcgtttacattcatccgcactctcgttatccggcggccagcagcagcgtttatgcatcgcgagaacgcttgcgatgaagccggctgttcttctgcttgatgaaccagcttcagcgcttgatccgatttcaaatgcaaaaatagaggaattaattacaggattgaaaagagaatactcaattattattgtcacgcacaatatgcagcaggctctgcgggtttctgaccggacggcattctttttaaacggcgagcttgtagaatacggacagaccgaacagattttcacgagtccgaaaaagcaaaagacagaggattatattaacgggaaattcggataggagggcggcaatgagtattgctaccgaagctgtaatgaaacaggaagtatatcaagtcaatggaatgaacttatggtatgggcagcatcatgctttaaaaaatatcaatttgagcatttatgaaaatgaggttacggcgattatcggaccatccggatgcgggaaatcgacctttatcaagacattgaatttaatgattcaaatgacgccgaatgtaaagcttgcaggtgagctgaactataatggcagcaacattttaaaggataaagtggacatcgtggatttgcgaaaaaatatcggcatggtattccaaaaagggaatccgtttccgcaatctatttttgataatgtggcttacggaccgagagtccacggcaccaaaaataagaagaagcttcaggaaattgtggaaaagtcattaaaagacgtggcgttatgggatgaggtgaaggatcgattgcatacgtccgctctttcgctgtcagggggccagcagcagcgtctttgcatcgccagagcacttgcgaccaatcctgatattttgctgatggatgaaccgacatctgcactagatccaatctcaacgagaaaaattgaagaactcattctagagctgaaagataaatatacaattgtcattgtcacgcataacatgcagcaggcagcaagggtttctgatcaaaccgcctttttctacatgggcgagcttgttgaatgcgacaatacgaataaaatgttctctaacccgaaggaccaaagaacgctcgattacatttcaggaaagtttggatgaaaaaaacaggctgagtcagcctgtttttttatcgtgttaacgtttttacgatctttttgaaactcatgtctgattttactttaaactcgccggcacgaatttctttgtgatagccggcatcaatgacatagtcattaaagtcttgagccgaagagataatgccctctttttcaagaatagcagatacatccgccgtgctcatgccgtctttaatggtgagcttgtaggttttgactttgtctgatttcgtgtctgagccgctgtcattgtttaaggatttctcttttgaatcgagaagtttttgatattcatcacggttgacagaaaccaattttttagaatcaagataattgttcacgtcttgttcggttactgttttattatcttttacagcagcggcctggtcttcgtcagtcagataaaaaacagctgcaagaacggctgtcgctaaaatgatgccgccagcaaatgcctgaatgccccgttttgtcatacgagcaccttctcattatctttgataatcgtattcacgtcttccactgatacatgttcagctttagcaatcgcttcagctgacataccgttattatatttagaaagtatttgtttagcgattttttgattgatgtcgttctgctttgatttgcgaatgacaaggtttgtttccagtaattcttcctcaagcactgtcattttctttttgagcttgtaaatttcctgcatcgcagaaagctgcagtgtttcgagctcctgttctacatctttcatcgggtctctttgagaatatgagaatgcaattagcgctatactgacgataaacaacgcaataatagcaatttccacgtttcatcaccttctattctttttttatccttcttttttataccataaaaccaatagtttctaaaggaattcgcgaaaaaaacgagattttgtcgagaaatctttcttcgcttcttcttcatgtaatggtttaataggaacacgaagtgaacgattggaaaggagaatgttaggagtccatggataaacacccatttccctataatatacgacataagctttccttttttagggacacattcgacataatcattcaaaacgctcacaccttgaccgtaagctgggaaatctcagaagaaacaatgcggctggctgaagcggtccttttcgaaaaaacgcaggatatgataaaagaattgcgcattgtcatcaaaagaaaagacattgaagctgtcaggacaaaacgcacaacgtatgataaaggagaatggacgattagacaggcggctggtgatgctgtatatcgggctgaatacagaattgtgaattcaatgaatgtctctctcaagcttgccggtacagacgacatctatcttgatgaaaatgggattcgtcatataaacagttttcagattgaagaagcgcacaccaggtgggaggcgcaattttctgcatacacctgttatgggagaggggaaaaagaacggtgaacattctcatgctttcacccgaacatcccgatgagccgaaaagcgggctcggtgtccatttaaaccgcctcatttcctatttaaaccctcatatcaacattacggtttttactccgagcgggcagctgttttcgtatgcgaagtttgaagattacatagctgatgctaactttacaatggttcgccatgtgttatcacacaataaacgctttgatctgattcatgcccatgatgacacaactgcccctgccgcccagtatttgaaacaacggcttggccttccgcttgctgcgacaatccacggtcttgaaagcgaaaggaagaaggtgtgccgagaagccccacacccatacaggctcatgaccgaacggctccttatagaatccgctgatgcattgatcgtattaagcacatttatgaagcggtctcttgataaggcggcacataagaaaataaccgttatcccaagccctgcatctatggaggaagagaaggggaaaatcccgagaagcatgaatagaagattcctcttttcatatggaaggtttgttccggaaaaaggattatcgcagctgttaaaggtgtttgccatcttgaagcagcgtcagcctgacctctatctagtgctggctggggaggggccgtctctgtcctgctatgagaaattggctgcggcatataacctgaaggatcgcgtcatgtttctgccgtttctaaataggaaagatatcagaacgttactgtctcactgtgaaatggctgttttccctagttcttatgaaccgtttgggcttgccgcgcaagaaagcatggaacaaggtgtgctgactgtcgtttctcagtcaggtggtttttgtgattatgcggttcatgacaaaacggcaatcatcgctgattttacgctcgtacaggaagctgctgatctgctggacagttttttaaaagaccgggaaaaagcccgccggataaaagaagctggcagacaacaagtgttcaagctccaccacccccgactcattatgtcatcatatttgcagctttatgagcgtatcttcaataattcagcaattcattgaaaaacagcctagcattccgtccattatagtggtattatatataagtctgaataagtaaatgattttagtttggagggaaaataatgcgcgttaatattactttggcttgcactgaatgtggtgagcgtaactatatttctaaaaagaacaaacgcaacaatccagaccgcgttgaatttaaaaaatattgcccacgtgataaaaaatctacgttacaccgtgaaacaaaataacagctttgctgtttgaggtgtaagaaaaaagccagagctttgaaaaaggttctggctttttttctattccgagggggatgagagatgaaatcacaattaagaaaaaagacgctggaggcactgtctgctttatcaaatgaagatattcttcaaaaaacggaacgtatgtataagtacttgttttctctgccggagtggcaaaatgccggcaccattgccgtcactatttccagaggattagagataccgacgcgtcctgtcattgagcaggcttgggaagaagggaaacaagtttgcatcccaaaatgccatccggacacgaagaaaatgcaatttcgcacatatcagactgatgatcagctcgaaaccgtgtacgccggactgctcgagccggtaattgaaaaaacaaaagaagtaaacccatcacaaattgacttgatgatcgttccgggtgtttgttttgatgttaacgggtttagggtcggctttggaggcggctattatgatcgctatttaagtgaatatgaagggaagacagtctctttgcttttggagtgccagttgtttgcgcacgtaccccgtctgccgcatgacatcccggtacataagctgataacagaggatcggattatttcttgtttttcataactttcctgtcccttattcgagaataaataaggtagaataacaaaccctattggcaggagggatatcatgaaaaaacttttgatatatgccattttcgcggtttctgccgtcatgttttatcaaaatcgctaccgtcttatgaatactgtactcagccagccaggaatcaggcggtcttttatccatttgtttttaagaattccatttatccgcaataagtttatacagcaagctttctaaaatcccgtgaaaaacgggattttttgctttcagtaggcgtttcggagcgccagctgttataatgaaaaaaaactattggagcggtaaacatgtttttgctggagtatacatattggaaaattgcggcgcacctggtgaatagcgggtatggcgtcatacaagccggtgagtcagatgaaatatggctggaagcgccggacaagtcctctcatgatctagttcgtctttataagcacgatcttgatttccgtcaagaaatggttagagacatcgaagagcaggccgaacgagtagaacgagtcagacatcaattgggcagacgaaggatgaagctgctgaacgtgtttttttcaacggaagccccagttgatgactgggaagagattgcaaaaaaaacttttgagaagggaactgtgtcagttgagccggcgatcgttagaggaacgatgcttcgagatgatcttcaagcggtttttccatcatttcgtacagaagattgttcagaggaacacgcttcgtttgaaaacgcgcaaatggcgcgagaacgcttcctttcgctagtgctgaaacaagaagaacagagaaaaactgaagcggcggtttttcaaaacggaaaaccgacttttacatatttatttattgcgcttcagatcctgatgtttttcttgctcgaaataaacggaggcagcactaatacggagacactggtggcttttggagcaaaagaaaacagcctgattgcacaaggagaatggtggcggcttctgacaccgatcgtgcttcacatcggcatagcgcatttagcttttaatacgctggctttatggtcggttggtacagcggttgagcggatgtatggatcggggagatttttgctgatttatctggctgctggcattacgggttcgattgcgagttttgtgttcagcccgtatccttcggcaggggcatcaggagccatattcggatgcttaggtgcattactgtatgttgctttgtctaatcgaaaaatgtttttaagaactataggaaccaatattattgtcattattatcatcaatctgggctttggttttgcggtttcgaatattgataattcaggacatatcggcggcttgattggcggctttttcgctgcagcagcactggggttgcctaaagccggagcctttggaaaaagattgttgtcagcggttttgctgattgctttggctgttggatttttatattacggattgcattcgccttcacaccaggagtcagcgctgattcagcaggcaagcgagctgtatcaggaaggaaagtatgaagaagtaacagaattgctgaacggagaagcagcgcaaaaagatgcctctgccgatcttttgaaaattcttgctgtttctgatattcaaatcggcgaatatgatcaggcggtttcccttttggaacgagcagtgaaaaaagaacctaaagaccatgcttcctattacaatttagcgttattgtatgcggaaaaaaatgagcttgcacaagcagaaaaggccatccagacggctgtgaaactgaagccgaaggagcagcgctacaaggagctgcagcggcaaattgaaaacaataaagaatcatagaggtggaatatggaaaggaagctggcttttttgtcagcgttttcttcttgactgaccgcttccttatgaatacgcttatgatagttaagttcaagaaatggtgaggaaaatgaatacattttatgatgtgcagcagctgttaaaaacgtttggccacattgtttattttggagacagagagcttgaaattgagtttatgctggatgaattaaaggaattatacatgaaccacatgattgaaaaggagcagtgggccagagcggcagctgtccttcgaaaagaattggaacaaacaaaaaacggaagagatttttataaaggctaaggtgataaaaatggacgagatatggtttgcgggcattgacctgggaggaacgacgattaaactcgcttttattaatcaatatggcgaaattcagcataagtgggaagttccgacagataaaaccggcgacacgattactgtcacaattgcaaaaacaatcgacagcaagctggatgagctgcaaaaaccgaagcacatcatcaaatacatcggaatgggtgcaccaggccctgtagatatggcggcaggagtggtttatgaaacagtaaatctagggtggaaaaattatgctttgaaaaaccatctggagacagaaaccggcatcccagctgttatagaaaatgacgcgaatattgctgcgctcggggaaatgtggaagggagcgggtgatggcgcaaaagacgtcattctcgtgacgcttggcacaggagttggcggcggcatcattgcaaatggtgaaattgtacatggtataaatggcgccggcggagaaatcggccatatttgcagcatccctgaaggcggagcgccctgcaactgcggcaaaacgggctgtatcgaaacaattgcgtcagcaaccggaattgtaagaattgcaaaagaaaaaatagcaaatgctaaaaagacgacacgtttaaaagcaaccgaacaattgtcagcgcgagatgtgtttgaagcggcgggtgaaaatgatgaaattgcccttgaggtggttgattatgtagccaagcatcttggtttggtgctcggaaatttggcaagctcgcttaatccatccaaaatcgttcttggcggcggcgtatcgagagccggagaactgctgagatcaaaagtcgagaaaacattccgcaaatgcgcgtttccgcgggcagcccaagctgctgatatttcaatcgcagcacttggaaatgatgccggcgttatcggaggcgcttggatcgctaaaaatgaatggctgaaacatcaaaattgttaaaattgtgtaaatgaaattgattttttgttgtgctcaggttaagatttaatttgatgtgttaatgagaatgttgggaatagactgatttttttgagcgtgctgcataggaggttgaaatgcgaaaaacgtttttttcgaagatttcatttatgctgattgccattttattgatgtggctgaaaacgtatgctgtttacaaaaccagttttcatattaaaatcgacaatctaacacaggaatttattctgtttatcaacccattgagttttttgttgcttatttttggcctcagcctgtttttaaaaaggcaaaaacagaaatcgctacattatcgcgatgagctgtcttgtcacgtttgtattgctggcaaatatggttttttaccgtttttacaatgatttcttaacaatccctgttctttttcaaacgagcaatatgggtgatctcggaagcagcatcggaacacttcttgagccgacagacctcctattagctgtagatattgcggttttaatatggcttcacatccggcaaaaagcttttcaatcggacattccctcaacgaaaaatgaacgggcggcttattttttgttcgttgcttctgtttatttcttcaacctgggcttgtctgaggcggaaagacctcagctattgacacgctcatttgacagagaaatgcttgttaaaaacattagcctgtttaattttcatatttacgatggcgttcttcagtcaaagcaatccgcacagagagcgttggcagacagcaacagcctgacggagattgaaaactacgtaaccgctaatgcgaaggatgccaacaaacgcttattcggcgctgcaaaaggaaggaacgtcattctcgtatccttagagtcgacgcaaagcttcgtgattaatgaaaaattgaatggagaagaaatcacgccttttctgaatgactttataaaacagagctacaactttaataatgtttaccaccaaacaggccaggggaaaacctcggattctgaatttatcgtggacaattcactgtatccgcttggacgaggtgccgtattttttacgaatgcgggcaatcaatatatggccgctcctgaaattttgaaaaacagcggatactattcagcggtgctccacgctaataataagagcttttggaatcgtgatttaatgtacgactcatttggatatgattcgttttttgatattaactcgtatgatgtaactgacgaaaattcagtcggctggggacttaaggataaagaattttttgagcagtcctcagagctgatgaaaaatctgcctcagccgttttactcgaggctgattacactgacgaaccacttcccgtttgatcttgatgaagaggatcaattgattgatgaatatgattcaaacagccagacgctaaataaatattttccgacagtgcgttatcaggatgaggcgctgaaacggtttatcgaaaagctgaaggtagacgggttatacgacaactctgttattgtattatatggtgaccattatggtatatcagaaaaccataatgaagcgatggggcagtttttaggaaaagaaataaccccatttgaagaggtacagctccaaaaagtgccgctggtcattcatattccgggtattactgataaaaagccgcaaaccattgaaacagtaggcgggcagattgatatcaggccgacgctgatgaatcttttagggattgatacgaaagatcaaattcaattcggcaacgatctgctttcagacgaaaaactggacttcacggtgctccgggacgggagctttatcacagatcaggttgtttatacagacggtgcgtgttatgacaaagagacgggaaaaccgttagaagagacaaaacaatgtgaagcatttgctgataaagcaaaacaggagctatcactttctgatgaaatcatttatggggatttgttgcgattttatgaccagaaaaggctggacaattcgtcaaagcggaaagaaaaacaaatgcttgatcaggcatcataatcacaatgtctcccgcatcgaagtgagcgggaggctttctttttttaaatacgctgtcatatagtaacaaaaaagggggatgatgatggcgtttattacggtgaaacctgagatcaagaacaatttggccaatgtggcgaaagaactgaagatagacgaggaattgcttaaaagtgcaaatcgctccgcacaaaaacatcaattgtattgccctggttatgtgatagaggagcatagcggcaaagagcttcaaaccattcaggacataaagcgctttttacagcctcggcagctgaaactttcagatagctggattgagcaagagaaaatctatgatgattcagctgttgaaaaggaaataaagaagattattgatgtttttccgtttgtctcatgccgggaaattggccgttctgtactcggcaggcctatctgggagctgaaggctggtggggagcatgccgtaaaaaaggtccatatgaacgcgtcatttcatgcgaatgagtggattacaacgtctgtcctgctaaaatggtttaaggaatactgtatgtcattatgctgcaattcgcctttctttggcttttctcccataaagctgtttaacagcacatccttatccctcgttcctcttgtcaatccggatggcgttgatcttgttttaaacggatcagaagtcatgggagccagaagagatgaactcgaaaggctaaatgaacatcgtccaaattttaatgaatggaaggcgaatataaacggggttgatttaaataaacaatttccatcattatgggaaattgaaaaataccgaaaaccgacagcacccagctaccgcgattttccgggaatctctccgcttacggagccggaatctattgcgatgtaccggctgatcacggagaatccgcctgacagactgctggctcttcatactcaaggagaagaaatttattggggctataaaggccttgagcctgaggaatctgctgccgtcataaaggagtttgaggagttaagcgggaacatttataagggagtaagggatatagacagctatgctggatttcgtgattggtttattcaccattattttaaggaagggtatacggtggaacttggaaaaggccaaaatcctttgccgtttcagcagttttcacacatatataacgccacaagcggtatcttgtggagggcgttattttttcatgagtaactgaaactttttcttttttctgccgaagcaaatatgagagaataaagatgatcggaggggaatgctgatgagatcagtttgttttattctgctggcggtattgctgtttagtttatcggcatgcgaaccatctcatcagcagcaaaaacaggcatcggcggcaaaagatgagaaaaaagacatcataccgctttccgcggaaaaagcggatggggcggaaggctggctgaataacagcacaatattatatactgcgtctaatccgacgaaaacagagctttttgcgtaccgcatctttacaggcaaagcgaaaaagctctatcaaacggatggtcaaatcgttgatgttcaaatcaatgcgagggagcagatgattctgctgcaaatcacacatagccaaaagacggcagtggttttgcttaatgcagaaggagagacgctttacgaaaaagattacgaaacgtatgagcttgaagctgcttggaatcagtatgatccttatcaaatgatggtgacggaattcaatgaaaactgggatttccatacatatcaggtgaatgctaaaaaagacgaatctttcttaagcccagtacaggttccgttcattcattggacatccaaaaatacatttgattatgtaaaagagggtagagacgataaaacagggcctttatatacgttcgatacagcttctaagacggaacagaagcttgaggataacgttctattcttcgattctttccatcaaatgagttttactgtcaaatcagcttccggaggaaaagggacgtatcagtttaaaacgccgcaatcaacatcacctgttacagcgaaatggccgctccaagcgaaatatacaagtttggctccaatggagtatgactatgatgaagcaggaggcctgttttatacattcaaacaaagcggcgatgcatataagctcgcagcaatcaatgtagcatcgggagagacaaaagatcttgtgtctctgcgggaaatggagccgattcaaatatctccgaacgggaaatatgcgttatacggctttcattttgagcaaattattttattgaaatcacatgaaacgaagcaactcatcattgatcaaaaggagatggaataacgatggctatcgcagatgtaaccattatcccaatcggtacggaaacacccagtgtcagtgcttacgtagccgatgtgcaaaagatattagaaggatatcaagcagaagggaaaatcaaatatcagctgacaccgatgaatacgctgatcgagggagaactcagtgacctttttgcagttattcaggcaattcacgaagcgccatttcaaaaaggattgcacagagtggcaacgaatatccgtatcgatgacaggcgtgacaaaaaaacgacgcttgagagcaaaatagaaagtgtcaataaacatttacagccataaaaataaacctgtatccgatcggatacaggttttaatgtgcggttggatacccgctgtttattacggtcatcacggtaaaccatccaaagacaaataaggtggcaccggctaataaaaacccgagtatatttttatttctaacagaacgcaagactccccataaagcgaaaagagcgacaaggccgaaaatcacgacaagtaacataacacagccccctttacattgaaaaacctgcaattctttccagttttattctacctgttttttataggtttgtcgatagcgttttcattgcgattgtttgaatcttttttcaaaaaccctcataataagagcataaaaaagaaagaggtgataatagtgaaatggagacgaatgccagtagggccgattcaagcgaacgcatattttctcatcagtgatgatcaatgtctgatttttgatccgggcggcgagggacataaaatcaatcaatacataaaagaaaaagggctgacgcctttagccattttgcttacacatgcccattttgaccatattggggcgcttgatgaagtgagagaaaaatgggatatccctgtttacctgcatcaaaatgaaaaaaattggcttgcggacgcttctttaaacggctccggcatgctgcgagggatagaagtcacagctaagcctgcagatcatctaattgaaggcgacggtgagttgaatatcgggccgtttcatttggaaacattatttacgccgggacattcaccaggcagtgtgtcttactacgtgaaagatgcagacttggtcatttccggagatgtcttgttccaaggcggtataggacgtacggatttaataggcggcaatcaagagacgctgctgacgtccattcatgaaaaactgcttacgcttccggaacacacgctggtgttaagcggccatggacctgaaacagacgtactgactgagcaggatcaaaatccgtttttaaatgggttttcattgtaaaaaaagagacaaaccgataaggtttgtctctttctgcatttaatggcctccgccgccgggcaccataataaaaattgagtaatatgtaaagccggcgaagaaaattgttaaataagcgccaaaaatataaatatacatgcgttcggttaagttcaaatacgatagaaacacaaataagatcgtctgtccaaaaaataaaagggaagcatctttcatatcacctaaataaaacatgactgcaaaaattcccgtccaaaatcctaacacccggaacatgcgattcatttttatcccctcccgagagtccctctgactgttattataatagatcacacctagaaatgtaaacattttcattattaatatacaaatggaatttgtccctttgattgtgttttctattgtatgaatgttttttaaaaaataatccgaaaaaagttctgtaaatggtttaaatgaaaaatgatccgggtagttattctacaaagagatggttaactgaggaggaaaaaacgaatggaacaacaattaactttttactcatatccaagctgcacgtcatgccgaaaaacaaaacattggcttaaagcacatcaaattgaatttaacgaacggcacttattcagagaaaccccgacaagagaagaattaaagtacattttatcgttaacgacagaaggaattgatgaaattttggcgacaagaagccagactttcaaaaatttaaatttaaacattgaagaaatgacggtaaatgaggtgctggaacttttaatcgagaagccgaagcttttgcgacgcccgattctagtagacaacaaaaagctggtgattggttataacccgggagaactgttgaagttatcgaagaagaaaacggttcatcaatctgcatgatgaaaaaccgaagatccgctgatttatacgaatcagcttatcttcggtttttcacctgttcagaaactgggctagctggattcgaaccaacgatcacggagtcaaagtccattgccttaccgcttggctatagcccattgaatctaaacatagtatgtgtaaaggcagacgcgttatacatatatagcgtacatttttcaaaaacaggaggtaactcattaagatgatagctcttgatcagcacttaacagagcacaaaaaagatattacgcaacaatggctggaagtttgtacgtcaaacggcagctggctgtattcagcgaaagatcagcaaaaactagaacaaaagttaaaagaccagcatgaattattggtgaccatcgtagcaaaatcccttagaaaagaagacgtagaggatgagctcaaccggtggtctcttcaatgcgccagagaccgtgccgttcatgaagtgacggttacacaaagtgtcggccagtttaacactttcaggcacatcatgtttgaatggattcataaattcagcgaagcttcttctcaagacatcagcattcaggaattttatgagtggagccggatcttgaatcaaaacattgatgagatcatcgaagtgtttacggaagaatatcaccaggtgaccatgatacaattaaacgcgcaaaaagaaatgattaatgaattgagtgcgccgattatgccgattactgatggaattgggattcttccgcttgtcggtgaaattgatacgcacagagcgaggacgattttggagtctgtgctggagcagtgctcagcgttaaagctctcgtatttatttttagatatttcgggcgttcctatcgttgataccatggtagcctatcaaatttttaaagtgattgacagcaccaaattgctcggcattgagactattatttcaggaatcaggccggaaattgcccaaactgtcgtgaagctgggtctggatttttcgaatgtgaaaacagagcaaagtcttgctaaagccctggccaataaagggtttaaaataaaagagtgttgatgcctttgccatgtttatcttgaaagatagcagctgaacagcctttcacgggctattcagcttttttaacttctataaataaaatgtgatggctgttgatgtcttttaccttaaaagagtagccatcatattctatggcactttcaggctcagcgtctatgttttgtgtcaaaaaccagccgcccaaggtgtctacttcagcctctgataaatcggttccaagcaggctgttaacatcgctgattaataattttgcatttaacaagtaatgatcctttccaagttcgcggatatgaggcacttcatccgcatcaaattcatcacggatttctcctacaatttcttcgataatatcctcgacagtgaccaaaccggacgtcccgccatattcatctatgaggatcgccatatgagtgcgttccttttgcattttcagcaatagtttataaataggaatcgtctcaattacatggataacgggctgtacgaaaggttcaatttgatgcttcttgattgaaaaatctttcgtcagcatggaaaacagcacttctttcatattaatcacgccaatgacgttatctttatcctctcttacaaccgggtaccgtgtatattttgtttgcttgactgtttcctgaagatttgaaatggagtcttcatctagtgacaaactaaccatttcatttcgcggcaccataatttcctttgccattcgtttatcaaaggtgaagatattattcatgtactttaattcactttttctgatctcgccgcttttatagctttcagccaataggacccgaagttcttcctctgtataagccagctcatgctctgatgccggcttcagcccaaacactcctgtaatcaatcgggcagagtggttcaacagccaaatgaatggaaacatgatcttataaaaccaaataagcggtttagcgaacaacaaggtaatgctttctgctttttgaatggcgaaactctttggcgccagctccccaataacgacatttaaatacgtaaccactaaaaatgcgatgacgagtgaaagcaggtgggtaagcgattcatttaagcctgctttatgaaaaagcggtcgaagcagagtttgcacagtcggttccccaagccatcccagtcctaaagctgcgactgtgatgcccagctgacaggctgataaatattcatcaaggtgagtgatgacatgctttgccgctttagcacctttctttccttttgcgacaagctgatcaattttggatcgccgcacttttacgattgaaaattctacggcaacgaaaaatcctgttaacaaaatgagaatagcgactgctagtaaattgataaattccaaaacaactgccttctccaaggaaggcatgcacctcccttttccgatgtctttctacattccataccacctgaaaatgctcataaaacatgtgttgaagcggcagactggtttagtgatgcggttattgggcaattaaagaataaagaacaaaagtttggaggagcttgacatgaaggcacatacgggaaaggattggttttggtaccaaatggggcctcaagaaagaagtaaggcaagagatctaatccatttttctcactggcctcagtgtgaaaagtggtttgaaaataaccatcacgttaattttttgcgagtagatacaactgaaacggaaaatgaagcagtatttgggtcgattgtttatgatcaggggcttggtgaagaaaaagaccatactgtttttcacttttatatcaccagacaatatttttttacaatcaactttgacttttcaattttgagagagattaaaggcaaagaagttgttcggcaaatggaaagagcggacaatgcgatagaggggtttttaattcttctcggcgaactaatgaatgcgtatttaatcggtgttgatgaatttgaagtcaagctgagaaagctcagatggcaaattaaagacgacaatagcaaaagcattttaaaccgcgtccatctcctgcgccatgaactgatgatttggaaaaatttgatattaagcgctaaaaaaattgaaatggcgttgaaagaaacctttttacctcaaaatgaagggaaaaaggattatcagcggacacaactgaagattgacaggggatttacatacatcagcgaatttgaaggggagcttaacaatctgctgcattcagaggaagtcattacctcacatagggggaatgaaattgtaaaagcgctgaccattttcacgacgctttttactccgattacagctctgggtgccttatgggggatgaacttttcagtgatgccggaactgaattggaaatacggatatctcttttccctcttattgattgtcacatctacagttctgatctatctctatttgagaaaaaaaggctggacgggagatatgctgcaggagcggaagaagaaaaagaaacctcgaaaaaggcggactctataggatgtttcatattttgtgcagcgtgccccgctttttcaccagacatatcagggtgaccggatacgatgtcaaggggcttatgacagagcattaaatccgcagtttatcgattcttgaaaatgaccaaatgaccggtattgttgcattaggcgatctttccgttgagaaagatactggtcaataagcgaaaacagcataatgaaaatggaatctagcaggcatggtgaccatgtctgcttttttatttatagggaaaattataatgacaggggtacattcagttgaaagtcttttttcttgccagaaagaattggtttttcagcatataacatctcacaaaatcacgttttccctgtttgattaccttttcttctttttctacaatatgcgttgaaaggagagggaatcaaattggattcaatagaaaaggtaagcaaaaacttgattgaagaggcatatctaacaaaggcttctgatattcacattgtgccgagggagcgggacgctatcattcattttcgggtcgatcatgccttgctgaaaaaaagggacatgaaaaaagaagagtgcgtaagactgatttcacattttaaatttctttcagcaatggatataggtgaaaggcgaaagccgcaaaacggttcgcttacgttaaagttgaaagagggaaatgttcatttaagaatgtcaacgctgcccacaattaatgaagaaagcctcgtgatcagagtgatgccccaatacaatatcccttcgattgataaattgtcgctatttccgaagacaggagccacattactctcgtttttaaaacattcccatggcatgctcatttttaccgggccgactggttcagggaagactaccacattatactctctcgttcaatatgcaaaaaaacactttaatcgaaatattgtcacattagaggaccctgttgaaacaagggacgaagatgttcttcaggttcaggtgaatgaaaaagccggtgtaacttattccgcaggtctgaaagcaattttgcgccatgaccccgatatgattattttaggtgagatcagagacgcggaaacagctgaaattgcggtgcgggcagcgatgacgggacatctggtactaacgagccttcatacgagagacgcaaagggcgcaatttacagactgcttgaattcggtatcaatatgaatgaaatcgaacagactgtcattgcaatagcggctcagcgcttggttgatttggcttgcccgttttgtgaaaacggatgttcatcagtgtattgccgacagtcacgaaatactaggagagctagcgtttatgagcttctatacgggaaaaatcttcagcaatgtatccaggaggcaaaaggaaatcatgcaaattaccaatatcaaacgcttcgtcaaattatcagaaaaggaattgcgctcggctatttaacgacaaacaactatgaccggtgggtttatcatgaaaaagattagaaaagtctggttgttaaaggatcaagccaggttattaaagaggctcggtgaaatgactgcgggcggatatacacttctggatggattacgcctgatggaacttcagatgaataagaggcaggcggctgacttgactgattcggtcacttgtttgagggaaggggctccgttttatcaagtactaaagagtttgtcatttcataaggaagccgtaggtatttgttattttgctgaaacacatggtgaactgcctgcttcaatgatccagagcggagagctgctggaacgaaaaattgcacaggcagaccagctgaaaagagtgctgcgctatccgcttttcctcatctttacggtcgctgtcatgttttatatgttacagtccatcatcattcctcagttttccggtatctatcaatcgatgaatatggaaacctcacgttcaaccgatatgctttttgctttttttcagcatattgatcttgtgatcattttgcttgttctttttacagcaggtatcgggatttattattggcttgtgtttaagaaaaaatcacctgcccggcaaatgctgatttgtatcaggattcctttggttggaaagcttgtaaagctgtttaacagctactttttttctttgcagctaagcagccttttaaaatcaggcctctcaatttatgacagccttaatgcatttaaacatcaaacgtttctccctttctaccgctgcgaggctgaacaattgattgaacggctaaaagccggtgagtcaattgaatccgctatttgtggaagccttttttatgaaactgatttatcaaaagtcatatctcacggccagctgagcggccgattggatcgggagcttttcacatacagccaattcatattacagcggctggaacacaaagcgcaaaaatggacaggcatccttcagccaatgatttatggatttgttgcagcgatgatcttacttgtgtatttatctatgcttgtgcctatgtatcagatgatgaatcaaatgtgaaaggaagaggctgatgaatgagaaaggatttacacttgttgaaatgttaatcgtgctctttattatttcgattttgcttttaattacgataccgaacgtcacgaaacataatcaaaccattcaaaaaaagggctgtgaaggcttacaaaacatggttaaggcacaaatgactgcatttgagcttgatcatgaaggacaaactccgagccttgccgatttacagtcagagggctatgtgaaaaaggatgctgtctgtccaaatggtaagcgcattatcatcaccggcggagaagttaaggttgaacattaaattaaacgaggagaaggggtttacccttttagaaagtttgcttgtgttaagccttgcctctatcctcctggtggccgtcttcactacacttcctcctgcttatgacaatacagctgtccgacaggcagcaagtcagctgaaaaatgatattatgctcacacagcagactgctatttcccgtcaacaaagaacaaaaattctctttcataaaaaagaatatcaattagtcattggtgatacggttattgaacgtccgtatgcaacgggactttctatagaactgctgacattaaaagaccgtttggaatttaatgagaaagggcacccgaatgcaggcggaaaaatacgagtaaaaggccatgccgtttatgacataacagtttatctagggagcgggagagtcaatgtggagagaaaataaaggtttttctacaatagaaacaatgtctgcgctaagcctgtggctgtttgtgctgctgacagtcgtccccttgtgggacaagctgatggctgatgaaaaaatggcggaatcacgagaaattggctatcagatgatgaatgagagcattagcaaatatgtcatgagtggtgaaggagccgcgtcaaaaacgattacaaagaacaatcatatctatgcaatgaagtgggaggaggagggcgaatatcaaaacgtatgtatcaaagccgcagcttataaagaaaaatcattttgcctcagcattttgcagacagaatggctacacgcttcttaacgtattattttcgctctcagtctttttgctcatatcaggatcgttagctgcgattatccatctgtttttgtctcgacagcaggaacatgacggtttcacacagcaggaatggatgatttcgatagaacagatgatgaatgaatgcaaggaatcacaggcagttaagacagccgagcatgggagcgtgttaatctgcaccaatctttccggacaagacatccgttttgacatttatcattcaatgataagaaaaagagtggatggcaaagggcatgttccgattttagatcatattactgccatgaaagctgatattgaaaatggtgttgttttgctgaaaattgagagtgaagaccaaaaagtgtatcaaactgcttttccagtctattcgtatttaggaggggggtgaatgtatcgtacaagagggtttatttatccagctgttctttttgtgtcagcgcttgtgctgttaatcgtgaactttgttgctgctcaatatatttcacgctgcatgtttgagaaggaaacaaaagagttatacataggagagaatttgcttcaaaatggggtgcttctttcgattcggcatgttctagaggaacggaaaggccaggagggtacgcagcaatttctatatggacgggtttcttattacattcatgatacatcgataaaagaacaaaaagaaatcaacttaagagtgtcaacggattcgggaacagaaagaactgcacagatcgtgtttgaccaaaaacagaaaaaactgctgagatggacagaataaaacagtgtaaagggtataaaaaaagtcatgtgagacaacactcataataattgaatgatgaggtgatcacgtgaaaacgaatgattatgttaaatatatgacgcagcaatttgtcaaatatatagatactccgagagatgagcgaaaagaacgaaaagaggtgcggaaagaaacaaaaacgcctgtttcccagcagtggttcggtattttaccctatggcttccgactttggctgaaacggaaaaaataaccgcaaataaacgaataaggtccttcaaaaaatggaggaccttattgatattcttctaatatggcaattttattgaccttttggctataaggatcaaatgaaatcgtcacaaaaacgccgaattcttttgacccttccctcagagttaaatggtattgcttcactgcttcatcttttcttttacggtcccatactttttgtttgaacagtacctgtgcgagcgggtaccttttttttgcttcttttacagcaatctcttcccatttggacatgtggcgggcggttacaagcggtgtttcttctgcgtgagcggctgtggtgccaaagacgagaagagatagacaaatcacacattgtttgatcatcatgctgtcaccctttctttgtttattattaccaaataataatgggatatgcatttaaattctcacataacaatcccaaaaatttctaaaaaattgaaaaaatgagcaatactgagcaagactttgtaatatgatgaaaacattcttttaaacgaacgaaatgagcgatttcggtgtttttaaatctataaatcgttgattatactctatttgtgaagttctttaaagagaacgattgtcatatcaagttacagtgttttacaggaggtaagatatgtttcgattgtttcacaatcagcaaaaggcgaagacgaaactgaaagttctgcttatctttcagctttcagtcattttcagtctgactgccgcaatatgcttacaattttccgatgatacaagcgctgcttttcatgatattgaaacatttgatgtctcacttcaaacgtgtaaagactttcagcatacagataaaaactgccattatgataaacgctgggatcaaagtgatttgcacatatcagatcaaacggatacgaaaggcactgtatgctcacctttcgccttatttgctgtgctcgaaaatacaggtgagaaacttaagaaatcaaagtggaagtgggagcttcataagcttgaaaatgcccgcaaaccgttaaaggatgggaacgtgatcgaaaaaggatttgtcaccaatcaaattggcgattcactttataaaattgagacgaagaaaaaaatgaaacccggcatttatgcatttaaagtatataaaccggcaggctacccggcaaacggcagtacatttgagtggtcggagcctatgacgcttgcaaaatgcgatgaaaaaccgacagtccctaaaaaagaaacaaagtcggacgtcaaaaaggagaatgaaacaacacaaaaggatatacaggaaaaaacaatgaaagaagaaacatctcaagaagctgtaaccaaagaaaatgaaactcaatcagaccagaaggaaagcggggaagaggatgaaaaaagcaatgaagctgatcagtaatattttatacgtgatcatctttactcttattattgtgctgacacttgtcgtgatttcaacacgttcatccgggggagagccggcggtgtttgggtatacgctgaaatcagttctgtcaggttcgatggagccggagttcaatacaggttccttaatattggtaaaagaaatcgctgatgtgaaagagcttcaaaaaggtgacgttattacatttatgcaggatgcaaatacggctgtcacccacagaattgttgacataacaaagcaaggagaccatttgttatttaaaacaaaaggtgataataatgcagcagctgattcagcgcctgtatcggacgaaaatgttcgcgcacaatacacaggttttcagcttccatatgcaggctatatgcttcattttgccagccagccgattggaacggctgtattattgattgttcccggcgtgatgctgttagtgtacgcttttgtgacgatcagcagcgccattagagaaattgaaagaaagacaaaagccttggaaacagatacaaaggacagcaccatgtctacttaacttcagttgtaaacctggcaacaggtttcgatataaaatcattcaataaaaggggagtttaccatgggtatgaaaaagaaattgagtttaggagttgcttctgcagcactaggattagctttagttggaggaggaacatgggcagcatttaacgacattaaatcaaaggatgctacttttgcatcaggtacgcttgatttatctgctaaagagaattcagcgagtgtgaacttatcaaatctaaagccgggagataagttgacaaaggatttccaatttgaaaataacggatcacttgcgatcaaagaagttttaatggcgcttaattatggagattttaaagcaaacggcggcagcaatacatctccagaagatttcctcagccagtttgaagtgacattgttgacagttggaaaagagggcggcaatggttacccgaaaaacattattttagatgatgcgaaccttaaagacttgtatttgatgtctgctaaaaatgatgcagcggctactgaaaaaatcaaaaaacaaattgaccctaaattcttaaatgcaagcggtaaagtcaatgtagcaacaattgacggtaaaaccgctcctgaatatgatggtgttccaaaaacaccaactgacttcgatcaggttcaaatggaaatccaattcaaagatgataaaacaaaagatgaaaacgggcttatggttcaaaataaatatcaaggcaactccattaagcttcaattctcgttcgaagctacacagtggaacggcttgacaatcaaaaaggaccatactgataaagacggttatgtgaaagaaaatgaaaaagcgcacagcgaggataaaaattaataacagccataaaaagagacggcccagtattcatatactgggccgtctcgatggttattgacaaaagaggagttagtgcctctgctcaggcactactcctctttttgggattttctccatttttgataatctaaaaattcacgaaattgttttttcgataccccggatgtcatcgcatcgcgaaccaatttctcccattcactatctaattgaccatcgtattcggtttcatgtttctcatcgagcaaagtatgaaccgagacgtccagaacagcggagactttttcgagaaattgaatggaggggttcgtttgtagatttcgttctattgagcttaaataagacttcgctaccccagctttttcagctagttctgatagtgagtagcctttttctttacggtattgtttaatacgctggccaatcaatgtcatcaccttccttgtgatattatagcacattcagaaaggatttacggtatgacttctggctgccggaccaggatgagcagactttttgtttaaaagtaaatattttcgtatttcttccgggctgatatttgcctctttggcttccaccattaattcaacccattcttgatccaattcaaagtgctcttgttttgcattcttcatgcagtttctcctcctaaaatacttgtttatgtatttcagccagtccggccatgacttattgtatgcttcattagtctctggaagtcatttgccattaaatcaccagaatttttttccaatatacctttattataatcgtattttctcaaaaaaaacgagaatgatgtcgaatagtaaaaaagttagcttgaaatattattttgcagataaaacaatccgccattttcaatttcaactgatatctttggttgatacaaggttttcagcgcctgtttttctagatggtattcttctggtttttcttctatatgctcgtaaaacttatcaagcaatgtcatatcattcttccacctgttaaccgcctgttccgcccagtcggacggctcctgcatagcggatttggaaatatagttttccatacgcttaagtccgctttctggtttgatcataggtgaaatggtgaagcaatagtcacatatttgagacgtcagtgaaaactgggtcagcttgctttgaaaatcttcaattatcgttccagagactaggtgaagacctagtgacaataacttatcctttttcatgtcggactggtatgaaatcgtgacatttataccaagccaaggctgaagtgggactttagctccggctgattcaattttctcatacattctggtaaatctcccattttgtttaacagctttaaatatttgaaaaagacgcggggccccaaaatatataaattcaccatctaggtcttttggcgcattttctttatctgtaataaaagtgattttcattggattcggatcaccgcctgtcttctcgcgccaatgccagtagaaagggcggttcatgatttgtttgtccatttcaactgtaagctgcactgtcatatagcctaagccttgatcgacgatttggcagctgtttgcttgaaaaaaacgcagcagaaaatcgtgaacctcttgctgtctcactaataaaacctccttacaggctaagatcctcttttttcagcaggctgctgttttttataagacaaaaatgaggttaagttatccatttttattttcatttcttcttctgttgctgagtgatacaaaatgtcatgcagatgctcttcaaaattgttcacttgaattttcgttaaaatatcatcaagttcaccgaccactttttcaaacaaatgaattttttcatataaaagctttagaatatgctcttccaccgtatgttttgtcgccatgttataaatatgcacgtcacgctcctgcccgagtctgtgaattcttccgattctttgctcaagccgcatcggattccatggcaggtcatagttgatcatgtgattgcaaaattgcaggttaattccctcaccgcctgcttcagttgcaataaggacttggatttttccgcggaaaagatccttcatccagtctttttttccacgtttaaatccgcctctaaacggcacagaactgatgccgttttgctgaagaaaccactgcaaataaatctgggttgcccggtattctgtaaaaatgatgaccttatcgtcaatctttttgattaaatcaacgacttgaagcgctttagaattttgtgtcacttgattgatgcgatctattaaaactgaaatcgtatcctcatcaatggcaggtgcttgtttctctttttgatcaagcatctttttcagcgtcatatacaccgcttctctgctcgaacagcattctctttgcaaggtcataatcgagaacatgctggctggtttattgatactttccttcaagcgagaaatttcatcataaagcgcctgctctgatggagaaaattgaatcggcactgtttcaacatggcgctgtttccaattcagccctgtatcatgccgcctgttacggatcatgactttattcacaagatcttttaaatgttcatgcgcttctaaactggatttcttcttggcgaactcctcctgaaagtgattctgactgcctaaatggccgggttttaataaggacaccaaattgaaaatctcttcgatacggttctggattggcgtcgcggtaagaagcaggcaatatttttttacgagattccggacaaattcatagttcttcgttttgctatttttcagtttgtgtgcctcatcaataatgacaagatcatatgggatagacagaacgatttctcgatggggcgagcgcttcgcggtgtctattgatgagacgacaatatcgcattgctcccacacatagcttttcttttgttcaacagccggaatcaaaaatttttcctgaagctctttgacccactgtgacacaagggaagcgggcacaaggatcaaaattttttttgctaatccgcgaatcatatattcttttagaatcagtccagcttcaaccgtttttccgagaccaacctcatctgctaaaatcgctttcccgttcattttttcaaccactttttgcgccacttcaagctggtgggggagcggcgtaaaggaaggcagatataaaggagcccgtaagccttcaaaatctggaattgctaatgttttctggatttctgcagagagcttgtacagttcccagtttgcccaagggccatcgtttttcagtctttcagcaaattcttcaggccattttgcatcgtagatcatttctgtattcattgctttgaaaccgcctttcttattcttcgattcttaagatgaataatataagaaaaatctgcccaaattgctgttgcccagcatatagtgatgatggtaggatatgagtatgtatttgatgtaagatattgctatagtatgtccataacagcatgaaaatatgagcgaatgacagcaaggggagagacctgaccgaaaacctcgggatacaggcgccgaaggagcaaactgcggagtgaatctctcaggcaaaagaactcttgctcgacgcaactctggagagtgtttgtgcggatgcgcaaaccaccaaaggggacgtctttgcgtatgcaaagtaaactttcaggtgccaggacagagaaccttcattttacatgaggtgtttctctgtccttttttgtatgttttttagctgcgccgttgataaaggggaggaattagatgctgaacagaacgccgttatttgacctgtataaggaatatggaggaaaaacgattgatttcggaggctgggagcttcctgttcaattttcttctataaaaaaagaacacgaggctgtccgaactgcagccggtttgtttgatgtatctcatatgggagaagtcgaagtgtcaggaaacgacagtctgtcttttttgcaaagattgatgacaaatgatgtttccgcattaacgccaggccgtgctcaatatacagcgatgtgttacccggatggcggaaccgtcgatgatttgcttatctatcaaaaaggagagaaccgctatctgcttgtcattaatgcttctaatatagataaagacttggcttggatgaaagaacatgcagcaggtgatgtacagattgacaatcagtcagaccaaatcgcgctcttggctgtacagggaccgaaagcagaagcggtcttgaaaaatctgacagatgcggatgtgtctgcattaaagccgtttgcgtttattgatgaagccgatatcagcggccgcaaagcacttatttcacgcactggctatacgggagaagacgggtatgaaatttactgccgcagtgatgatgctatgcatatttgggaaaaaatcatcgatgcaggggatgcatacggattgattccatgcggtctcggtgcacgtgatacactccggtttgaagcgaagctcccgctctacggtcaggagctgacccgggatattacaccgattgaagcaggtataggctttgctgtaaagcacaaaaaggagtctgacttttttggtaagtcagtattgagtgaacaaaaagaaaacggagcgaagcgcaaacttgtcggtctcgaaatgattgaaaaagggataccgcggcacggatatgaggttttccaaaatggcaagtctgtcggaaaggtgacaaccggcacgcagtcaccgacattaggaaaaaacgtcggccttgccttaattgattcggaaacgagtgagatcgggactgttgtagatgtagagatacgcaaaaaattagtgaaagcaaaggttgtcaaaacaccattttataaacgctaatattttttcttggagagaggagacaacacatgaagcaccgttatttgcccgcaacagaaaaggataaacaggagatgcttgctactatcggcgtaagcagcatcgatgatttatttgctgatataccggaaaacgtcaaatataaaaaagagcatcaaatcaaaaaagcgaaatcagagacagaattaacaagagaactgacaaagctggcctctaaaaatcgtgataccgtacaatacgcttctttcttaggagcgggtgtatatgaccactatcagcctgtcattgtggatcatgtcatttcgcgctctgagttttataccgcatatacgccttatcagccagagatttcacaaggagagctccaggctatttttgaattccaaacgatgatctgtgaactgacaggcatggatatcgccaactcctcgatgtatgacggcggaacagccttggcagaagcagcaatgcttgcttcaggccacacgaaaaagaaaaaaattgttgtgtcaaaaaccgtgcatcctgaatcgcgagaggtgctgaaaacttacgcaaaaggtcagtatattgatgttgttgaagtacccgctgcggatggcgttacggatcttgatgcattgcgccaaaccgtttgcgagaacacagccgcagtgatcgttcagtacccgaattttttcggcaggatcgagccgctaaaggatattgagcctatcgctcatcaagggaaatccatgtttattgtttcagccaacccgctggcgctaggtcttctcactccgccgggcaagtttcagtctgatatcgtcgtcggtgatgcgcagcctttcggcattccttcagcatacggcggcccgcattgcggcttttttgccgttactaaaaaattaatgagaaaggtgccgggccgtctcgtcggacaaacggaagacgaaaacggaaaaagaggctttgtgcttaccctgcaagccagggagcagcatatccgccgggataaagcaacatcaaatatatgctcgaaccaagctttaaatgcgctggcagcatcagtggccatgactgctctcggaaaaaacggcgtaaaagatatagcccgccaaaatctcttaaaagccaactatgcaaagcaagaagcaaaaaaagcaggccttactgttatgtttgacgggccgatgtttaatgaatttgtcatcaaactggatgagccggtgagagctgtgaacaagcgtttgctggcaaaaggcatgattggcggatatgatcttgggttgacgtatccagagctggactgccatatgctgattgctgtaacagagctgagaacaaaagaagaaattgacgcactcattcaggaattgggggatcgccatgagtaatcaggaccaggcacttatttttgaactttcaagagaaggccgaatcggctatagtctgccggagctcgatgtaccggaaatcgaattgggggacctcttgtcagacacctatattcgtgacgaagacgcagcgctgccggaggtttcagagctggacatcatgcgccattatacagcgctgtccaaacgcaatcacggggtggattccggtttttatcctctcggttcttgcacgatgaaatataatccgaaaatcaatgaaaaaatcgcacgtattcctggttttgctgcgattcatcctcttcaggatgaagacacggtgcaaggcgcattagagcttttatatgatttaagcaaacaccttgaagaaataacgggaatggatgaggttacgcttcagcctgctgccggagcgcacggcgaatggacggggctgatgatgatccgtgcctatcatgaagctcgcggggatttcaagcggacgaaggtcattgtccctgattccgcgcatgggacgaatcctgcatcagcaacagtagcaggctttgaaaccgttacggtgaaatcgaatgaaaaagggcttgttgatttagaggatttaaaaagagcagtgaatgaagaaactgcagctcttatgctgacgaatccgaacacgctcggcttgtttgaggagcagattacagagatggcggaaattgtacaccaagcgggggggaaactgtattatgacggcgctaatttaaatgccgttttaagcaaggcgagacctggtgatatgggatttgacgtggtgcacctcaacctgcataaaacattcacaggccctcatggcggcggaggccccggctcaggccctgtcggcgtaaaacaagatctgattccttatttgccaaagccagttttagtcaaaaaagaagggcgctttacgtttgattatgaccgccctcatgcgatcggccgtgtgaagccgtattacggcaactttggcattaatgtgagagcgtatacgtatattcgctccatggggcctgacggattaaaggctgttactgagaacgcagtgttaaacgccaattatatgatgagaaaactcgcgccttattacgatcttccgtttgaccgccattgcaagcatgaatttgtattatcagggaagcggcagaaaaagctgggagtgcgtacgcttgatattgcaaaacggctccttgatttcggctatcatccgccgacgatttatttcccgcttaatgttgaagaatgcatcatgatcgagccgacagagaccgaatcaaaggaaacactggacgcgtttattgatgctatgattcaaatcgcaaaagaagcggaggagaatccggagcttgttcaggaggccccgcatacaacgattgtaaaaagaatggatgaaacaaaagcggcgagacacccagtgctcagatacgaggcggaagaaagataaataaaaacagctgtctaccagacagctgtttgctttatttcttcgctttaatctttccgccccattttttaaagccgccttttaggttgtaaatctcagtgcagccgtttttgcgcagggtttgtgccgcgcgtccgctgcggacactgttttggcagtacaggtaaacaggcttgtccgtacggatctcattttttctctgtttcagctgggaaagcgggatgttgcgggcgcctaaaatatgtccgccctcaaactcatttggctcacgaacatcaataagctgcgctttgcggtaacccgcgcggaattcttcttcggtaagtgttttcataattcgctgctgatagacatatgaagcaatcatatagatgataaatgcagcaaaaataatcaaaacgatcatattagacaatgtgattctactcctttagcatataaaatcaaaaccctgcttcataaaacaaggtcatagagccgttttcgacaaatactattatagtaaagcacagcgtgattgtcatctataatggaactaaaatatttttcattttcccgacagtttgataaactgattctattaaaacggtaaggaaggtcttaaaatgcaaaaagaaacttggcggtttatagactcaggcaatgcaagtcctgcattcaatatggcgcttgatgaagcgcttttatattggcacagcgaaaagaaaatccccccggttatccgtttttacggctggaatccggcgacactttctgtagggtattttcaaaatattaaaaaggaaatcaattttgaagcagtacataaatataatctcggattcgtcagacgcccgaccggcgggagaggtgtgctgcacgatcaggaactgacatacagcgtaattgtttcggaagagcaccccgagatgccggcgactgttactgaggcttaccgggttatttcagaaggcatacttcaaggctttagaaatctcggtctggacgcttactttgccatcccgagaactgaaaaagaaaaagaaagcttaaaaaatccgcggtcatctgtttgttttgacgcgccttcgtggtatgaactagtggttgaggggcgcaaggtggcgggaagcgcgcaaacgagacaaaaaggtgtgattcttcagcatggctccattcttcttgatttagatgaggacaagctgttcgatctgttcttatatccaagtgaaagagtaagagagcggatgcagcgcaatttcaaaaataaagcggttgccattaatgaactcatcgaaaagcgggtgacgatggatgaggctcgtaaagcctttaaagaaggatttgaaacaggtcttaacattcatttggagccatatgaactttctcaggaagagcttgattttgttcatcacttggctgaaacaaagtacgcttcagatgaatggaattataagcggtaaacagggcttttgacccgcggagcatccttgttttttcaagttcattagtgtaaacttgtaatggtttataaagttaaggtgctttttgggagggtttcgatgacaacaccaagtatggaagattatattgaacagatttatatgctgattgaagaaaaaggatatgcacgagtttccgatatcgcggaagcattggcagtccatccctcctctgtaacaaaaatggttcaaaaactagataaagacgaatatttaatttatgaaaaatatcgcggtctcgtgttaacgtctaaagggaaaaaaataggcaaacggctggtatacagacatgaattgcttgagcagtttttaagaatcattggtgttgatgaagagaaaatatataacgatgtcgaaggaatcgaacatcatttaagctggaacagtattgatcgcatcggggatcttgttcaatattttgaagaagatgatgcccgtaaaaaagatctgaaatcaatccaaaagaaaacagaacatcataatcagtaaaaaggcggtctcgaaggaggccgtcttttttgatacgctgacgccacccgtcattcgttggtctatttcttcgcgtgttttcttaaaatggtaataaacgatcggatggagggggagggaatgagatgtatattgacggtgtgttttccggcggaggagtaaaaggcattgcgctcgcaggcgcttatgaagtgcttgaggaaaaaggcttccgctttaaaagagttgcgggtacaagcgccggcgccattattgccgctttcattgcgtcaggttacaccagtaaggaaatccacgctttaattgaagaagtggacggagagaaattgctggatcagaggtactcatttctccccttaaagatgctccagtgggtgtccatctactggcgtcttggcttatacaaaggcgatacgatagaaaaatggattgctgatctgttaagagcgaaaggcataagggttttcggcgatttgcagaaagggtctctgcgccttattgcttctgatctgacaaacggcaccatgattgttttgccggacgatttggcccgttacgggttaaatccagatatgttcccggttgccagagcggtcagaatgagctgcagcattccgtatttctttgaaccgataaaattaaaaacggacacaggcaccgccacggttgtcgacggaggcgtgttaagcaattttccaatctggctgttttcaaaggaaagaaagcgccctgtgatcggtgtcacgcttgcgccgcgtgaaagagagcgtccgaaaaaaaatatccgcaacgcttttgaactgttcggcgccctgtttgaaacgatgaaggatgctcatgacgcaaggcacattgcgtcacgctatgaacaaaatatcatttttctccctgttgatgacgtaatggccactgattttcatttaacacaacaaaaaaactagccctgattgagctaggtaaaagacggacagagctgtttttaaagcagtggacctattaaaaagcgctctgtttttcttttatttttttcccttctataacagtcagctgagtctggctttttttcttgagaatcatcggcttaggcttgctggcgctcggaacgcttcgcaggtggctgacacgtcccttatgtccggcgcggtgttttgctttttgttctttcatccggcgccgtgattgtttcgccgcttttttgaaggctgctccttcgctgcccgcatttcgattcattacatatttcacaataaaataaataatgatacctgccacgatgacggttaccgccatttttgccatttctccgggattggttaccagcacatagaggaaaccgaacgctcccagcgcaattaatacagcaataataggttgtacacgatgattcataactgtccacctccgaaagtaatagcagggcaacggattttagatgacgttgtgagaaggcttctgattttgctcagacaatgcttcgagtctgagaagttcgttaaagctttcgatggcaacttcaacctgttcatccttaggttcctttgtggttaacagctgaagccaaagtcccgggtacccaagtaatttcagaccgggaatgtcacgcactttgtttgtcagctgcagaacttcaaaggatataccaagcacgaccggtatcagtgcgacacgatctataacacgcagccaaagcggatctgtcggaacgagtaaataaacaaacatgccgacaataatcgtaaataaaataaagcttgatccgcagcggtaatgaagccgagattggttttggacattctccacagtaattggcaaattctgttcataacagtttatgactttatgttcggctccatgatattgaaacactcttttaataagcggtgtcatggacaaaaaatagatgtaaccgagcagcaaaatcaacttaaacaggctttcaatcgcgatttgcgctgtgttcgaggaaaaaatcggccttgtcagttccgctaagaaaactggaaccaatgtaaatacgaatttactgaacaaaaatgataggacgcctataactgcgaggctgagatacatagacagcccagaggattttttttcttcctgctcaagtgtctcgtcttcagatggatcgagcccgtaacgttcgcttgaaaaattcaaatgctttgtgccgtttgcactcgcttcgataatggccgcgatcccccgtaaaaacggtatctttttcacgatgttcagtttcgggttgtgtttgcgtggaagcttaaaaaaagtcaatgcttccatccgttcttctgatggctgtaacgtaatgatgctttccgccaaacataacgccttccacaacagcctgcccgccgtaagcgggcggaactttatgttttgacatattatcaacctgcctatttctttaggattgctaaccatttcctttcactctattgtacaggaaacagcgctaaacctctagattgacaggctgaaaaaattgccatagccttgctttttctacatgcattatacccgttattttcaaattttactcgcagctgccaaaaagtgtgagcttttttattgacatttcattttttgggcacactttaactggaggtgccatgatgacaagcgaaaaagatacagaacaaaatgaagaattgaatgagaagcaaaagccgcctgtttcaatggccggcagggtggcggcaacaggtttttgcggaggcgtactttggagtttcgttgcttatatcgcatatttgtttcatttttccgaaatcagcccgaatatgatattgcagccgtttgtactcggagagtggaaaaaacatgggctgggaacggtaatcagcatcattttgattggagtaatttcaattggcgcagcatttctttattttcttctattgaaacgtttaaaaacaatgtggccgggtattttatacggcttggtgctttggctgctcgtgttttttgtttttaatccgatttttccagatgtgcgcacggtgaccgaactgacatcagatacaattattacgaccatttgcatttatttgctttacgggctgtttgtcgggtattctatttcatttgaatacaatgagctgaattcggaaaagcttgcacgtgcgctgggaatgcatagagaatagtgtataatccttttccagtatgataaaatgttcacgagaagtgaacattttttacatgagaaaccctcgcgaaaaggagagattgtgtgcctcattttttgattttgaacggaccgaatgttaaccggcttgggagtcgtgagcctgaagtattcggccgccagacactgaccgatattgaaacagatctttttcagtttgctgaagccttacatatccagctcactttcttccagtctaatcacgaaggtgatttgatagatgcgatacatgaggctgaggagcaatacagcgggattgttctgaaccccggcgccctgagtcattacagctatgcgatcagggatgctgtttcaagcatcagtcttcctgtggtagaggtgcatttatcaaacttatacgccagggaagaattcaggcatcagtcggttatcgctcctgttgcgaaagggcagattgtcggtcttggagctgaaggctacaagcttgctgttcgctacttattaagccagcaagggggagaatcaagatgaagctagagaaattaagaaacctgtttggacagctgggaattgacggcatgctgattacaagcaacactaatgtacgctatatgacagggtttacaggttcggcgggtttggctgttatatcgggtgacaaagcagcgtttattacggattttcgttatactgagcaggcgaaggttcaggtaaagggttttgagatcattgaacatggcggcagcttgattcagaccactgccgacactgttgaatcgtttggcatcaagcgtctcggctttgaacagaacagcatgacatatggcacttacgcttcatacagcgccgttatcagtgatgccgaattagtgcctgtggctgaatccgtggaaaagttgcgcttgattaagtctagtgaagagattaagatattagaggaagctgcgaagattgcagatgatgccttcagacatatcttgacgtttatgaaacccggcatttctgaaatcgctgttgccaatgagctggagttttatatgagaagccagggagcagacagctcttcttttgatatgattgtcgcctcaggccttcgttcaagccttccgcacggtgtggccagtgacaaactgattgaaagcggagaccttgttacgcttgattttggcgcttattataaaggatattgttctgatattacccggacggtcgctgtaggtcagcccagtgatcaattgaaggagatctatcaggttgtatttgatgctcaggcgcttggcgtcgcacatattaagccgggaatgacaggaaaagaggctgacgccctcacaagggatcatattgctgcaaaaggctacggtgactatttcggccattcaaccgggcacgggctcggcatggaagttcatgaatcgccgggattatccgtcagatcttcagctatccttgaaccgggtatggtggtcacagtggagccgggcatttacataccagaaacaggcggtgtccgcattgaagatgacatcgtgattacagaaaacggcaaccggacaatcacccattccccaaaagaacttattattttgtgattggaatataggaggacattaaacatgatttcagttaacgatttccgtacaggattaacaattgaagtagatggcggcatttggcgcgtcgttgacttccagcacgtaaaacctggaaaaggtgcggcatttgtccgctctaaactccgcaaccttcgcactggcgcgattcaggaaaaaacattccgcgctggtgaaaaagtagcgaaagcgcaaatcgaaaccaaaacaatgcaatatctatatgcaaacggagatcagcacgtatttatggatacttcttcttatgagcagcttgaactgagcgcaactcaaatcgaagaagaattaaaatacctgctagaaaacatgtctgtgcatatcatgatgtaccaggatgaaacacttggtatcgaacttccaaacacagttgagctgaaagttgttgaaactgaacctggtattaaaggtgatacagcgtcaggcggtacaaaacctgcgaaaactgaaaccgggcttgttgtaaacgtgccgttctttgtgaatgaaggcgacacacttgttgtcaatacatcagacggttcttacgtttcaagagcatagaaagaaaaaaagaagtctgttcccaaatgggagcaggctttttttgtgcccaaaaacagaatctttcttttatacgaaaatgacaagactacttcagcaagctagagcatatcatataaaaaaatgggaggttgggagagtgctatgaaatttttacttggaaatatcaattctactgttttaacaatggcgggattacgagttttatcctctatgattgagctgacggcagcaattgtcatgcttgtgaccaacgatgtccggaaggcggttgtggttaacagcattctcgctattgtcggtccgttgatttttatcattacaatgactgtcggaatctaccaaattgccgggcagctttcgtatgcaaagctgattctgatttttacgggtgttgtcttgattttggcgggtgttcataaataaagagaggcttgtcataaagtctgcctcacatcatacattttaaagaagccaatcggtagaaaggaggaggctctgttgaatgaaatcgctgaggttctccctgaatccatgaaaaacgccctttctgaaataccggaacaacaatggctggaaatcgaagaagtcagaattcggatcaaccgccctgttgaattgattcgaagaggacaacctgtttatttgtcctatgcgggcacggccgaggatgcccatctgatcctgagccggctcagcaactatagtatgtatacacttgaagaagagctgaagaaagggtatgtcacgatcagaggcggccacagagtcggactggcgggcagagtcattacggaaaacggaggtgtgaaaggcctccgtgacatcgcatcttttaatatacgaattgcccggcaaaagctggggattgcggagccgctgcttccatacttatatcaaaacagctggctgaatacgctgattatcggaccgccccaaaccggcaaaacaacacttctccgggaccttgcgaggctctcaagcaccggcaaaaaaacatgctgcccgtaaagacagggatcgtcgatgaacggtcagagattgccggatgtcttcgcggtattccgcagcatcaatttggtcagagaattgacgtgttagacgcctgtccaaaagctgaagggctgatgatgatgattcgatccatgagccctgaggtgatgattgtcgatgaaatcgggcgtatggaagatacagatgcacttctggaggcgctgcatgccggtgtttcagtaatcgtatcggcgcatggctggagtatatccgacctgatgaagcggccttcattgaagcgtttgtgggaagaaagagcctttgaccgctatttggaattatcaagagcaaaagggccgggcacagtgagccaaatttatgacaaagacggaaatgtgctgtctaggacgacgggcgtgaaaacatgctgaagctgctgggcgctgtattcattgtggtagcgacaacatggacaggttttgagatggcgaagatttatacagaacggccgcggcaaatccgccagctgcgtgcggcgcttcaatccctcgaggctgaaatcatgtacggccatacaccgcttcatactgcttcacagcagattgccaaacagctcgcacagcctgtttcaactcttttttccgcattcagtgatcagctggacaagggaagtgattccgcgaaaacggcgtgggagcaaagcttaaagaaggtatgggacaccctgtctttgaaaaaaagcgaatacgaagtgctgaagcagtttggcgagacgcttgggattcatgatcgaatctctcagcaaaagcacatcaagctggcgctgacacatttggaagcctcagaagcggatgctgagcaggcgcaagcgaaaaacgaaaagatgataaaaagtttgggctttttagcgggcttgttactcattcttctattgatgtaaacgtgaggggagcaaaaataaaatgggagtagacgtgaatgtcatatttcaaatcgccggagtgggaatcgtggtcgcttttttacacacgatattggatcagatgggcaagaaagaatatgctcagtgggtgacgctgttaggttttatctatattttatttatggtcgccacgattgtagatgacctatttaaaaagataaaagctgtgtttttattccaaggataggggggcttgcagattgacattgttcaaattgtaggtttagggctgatcgccaccttcctttctttaattgtaaaagaacaaaagccgacttttgcgtttttaatcgtcgtttttgccggatgtgccatttttctttatttggtagaccaaatctacgacattattcgaatgatagaaaaaattgcgattaatgcaaatgtcaacatggtctatgttgaaaccattttaaagattatcggaatcgcctatattgctgaattcggggcacagctcacaaaagatgccggtcaaggagccatcgcctcgaaaatagaattggcggggaaaattttaatactcgtaatggctgtgcctattttaaccgtcattatcgaaacgattctcggacttataccttctatgtcataaccgaaaggaggcggtagattgaagcgctttcaatgggttttgcttttggccgtgctgatcatagcaggccgtgcagaaattgtacaagcagctggtaatgcagaacaaacggaagaccatgctgaaacagccgagcaattagcggaaaggacagcagcctcgcttgaaacagataagatcggggaattttggaatgacattatgacagaatacggcggactgctgccggaaagccaaaaaggcagcttaatggagtttatcaatggcgataaatcattctcaccgcaagaatggctgaaagctctcttttcttatttgtttcatgaagtgcttgccaacggaaagctgctgggcacattgattttgctcacgattttttgcgtcattctgcagcttttgcaaaatgcttttcagcaaagcaccgtcagtaaggtcgcttactcaattgtgtacatggtgctgattatccttgcgcttaatagctttcatgtggcaattaactatgcaactgaggcgattcagacgatgaccagctttatcctggcgctcattccgctcctcttggcgcttttggcttcctcaggcggagctgtatctgctgccttctttcatcctgttatcctcttcctgatgaacacgagcggtctcttgattcagaatatcgtcatgccgctgattttttttatcagcgattctgagcattgtcagcacgatgactgaacaatacaaagtaacgcagctggctaacctgctcagaaatatcgccatcggagcactggctgtttttcttaccatctttctcggcgtcatctctgttcagggagcgtcagctgcagtgacagacggcattacgctcaggacggctaaatttataaccggaaattttattcctgtgcttggccgaatgtttacagacgcaacagatacagtaatcagcgcctctttactgctgaaaaatacggtagggattctcggtgtcgctattttgatctgtattgcggcatttccggcaatcaaagtgctttccctcgcttttatttataagctggcagccgcgattcttcagccgctaggaggcgggcccgtcatcacctgcctcgacgtcatcagcaaaagcgtcatttatatttttgcagctctcgccattgtgtctctcatgttttttttaagccttactgtcataatcacagccggaaacctcacgatgatgatgaaatgaaggaggcaggcaaatgagttttttaacggaatggcttaccaccatcgtgttgtttatcctatttgcaattgtgattgatatgctgctgccgagctccagcatgcaaaagtacgcaaaaatggtagtcagcctgctcttgattgtcgtcatgcttacgccgatttttaaacttttcaagacagaccccgaagtcatctttgaatacctcacaaaaaacgggcagtcagagtctgccgacataaaaaatcaaatcaattcaaaaaaaatagaaatacaagcttcccagcgcgcatatattctagaagaaatggctgtccaactaaaaaagaaagcggaggagagattcagtcatgatgaatataaagtaggccgcatcaaactcacggcaggagaaaaggtagattcagaagaggatattaaaacaatcagcgtgtatatggccccgtcttctgaaaaaacggtccaaacggtcgcgccggtccacattgatacagatcatgcatacgtaacaaaagaagcagccgaacaaaaagaagccaaacagatacaaacgcagctcgcggacatttgggaaatcggaagtgagaaaattacggttcatatggaaggcggggagagtgtcggcaatgaataaaaacggattatggaatgtattgaaaaagcagtttcttccgggacaaacgaaggacggcgaaaagccgaagctgaccaaatatcattactttctattcgtttttgttctcggagtttcctttatgcttgtcagccagctgttttcttcacctgagaaaactgaaaacgccaaaacgataacggccgtatcatcacaacattccgcagacagcaaagagaaaacagccgaagtgtttaaagcctcaaaatctgataaacctaaagactcgatcgatgactatgaaaaagaatacgaaaatcaactgaaagaaattcttgaaacaatcattggtgtggacgatgtctcggttgtcgtgaatgtagatgcaacgtcgctgaaagtatacgaaaaaaacaaatcaaacaaaaatacaaccactgaagaaactgacaaagaaggcggaaaaagaagcgttacagaccaatcatcggaggaagaaatcgtcatgatcaaaaacggcgataaagaaacacctgtcgtcgtccaaacgaaaaaacctgatatacgcggtgtactcgttgttgctcaaggagtggacaacgttcaaataaaacaaaccattatcgaagcggtgacacgggtcctggatgttccaagccaccgggttgcggttgcccctaaaaaaataaaggaggattcataaatgcttaaaaaacaaaccgtttggctattaacaatgctcagtcttgtcgtggtgttaagcgtctactatatcatgtcgccggaaagcaaaaacgccgtgcagatgcaaagtgaaaaaagcgcgtctgacagcggagaggtcgcaactgaaaaagcgcctgccaagcaagacacgaaggaaaaaagcggtacagaaactgaaaaaggaaaagaagatggaacaaagggaacgaaagattcatcagcagacaaggaaacatccgctgaagccagtgaaaaaggaactgttgttacggaaacagccgatgatgatttgtttacaacgtaccgtcttgatttagaagatgccagaagcaaagaaagagaagagctgaatgccattgtgtcaagcgatgatgcaacagccaaggagaaaagcgaagcatacgataaaatgacggctctcagtgaagtggaaggaacagaaaaacagctggaaacgctgattaaaacacaaggttacgaggatgcgcttgttaatgctgaaggagataaaatcaatattacagtcaaatcagacaaacactctaaatcgaaggcgacagccattatagaccttgtggcaaaagaaatcaaaacaatgaaagatgtcgctgtcacatttgaaccctctaaataagaatgagggaaaaaagcccgctaaacaagcgggctttttgcgttgctgtcatattagagttgaattcaaaagtccgctcctgtaagatgaacatagtatgtacttttagtagtaacctataaaaaagaaatttcatacataggagtgcgattgaatgttaaatatcaaagaaatccacgagctgattaaagcaattgacgagtctacaattgacgaattcgtatatgaaaatgaaggtgtatccttaaaactgaaaaaacacgaagcaggcacggttcaagtcatgcagcaggcaccggcagcacctgtacaagcacaggctccgcaggcagttcagccgcaagcgcagcaagcagcggcacctgcccaagaagcaccaaagcaagatgagaatctgcataaaatcacttcaccaatggtaggaacattttatgcttcttcatcaccggaagctggcccgtatgtaacagccggttcaaaagtaaatgaaaacacagttgtctgcattgtagaagcgatgaagcttttcaacgaaatcgaagcagaagtgaaaggcgaaatcgttgaagtattagtagaaaacggccagctggtcgaatacggacaacctctatttcttgtaaaagcggagtaaggagactgaacatgattaaaaagctattgatcgccaacagaggagaaattgctgtcagaatcatcagagcctgcagagagctcggaattgagactgtcgctgtttattcagaagctgataaagatgcccttcatgttcaaatggccgatgaagctttttgtatcggaccgaaagcatcaaaagacagctatttaaacgttacaaatattgtgagtgttgcaaagctgactggcacggacgccattcatccgggatacggatttttagctgaaaatgctgatttcgctgaattatgtgaagaagtgaatgtcacgtttgtcggcccgagcgctgacgccatttcaaaaatgggaacaaaagacgttgcgcgggaaacgatgaaacaggccggcgtgccaatcgtaccgggttcacagggaattatagaaaatgtggaagaagcggtttcgcttgctaatgaaattgggtatcctgtaattataaaagccaccgcaggcggaggcggaaaaggaattagggttgcccgcactgaagaggaactgattaatggcattaagattacacagcaggaagcggcaactgcatttgggaatccaggtgtatacatcgaaaaatacatagaagattttcgccacgttgagatccaagtgcttgctgataactacggaaatacgatccatttgggcgaacgcgactgctcgatccaaagacgcctgcaaaagcttttggaagaatcaccatctcctgcccttgattcagaaatcagggagcaaatgggagatgcagcggtaaaggctgccaaagcggttggctatacaggtgctggaacagttgaatttatctatgactacaatgaacagcgctattacttcatggaaatgaacacgagaatccaggtggagcacccagtcacagaaatggtgacgggaactgacctgatcaaggaacaaatcaaagtggcttcaggaatggaactgagcctcaagcaagaagatgttgaatttgaaggctgggccatcgaatgccgaatcaacgcagaaaacccaagcaaaaatttcatgccgtcacctggtgaaattaaaatgtacctgcctcctggcggtcttggtgtccgtgtcgattcagctgcgtaccctggctattccatcccaccgtactatgacagcatgattgcaaaggtaatcacatacggaaaaacgagagatgaagcgattgcccgcatgaagcgcgcattgagcgaattcgtcatcgaaggcattgagacaacaatccctttccatttaaaactgcttgaacacgaaacatttgtgagcggagagtttaatacgaaatttttagaaacatatgatgtaatgggctcataatttttacggaggtgaattgaatgaaagacaacagcttgcttaaaatggatcacgaagatacgcatttgggtaaggttgagattgcaccggaggtcattgaggtcattgccggcattgcagcatcagaagttgatggagttgccgaaatgcgcggaaactttgcgacaggcgtcgttgagcgctttggcaaagtgaatcatggcaaaggtgtcaaagtcgacctggcggatgacggaattacgatcgatgtatactgtgtcgttacatttggcgtttcgattccgaaagttgcagcatccgttcaggaaaacattcgtcaaaccttattaaatatgacgtctctttcgattaacgagatcaatattcacatcgtcggcattcaatttgacacaaaagcccaagaagtccaaatcgacgaagaaatgtaaatggcttaacacgaaaccaaggggagggcggccctttggtttttttacacgttaccctttatttcaaagcatgaagaaagccggcttacatagccgagtttcttcatgaacgtgaaatccgaataatcatattaaggtgtgtgaaaatattcggtaatagggtaaaaaaaccttgatttcaatatgcggatacgaaaaaaatatgttatgatctctttgtggcttaacgacaagcggataaagaggatcaaaggagaaagaaaatgaaaagaagaacagcaagagaaaaagctttgcaggcactatttcaaattgatgtcagcgatattgcagtgaatgaagccatagaacacgcactggatgaagaaaaaacagatcctttctttgaacagcttgtacacggggtattggaacaccaagaccagctggatgaaatgatctccaagcatctggtgaattggaagctcgatcggattgccaatgttgaccgtgcgattttgcgcctggcagcatatgaaatggcatatgccgaagacattccggtgaatgtctccatgaacgaagcgattgagctggcaaaacggtttggtgatgacaaagcgacaaagtttgtaaacggggttctttctaacattaaatctgatattgaacaatcataggaggaaagaaaatgactgcaacaatcatcgacggaaaagaaacggctagagaaaaacgcgaacaattggcaaaagaggtagaagagcttaaaaagcaaggcgtcactcccggactggcggttattttgattggagatgatcctgcttctcactcttacgtgcgaggaaagaaaaaagcggcagaaacaatgggaatgaatttcaagctcgatcaatttgacagcagcctcacagaagctgaactgctttccattattgatcaatataaccaagaccctgagtttcatggcattctcgttcagcttccgctcccagaccatatttctgaaaaagcggtgatcgaacgtatctcccctgataaagatgtagacggttttcatccgttaaacgtagggaaaatgctgcttggcgaagatacgtttcttccttgcacgcctcatggaattgttgagcttttgaagaaaaccaatattgacctttccggtaaagaggttgttgtagtcggccgaagcaacattgtcggcaaacctgtcggccagcttttattaaatgaaaacgcgacggttacttactgtcattcaagaacagaaaatattactgaacatacgaaaaaagcggacatcctggtggtggcagtcggcagagccaacttcatcagtgcagaccagatcaaagagggcgctgttgtcattgacgtcggcgttaaccgtctggaaaacggaaagctttgcggagacgttgaatttgaaggggcaaaggaaaaagcgtccttcataacgccggttccgggcggagtaggtccgatgaccatcacgatgcttgcgcataatactgttaaatctgcgaaacgtacgttatcatagataattggagatattcacaggcgaaatgtttacccgccttgaatatgagcacgatacccgcttcttcaggctcctaaagccagggcgggttttctttagttatggtgcaggaatgcttaggagaggagtttttagacatgggtgaagcagcgtatgtgaccgtctcagcgctgacaaagtatataaaacgaaaattcgatgtagatcctcaccttgaaaatatttggattaaaggcgaattgtcgaatgtaaagatacacacacgagggcatatttatttcactttaaaagacgaaaacgcaagaatgcagtcggtgatgttcgcgagacaaagcgagcgtctgccttttaaacctgaaaacggaatgaaagtgctggtcagaggcggaatttccgtatatgaaccgagcggaaactatcaattatatgccaaagaaatgcagcctgacggggttggagcgctttatttagcgtacgaagaattaaaaaagaagcttgccggagaaggtttatttgacgaccgctacaaaaaacaaatccccgcatttccagccacaatcggggttgtgacatctccaacgggtgccgctgtcagagacgttattacaactctaaaaagaagatatccccttgtaaaagtcattgttcttccagcgctcgtacaaggtgaaaatgcgagcagatccatcgttacgcgcattgaagaggcaaatgaaaaagagatttgcgacgtattaattgtcgggagaggcggcggttcgatagaagaactgtgggcattcaatgaagaaattgtagcacgcgccatctttgcttccaatattccgattatatcggcagtcggacatgagacggattttacgattagtgattttgtcgccgatatcagagctgcgacgccgacaggagcagctgagattgctgtgcctcataccactgatttaatcgaacggacaaaaacagcggaagtcagaatgacaagagcaatgcagcagcatctcggccagaaaaaagaacggatacaaacgctgcaatcgtcctatgcctttcgttttccaaagcgtttgtatgcgcaaaaagagcagcagtttgacctcgcgtaccagcagtttcaagcacagctgaccgctcttttagatcggaaaagcagacagctggagcgtgaaacgtacagattagaggcattgcatcctcatgaacagctgaaacaagcgagaacacgataccaggaacaaacaaatcagctgagaaaaaatatgaatatccaaatgaagcagctgcattcccaatttcaaaccgttcttggcaagctgaatgcactaagtcctcttcaagtgatggaaagaggatacagcttggcttataaagaagataaactcattaaaagtgtcagtcaaatagaagagcaggaccggcttgaaatcaagctgaaggatggcgtgctgacctgtgaagtattagaaaagagaggggaagaaaaatgacagacgtgaaaaaaaatgaaaacatgacatttgaagaagcgatgaaagggcttgagagcattgtatcaaagcttgaagagggagatgtgcctctagagcaagccattaactatttccaagaaggcatggctctgtcaaaaatgtgccatgaaaagctgcaaaaagtcgaaaagcaaatggacttcattttaaaagaagacggcgaactggcacctttcagtgttcaggaggaagacgaaggtgacaaataaattaacgagctttctggcggaccggaaaaaaacaattgaaaatcagctttctgtctatacagaaaagcttgatatgccggactcattaaagaaatctatgctatattctctacaggccggcggaaagcggttgcggcctctgattgtactggctgttttaaatgcatatggaaaaagcgaaaaagacggcattccggtgggctgtgctgtcgaaatgattcacacgtattcgttaattcatgatgatcttccatgcatggatgatgacgatttgcgccgcgggaagccgacaaaccataaagtgtttggtgaagcgacggcagtattagcgggtgacgggctgctcacagaaagctttaagctgattacctcccacgtgtcagacgaggtgtcagcagaaaagcgcctgcggcttgtgaatgaactgatttcagcggcaggcaccgaaggcatggtcggtgggcaagtagctgatatggaagcggaaaaccgacaagtcacgcttgaagagctcgaatccattcatgaacggaaaactgccaagctccttggcttttgtgtaatcgccggtgctattttggctgatgcgcctgaggaagacattgaaacactgcgtaccttcagcagccacattggaatcggatttcaaatcagagacgatattttagatttagaaggcagtgaagagaaaatcggcaaacgtgtcggctcggataccacaaatgacaaatcgacatacccgtcgcttctttcattggaaggggccaaacataaattggatgttcatataaaagaggcgaagcgattgatcggcggactctctcttcaaaaagaccttttatatgagctttgtgatttaattgcggcaagagatcactaaaacgatcctaatttgaagcggctgcacgaggtatggtaaaatgtaagcagtttatatgaaaaatgaaaaggaaaagcgcgtttgtctttttttatgtctgagattattgtcagctcggcatgcaaaagacatgtatcattgcagaaattcatgctgaaagtgagttgatccgctttggatcttttatcaatacaggacccgtcgtttttaaaaaacatgtccattgatgaattagagaaattaagtgatgaaatccgtcagtttttaattacaagtttatccgcttccggcggccacatcggcccaaacttaggtgtcgtagagcttactgttgccctgcataaggaatttaacagcccgaaagacaaatttttatgggatgtaggccatcagtcgtatgtccataagctgctgacaggacgcggaaaagaatttgcgacgcttcgccagtacaaagggctttgcggatttccaaagcggagtgaaagcgagcacgatgtttgggaaaccgggcacagctcgacttctctgtcaggcgcgatgggaatggcagctgcccgtgatattaaaggaacggatgaatatattattccgatcattggtgacggcgcgctgaccggcggtatggcgctcgaagcccttaaccacatcggcgacgagaaaaaagacatgattgtcatccttaatgataatgaaatgagtattgcgccaaacgtcggtgccattcactctatgctcggacggctccgcactgcggggaaataccagtgggtcaaagatgagcttgaatacttatttaaaaagattccggcagttgggggcaagcttgccgccacggcggaacgggtcaaagacagcctgaaatacatgctcgtctccggaatgtttttcgaggagctcggttttacgtatttgggcccagtggacggacattcttatcatgagctgattgagaatcttcaatacgccaaaaaaacgaaaggccctgttcttctgcacgtcattacgaaaaaagggaaggggtacaaaccggctgagaccgatacgattgggacatggcatggtaccggaccatataaaattaataccggtgactttgtaaagccgaaagccgcagctccttcgtggagcggtcttgtcagcggaactgtgcagcgaatggcgcgcgaggacggacgcattgtagccattacgccggctatgcctgtcggttcaaagcttgaaggcttcgcaaaggaattccctgaccggatgttcgacgtaggaatcgcagaacagcatgccgcaacaatggctgcagctatggcaatgcagggtatgaagccgtttttggcgatttactcaaccttcctgcaaagggcatatgaccaagttgttcatgacatctgccgccaaaacgctaatgtgtttattggaattgaccgtgctggactcgttggcgctgatggagagacacatcaaggcgtgtttgatattgcgtttatgcgccacattccaaacatggtcttaatgatgccgaaagacgaaaatgaaggccagcacatggttcatacagcacttagctatgacgaaggcccgatagcaatgcgttttccgcgcggaaacggactcggcgtaaaaatggatgaacagttgaaaacgattccgatcggtacgtgggaggtgctgcgtccagggaacgatgctgtcatcttaacattcggcacaacaatcgaaatggcgattgaagcagccgaagagctgcagaaagaaggcctttccgtgcgcgttgtgaatgcgcgttttattaagccgattgatgaaaagatgatgaagagtatcctaaaagaaggcttgccaattttaacaattgaagaagcggtcttagaaggcggtttcggaagctcgattttagaattcgctcatgatcaaggtgaatatcatactccgattgacagaatgggtatacctgatcggtttattgaacacggaagtgtaacagcgcttcttgaggaaattggactgacaaaacagcaggtggcaaatcgtattagattactgatgccaccaaagacacacaaaggaattggatcatgacgtcaaagaaagaacgattagatgtattattagtggaaagagggctggcggaaacgcgtgaaaaagccaaaagagccattatggcggggatcgtctattcaaacgaaaaccgcttggacaagcctggagaaaaaattgaccgcgaccttccgttaactgtcaaaggaaacccgctgaggtatgtgagcaggggcggcttaaagctcgaaaaagcgttgaaggaatttcccgtctctgtcaaagataaaattatgattgatattggctcctccaccggcggttttacggactgcgctttgcaaaatggagctaaacagtcatacgctgtggatgtaggctataatcagcttgcatggaagcttagacaggatgaacgggtcgtcgtgatggaacggacgaactttcgttatgcaacaccggcagactttacaaagggcatgccggagtttgccacaattgatgtgtcctttatttcactgcggctcatcctgcctgtcctaaggactttgctcgtaccgggcagcgactgcatggctttagttaagcctcagtttgaagcgggacgggaatccgtcggcaaaaaagggattgttagagatcctaaagtgcatgctgatgtgctcaagcgaatgatcagtttttctgccgctgaaggctatatctgtaaaggcttgtcattttctccaatcacgggaggagacggaaatattgagtttctccttcatttgcattggccgggagagggacaggaaggccaggaactgccggaagaagagatcatgcgcgttgtagaagaagcacataagacgttaaaagaaaaaaagcagatgtaccggaataatagggcgctattattccttttttctgcattcatgtacaatgtgcagagaatcatataacataaaagaacagataagcttggaaatagaggtgcttacatgaacaaaggccagaggcatattaaaatcagagagatcattacaagcaatgaaatcgaaacgcaggatgaattggtcgacatgctaaagcaggatggatacaaagtaacgcaggccacggtatcacgggatattaaagaacttcaccttgtaaaagtgcctacaaataatggttcttacaaatacagtcttccggcggaccagcgtttcaatccgctgtcaaagctaaagcgggcattgatggacgcatttgtgaaaatagactcagcaagccatatgattgtgctgaaaacgatgccgggcaatgcccaggcaatcggggcgctgatggacaatttggactgggatgaaatgatggggaccatttgcggagatgatacgattttaattatttgccggactcctgaagatacagaaggcgtaaaaaacaggctccttgaactgctgtaacagaaaatctaacaaagataagaggtgtaatgctgtttgttagctgaactatcgattaaaaactttgccattattgaggaactgacggtttcttttgaacgcgggcttacggttttaacaggagaaaccggagccggcaaatccatcatcatagatgccatttctcttttagtcggaggccgcggatcatctgaatttgttagatatggggaagcaaaagccgaacttgaagggctgtttctgttggagagcggccatcctgttttaggcgtatgcgctgagcagggaatcgacgtttcagacgaaatgatcgtcatgagaagggatatcagcacgagcgggaaaagcgtttgccgtgtcaatggcaagcttgtcacgattgcttcactaagagagatcggcaggcttttattagatattcacgggcagcacgataaccagctgttaatggaagacgaaaatcatctccagcttttggacaagtttgccggggccgaagtggaaagcgcgctcaaaacgtatcaggaagggtaccagcggtatgtgaagctgctcaaaaagcttaagcagctttctgaaagcgaacaggaaatggcccatcgtcttgatcttattcaatttcagctcgaagaaatcgaatcggcaaagcttgagcttaacgaagatgaacagctccaagaagagcgccagcaaatttcaaactttgagaagatatatgagtcgctgcaaaatgcatataacgcgcttcgcagtgagcagggcggattggactgggttggaatggcatcagcgcagcttgaagatatatctgatataaacgaaccgctgaaaaaaatgtctgaaagtgtttcgaactcctactatttgcttgaggatgccacatttcagatgagaaatatgctggatgagcttgaatttgatccggaacgcctgaactatattgagacgcgacttaatgaaatcaaacagctgaaacgaaaatacggtgccactgttgaagacattttggaatatgcttctaaaattgaagaagagattgaccaaattgaaaacagggacagccaccttcaaagcttgaaaaaggagcttgactccgtcggcaaagatgtcgcagtggaagcggcaaatgtgtcacaaatccgaaaaacatgggcgaaaaagctggctgatgagattcatcgggaattaaaaagcctgtacatggaaaaatcaacttttgatacggaatttaaggtcagaacagcgtcacgcaatgaagaggcgccgcttgtaaacggccagcccgttcagctgactgaacaagggattgacctggtgaagtttttaatttcaaccaatacaggcgagccgctgaaatccctttcgaaagtcgcttcaggtggagagctgtcacgggtgatgcttgccataaaaagcattttttcctcacaacaggatgtgacatcgatcatttttgacgaggttgataccggtgtaagcggcagggtcgcacaggcaattgctgagaagatccataaggtgtcaataggatcacaagtgctgtgcattacacacctgcctcaggtggctgccatggccgatacgcatctttatattgcgaaggagttaaaagacggcagaacgacgacacgtgtcaagccgctctctaagcaggaaaaggtagcggaaatcgggcgcatgattgcaggtgtcgaagtaaccgacttaacgaaacgccatgcgaaagaacttttaaaacaagcggatcaagtcaaaacaactgggtaagctgcgcgagaagcgcagcttatttttttcgtgcacatccattcgttcatcagtatatccaatgtttttcttcatatgacagttataaataagccgtcagaaggcaaaattaaatgatgtagcagcaagtcataaagaaggtgtgggataggagcgaggagagtgaagtagtgaatgcccgataacatcagaaaagcagtaggtttaattctccttgtttcgttattaagtgtaggtttatgcaaaccgctaaaagaatatttactgattccaacgcaaatgagagtatttgaaacccaaacacaagcgattgaaacgagtttatcggtaaacgctcagacatcagaatcctcagaagcgtttacagtaaagaaagatccgcatgaaatcaaggtgacgggcaaaaaatcaggtgagtcagaattggtatatgatcttgccggatttccaattaaaaaacaaaagtgcatgttcttcctgatttaaaagttatacctggcggacaatcaatcggtgtaaaacttcattccgtcggtgttcttgtcgtcggatttcatcaaatcaatacaagtgaaggcaaaaaatctccgggagaaacggcaggaattgaagcgggcgacatcattattgagatgaatggacagaaaattgaaaaaatgaatgatgtagccccatttattcaaaaggctgggaaaactggtgaatctttagacttactgatcaaacgtgataaacagaaaatcaaaacgaagctgatcccagaaaaggatgaaggagaaggcaaatacagaatcgggttatatatcagagattctgctgctggcatcggcactatgaccttttatgaaccgaaaacaaaaaatacggagcacttggccacgtgatttccgatatggacacaaagaaaccaattgtagtggagaatggagaaatcgttaaatccactgtaacatcaattgaaaaagggacaggcggtaatccgggagaaaaactggcgcgattttcctcagaacgcaaaacgatcggggatattaacagaaacagcccgtttgggattttcggcacactgcatcagccgattcaaaacaacatatcagatcaagcattgccggttgcgttttctaccgaagtcaaaaaagggccggctgaaattttaacggttattgatgatgacaaagtagaaaaattcgatattgaaatcgtcagcacaacgccgcaaaaattccctgcgacaaaaggaatggtgttgaaaattaccgatccaagactgttgaaagaaacaggaggcatcgtacaggggatgagcggaagcccgatcattcaaaatggaaaagtgatcggtgctgtcacccatgtatttgtaaatgacccgacaagcggctacggtgttcatattgaatggatgctgtcagaagcaggaatcgatatttatggaaaagaaaaagcaagctgactgccggagtttccggcagtttttttattttgatccctcttcacttctcagaatacatacggtaaaatatacaaaagaagatttttcgacaaattcacgtttccttgtttgtcaaatttcatttttagtcgaaaaacagagaaaaacatagaataacaaagatatgccactaatattggtgattatgatttttttagagggtatatagcggttttgtcgaatgtaaacatgtagcaagggtgaatcctgttaactacatttggggaggaagaaacgtggagaaaattaaagtttgtgttgctgatgataatcgagagctggtaagcctgttaagtgaatatatagaaggacaggaagacatggaagtgatcggcgttgcttataacggacaggaatgcctgtcgctgtttaaagaaaaagatcccgatgtgctcgtattagatattattatgccgcatctagacggacttgcggttttagagaggctgagggaatcagatctgaaaaaacagccgaatgtcattatgctgacagcctttgggcaggaagatgtcacgaaaaaggccgtcgatttaggcgcgtcctactttattctcaaaccgtttgatatggaaaaccttgtcggccatatccgccaggtcagcggaaatgccagcagtgtgacgcatcgtgcgccatcatcgcaaagcagtattatacgcagcagccagcctgaaccaaagaagaaaaatctcgacgcgagcatcacaagcattatccatgaaatcggcgtcccagcccatattaaaggctatctctatctgcgcgaagcaatctcaatggtatacaatgacatcgaattgctcggcagcattacaaaagtcctctatccggacatcgccaaaaaatttaacacaaccgcaagccgtgtagaaagagcgatccgccatgcaattgaagtggcatggagcagaggaaacattgattccatttcctcgttgtttggttatactgtcagcatgacaaaagctaaacctaccaacagtgaattcattgcaatggttgcggataagctgaggttagagcataaggcttcttaaacatgagcttattaagtggtcattaaatcaaacgtcttttatttattagtttgcgctgataaataggaggcgttttgttttggggacatttgtagtatgggagaagaatattaagtatccgcatatagtaaaggataggtttgaaaagtaaggaaagcaaatggcggtattacctgcactcttggtccattcatacatcttataggatcacgaagcatgatcgaccctagatgtgtccgttataaaatgaaacctttctcctgcaaaatcgtaagtaaggcgtattcatgtaaaaaggagacgtacgaatgaaaaagaaaaaagcaagaaagcgtgaggggtttttcctggattttcttttcgaagttggtggggagctctttcttttgctgtttagatgtgtacacaaactatttatataaagggaaaaaagactgccgaatcgtttcggcagtctttgcacattaatctttataaggcacccagccttgtgtgttcacaattgcttgccatagcggttcaggcaaatgatatttttctttatctgtgcctttgatcactgtttcgatttgcttttcacggccttcttttacttttaccgtccagttagggtcaactagaatttcgcgtcccatagcgaccagtggaataccgttttcgatgacggcaagcgcgtcatcagcggaatggatggaaccgacggcgatcagcggcactttgtttccgacacgttcattcaataagtccatgcgtgtgcgagtcggatctgcaccgcggcgcgcttttgagttcacgtccatcagtgagatatgaagataatccaattctttatcccctaaagcatcaacaagcgtataagtttcagtcattgtcaatcccggtgtctcaggttcttccggagacaggcggtagccgactaagaatgcacccttcgcatgttctgaagcggcttttttcacttcatcgacaatagcgagcgggaaggctaatcgtttttcatcgcttcctccccagcgatccgtgcgctggttggttttcggagaataaaactgctgaattaagtagccgtttgcaccgtgaatttcgacaccgtcaaagccggcttcaatggcgcgtcttgtcgcttctccaaacgccttcacaatgttttccacttcttcttctgttaatgcgcgagcaatttgtttgccgttatcaaacacgtcacttggccccacaacatcctgttgaggaacgagctcagacgggcactcaataccgccgtgatgaatttgtacaacagctttagcgccttgtgcctgaatggcttgtgctaacttttttaaacctggaatgttggaatcgtcatggatggccggctgcccggggaatgcttttccgtccggtgtaacatttgcgcaggctgtaatcaccattcccatctcttttgaacgggggatgatgtagtcgagctccgcttcagatattgtaccgtcttcattagaagcgtaatgagtcatcggtgctactgcgatccggttgttgattgtaacgccgcttttaaacgtaaatggttcaaaaagtggcttatacttaggattcatttgatcatcttctttcgtttggattcgcacatattctagcctatatgtaaaaattaatgcaattgatctgctttaccgactgaatatcttgagtgcagagtgatgttttggccgctctttttcggggcctttgtagccgccactgatttggtggccgatggagcatgtgatgacagctgccgccagcagcagaacgaattttttcatggctttaacttctttcaataaagtaaatatcctttaaaaggttacgcttggctgacccacccgtcaaacgatttgctcaccctattctcaaattttttaaaatgaataaaaagttgcttctttccgctaattttttctaattggcgcctcaattagagccatcctcatagacaaatctgctcgttatctttctaacaacaggaaatgatcgggtcgtatagcccttttgaaaatcatggaacttgctcgcctgcattcgcgttgtctttacaaattctccattctggtcaaagataaaagccaaacatcaggaagaggtggtcatgtgaaacaaacggttcttttgctgtttactgcgctctttctttcggggtgcagtgttgcaagtgcggatgactcagtgccgaggtttaccgaagagggaaaatacattggctcggctgatcctcatacgattgcggtttctcttaatggagaagaaaccatgatacaagttccgaaggataaacgtgatgaatgtgaatcactgccagatcagacacatgtcctggtgaaatatacaaagaaggataatggaactttacagctggaagatattcagctgcgaaagaactcgtgaccggagggagtaagttgagaatgttatggaggagcttggcgctgtgcggattggctttgacgctcgcgccttgtgcacaggcagcagagccgatagaagggaaaacagtgtatattgatgccggacacggcggtgaagacagtggagcggtcggaaacgggctctttgaaaaggatattaatttggctgtctcagagcatgtgacagacaaactaaaagaggagggagccaatcctgttgcatcccggtctgacgatcattttctgaccttggaggaaagagtggctaaggcaagtgccaatcaggctgacctttttgtcagcattcatgtgaattcaggggttgcttcagcttcaggaacagaaacgtattttcaatctgattatgaaggggagaacagccggcgtctggcatccgatattcagtcacagctcgtttcttccttacaaacgagagacaggggcgtgaaagaatcagacttttacgtcattacatattcacaaatgccaagtgtgttggcggagcttgggtttatcacgaacagctctgacgcggacaagctgggaagtgaagaataccagcaaaaggccgcagatgcgattgtcaatggcattgattcttattatgatcagtagattgatacagccttaatcctagagtggagccgacaaaataagtataatggagaaaactttagggtttgaggtgaaacgatgacaaagatttttgcccaccggggggcatcaggtcaatttcccgaaaatacaatgcttgcatttgaaaaaggaattgaagccggagcggatgggatagagcttgatgtacagctgacgaaagacggacgcattgttgtaattcatgatgaaagacttaatcgcacgacatcacttaaaggattcgtgaaggatacagcctatgatgaggtaaagactgcgaatgcggccgctggtcacgatcaagcgtacagcgatataaaagtgccgctgctagaagatgtgctctcgtgggcggtaaaaaaggattttctcatcaacattgaattaaaaaacagcgtgatccgctatgagggaatggaagaaaaagtgctggaggcagtgaagcgatttaatgtagaggacagagtcatcctatccacgtttaatcatgacagcttggcgctgtgcgcccggcttgcaccgcatatcgaacgggcagtattaacttcagatgtgctttatcaggcagatcgatatatcgcgtctattccggcttccggctatcacccgaagataaacagcccaggggtcacagatgaagtactgaagaaaatgaggaacggtttgattaaggtaaggccgtatacagtcaatcgtccggaagatatgaagcgtctcattgaagcgggagcagacggcatgtttaccgactttccagaaaaggcttcggcattgctgaaaaatgaatagttgttagaaggaggctgtttgacgcagccttcttttttcattcattcatgcccgtttcaaagcatacattcatagaagacaactagaaattgtaagcgctgtctatcttctgaatgaggtgaaaccatgaggaaaacagtcattgtaagtgctgcaagaactccatttggcaaattcggcggagttttgaaagaggtgaaagctgctgagcttgggggcattgtgatgaaggaggcgctgcaacaggctggagtctctggagatgatgtagaaggaaacgtcatgggcatggttgtccaggccggctcagggcagataccttcccgtcaagctgcccgtctggcgggaatgccttggagtgtgccgtcagaaacactgaataaagtctgtgcttccggccttcgcgctgtcactttatgtgatcaaatgattcgggcgcaggatgcggacatacttgttgcgggggggatggaaagcatgagcaatattccgtatgccgttcccgccgggcgctggggagcacggatgggggacggcgagcttagggacttaatggtgtatgacggattaacgtgcgcatttgacgaggtgcacatggctgttcacggaaatacagctgccaaggaatatgcaatctcacgaagagagcaggacgaatgggcgttgagaagtcatgcaagggcagctaaggccgccgatgaagggaagtttcaggatgaaattgttcccgtcaactggatcggtcgaaaaggaaaaccaaacgttgttgataaagatgaagcgattcgccgtgacacaagtctggatcagctcgcaaaacttgctccgatttatgcaagtgacggttctatcacagccggcaatgctcctggagtcaatgacggagccggcgcgttcgtgctgatgtctgaggaaaaagctgctgagcttggcaaacggcctctggctacaattcttggtttttcaactacgggaatgccagcgcacgagctggcggcagcgccagggtttgctattaacaagctcctgaaaaagaatggtttaactgtccaagatattgacttgtttgaagtaaatgaagcttttgcttcagttgttttgacatgtgaaaaaatcgtaggtttcgatcttgaaaaagtaaatgtgaatggcggtgcgatcgcgctcggccacccgatcggcgcgagcggtgcgagaattctcatgacgcttgtttatgaattaaagcgacggggagggggtctgggcgttgccgctatttgcagcggggcagcacagggagacgccgtcttagtgcaggttcattaaaacatgatgaaaaaggggatttgaatggaaatcaaacaaatcatggtagctggcgcaggtcagatggggagcggaattgctcaaacagccgccgacgcgggcttttatgtgcggatgtatgatgtgaatccagaggccgcggaggcaggattgaaacggctgaagaaacagctggcccgtgatgctgagaaaggaaaaaggaccgagacggaagtgaagagcgtaatcaaccgcatttcgatttctcaaacacttgaggaggcagagcatgcggacattgtgattgaggctatcgcagaaaacatggcggcaaaaactgagatgtttaaaacacttgatcgcatttgcccgcctcatacgattttggccagcaatacatcttccttgcctattacagaaatcgctgctgtaacaaaccggcctcaacgggttattggcatgcattttatgaatcccgtccctgtaatgaagctggtagaagtgattcgaggcttggctacatcagaagaaacggccttagatgttatggcattagcggaaaagatggggaaaacagcggtagaagtcaatgattttcctgggtttgtttccaaccgtgtgcttcttccaatgattaatgaagccatctattgcgtgtatgagggagtggcgaagccggaggcaatagatgaagtgatgaagctgggcatgaatcatccgatgggtccgcttgcattagcggattttatcggactggatacgtgtttatcaattatggaagtccttcactcaggccttggcgattccaaataccgtccttgcccgctgctccgcaagtatgtcaaagcaggctggcttggcaaaaagagcggacgcggtttttatgactatgaggagaagacttcctgaagtctattccatccgggggtggccgagttgcatgtaacccaagagcaagtcatgatgcgaaaaatggtgcgtgattttgcacgaaaagaaattgctcccgctgcggaaatcatggagaaaacggacgaatttccctttcagctgatcaaaaaaatgggtaaacacggactgatgggaataccggtgccggaacaatacggcggtgctggagcggacgttgtttcttatattttggcaattcatgagatttctagaatcagcgcggctgtcggcgtgattctctccgttcatacctcagtcggcacgaatccgattctgtatttcggcaacgaagaacagaagatgaaatatataccaaatctcgcgtcaggagaccatttgggcgcatttgcactaacggagcctcactcggggtcggatgccgggagcctccgcacaacagcaatcaaaaagaacggcaaatacctattaaacggatcgaaaatattcataacgaatggcggagcagctgatatctatatcacatttgctttaacagctccagatcaaggcaggcacgggatttcggcttttattgttgaaaaaaacacacccggttttaccgttggaaaaaaagaaagaaagctggggctttatggctccaatactacggaactgatttttgataatgcagaagtgcctgaagccaatttgcttggcaaagagggggatggctttcacattgccatggcgaatttaaatgtcggccggatcggcattgcggcacaggccctcggaattgcagaggcggctcttgagcatgccgttgattatgcgaagcagcgagtgcaatttggaaggccgattgcagccaatcaaggcatatcatttaagctggctgatatggcgactagagctgaggcggcaagacatcttgtctaccacgctgcagaccttcataaccgcggcctaaactgtggaaaagaagcgtctatggctaaacaatttgcttccgatgcagccgtaaaggcggcgttagacgccgttcaaatttatgggggatatggctatatgaaggattatccagttgagcgcctgcttcgcgatgcaaaggtgacgcaaatttatgaagggacgaacgagattcaaagactgattatttccaagtatttgcttggcggaacctgatagacaaaaaacgcaaaaacggaggttgaggatatggaggagaaacagcattattctccagggttggacggtgtgattgcggcagaaactcatatttcttatcttgacacgcagtccagccagattttgataagaggctatgatttaatagaactttctgaaacaaaaagctatctggagcttgtccatttattgctggagggcaggctgccagaagaaagtgaaatggaaacgctggaacgtaaaataaacagtgcctcaagcctgcctgctgatcatctccgtctgcttgagctgctccctgaggacactcatccaatggatggtctgcgtaccggcctgtcggcacttgctggctatgatcggcaaattgatgatcggtctccttccgcaaacaaagaacgcgcctatcagcttcttgggaaaatgcctgccctcactgctgccagctacaggatcattaataagaaagaaccgattcttccgcttcaaaccctatcctacagtgcgaattttctctacatgatgacagggaaattgccgtcttcattggaagaacagatttttgaccggtcgctcgtcctgtacagtgagcatgagatgccgaattcaacctttgcggccagggtcattgcatctacacattcagatctttatggggctttgactggggctgtcgcttccctgaaagggaatcttcacggaggagcaaacgaagctgtgatgtatttgcttttggaggcaaaaacgacatctgattttgagcagcttttgcaaacaaaactgaaaagaaaagaaaaaatcatgggcttcggccaccgggtgtatatgaaaaaaatggacccgagagcactcatgatgaaagaggcgctgcagcaattatgcgataaagccggtgaccatcgtttatatgagatgtgcgaagcgggtgagcggctgatggagaaggaaaaagggctttacccgaatttggattactatgctgccccagtgtattggatgctcggcataccgattcctttatatacgccgatctttttcagcgcgagaacgtccggtttatgcgcccatgtgatcgaacagcatgccaataatcggctcttccgtccccgtgtcagttacatgggcccgcgatatcaaacaaaatcatgaaaggagctggtagaatgccgaaaacggatcgtgttatcgaagaaatcacagactatgtgcttgagaaagagattactagtgccgaagcgtatacaacagcggggcatgtattgctggataccctgggctgcggaatcttggcgctacggtatccggaatgcacaaagctgcttggcccgattgttccaggaacgactgtgccgaatggaagcaaagtgccgggaacgtcatatgttctcgatcctgtgagggcagcgtttaatattggctgcatgattcgctggctcgattacaacgatacgtggctggcggcggagtgggggcatccatccgataacttgggaggaatccttgccgctgctgattatgtatcaagagtgaggctgtctgaaggaaaagagccgttaacggtacgcgacgtacttgagatgatgatcaaagcacacgagatccaaggtgtgctggcgttagaaaacagcttaaatcgagttggccttgaccatgtgctgtttgtcaaagttgcgacaactgctgttgcagcaaagcttttgggcggcggaagagaagaaatcaaaaatgcgctttcgaatgcatggattgacaatgcagcattgaggacataccgccattcaccgaatacaggctcgcgtaaatcatgggcggcaggagatgcaacgagcagaggtgttcatttggcgctgatgtcgttaaaaggggaaatgggttatccgacagccttgagtgcaccgggttgggggttccaagacgttttattcaataagaaagagatcaagcttgcccgtccgctcgacgcttatgtcatggaaaatgtgttatttaaagtgtcttatcctgcggaatttcacgcccagacagcggcggagtccgccgtcattcttcacccgcaggtaaagaaccggattgacgagattgaccgagttgtcatcagaacgcatgaatcagctatccgaatcattgataaaaaaggcccgctccacaatccggcagaccgtgatcactgcctccaatacattacagcaatcggtttgctttttggtgatatcaccgcacagcattatgaagctgaaacagcgaatgatccgagaatagataaacttcgtgataaaatggaagtgactgaaaataaaacatataccgaggattatttgaagcctgataaacgctccatctcaaatgccgttcaggttcattttaaagatggaacgagcacggaaatggtggaatgtgagtttcccctcggccatcgttttcgaagagaggaagcagtgccgaaactgctggaaaagttttctgacaatctcaaaacccattttcctgataaacagcacaaacacatttatgagcgctgtaccagctatgagacattacaaacgatgcgcgtaaatgaattcgtagacatgttctgcatgtaaaagggggattttgtttcatgtcgtggatcgtcaataagcaatcgtcacaagaggagcttgccgggcgtttccgcaagctgatgtcagcaccggacattcttcaaattcccggcgcccatgacgggatggccgctttgcttgcgaaagaagccggtttttctgctatttatttgtccggtgctgcctatacagccagcagggggctgcctgatttagggatcatcacatcggcagagatagctgaacgggccaaagatcttgtgcgtgcagctgatctgcctttgcttgtggatatcgatacgggatttggcggtgtcttaaatgccgcccgaacagcccgggagatgcttgaagccagggtagcagccgttcaaatggaagaccagcagctcccaaaaaaatgcggacatttaaatggcaaacagctagttccgataaaggaaatggcgcaaaaaataaaagccattaaacaagcggcaccctcccttattgttgttgcccgtactgatgccagggcgcaggaagggcttgatgccgcaataaaacgttcagaggcttacattgaggcgggagcggacgcaattttcccggaagcgctacaggcggagaatgaattccgccagtttgctgagcgtatccccgttccgctccttgcgaatatgactgaatttgggaaaacgccatattatcgtgccgatgaattcgaagatatggggtttcacatggtgatatatcctgtcacctcgcttcgagcggcggcaaaagcttgtgagcggatgtttggtttgatgaaggagcacggctcacaaaaagaaggacttcatgatatgcagacacgaaaagaactgtacgatacgatttcttattatgactatgaagcgttagacaaaacgattgccaagaccgttttgcctgacgaataatgcaacaaaaaaagccggagcattctccggctttttttcagctatcgttttctgaatcgcgggctgacttgattgcgttttctgtctctgtataaaatgaacccggccagcacatagaggccgatcgcaaaaaagatgaatcctgacaacccttggagccaaagagctgaaaatggcttgattgtatggccgaaaagtgtatctctcatcagtttaatgcctaaagcagaaatagccccggggatgactaatattaaaagcgcaagaagtcggctcatcttcagaaaacccctttatcttttcatttcctttattgtccagcggaaaaaatattttgtcaagagaagaaaacgtggtaacatagggttgtgcaaattattgcaacggaataaataggtgtgcaaattttttcatacaaaggggtatcgggatgcaaaaggtactgatagtaggtgccggcaaaaggggaacggcgttattacatattctgattaaaacagccatcatagatatcattgccgtagttgacaaagaccccgaggcgccgggattgaaagaagcagaacagtatgggattgccgtatcatctgattggaaaccttacatacaacaaaaaccggatatcgtcattcatactaccggcgatcaagccgtgtttgacgagctccttcaaagaaagcatgaagataccattgtcatgccgggaaaaatggcatacatcgtttttcagctgatggaagaaaagcagcacctgattcaaatgctaaaagagcaaacctataaatatgacagaatttttaattccacccatgatggaatgatttttattgatatcaatgaagaaatcattctctttaaccatatggccgaaaaaatggtcggaaaaaaacgtgaggaagtcattgggcgcccaataaaagaagtgattccgagcactaagatgccgcggattttaaaaacaagagtgcctgaatacaaccagaagcagctgttaggcgatcatttgcaaattgtgaccacaagactgccgattattgatgaaggcggacgtctgctcggggctctttgtgtgtttaaagatatcactgatgcggtcgagctggcagaggaagtgaccaacttaaagcaggtccgtacgatgctggaggcaattattcaatcctccgatgaggcgatttctgtcgttgatgaaaacggcatcggcctgctaatcaataaagcgtatacgaaaatgacggggctttctgaaaaagaagtcatcggcaagcctgcaaacactgatatttccgaaggcgaaagcatgcatttaaaggtgcttgaaacaagacgtcctgtccgcggtgtcagaatgaaggtcggcccgaatgaaaaagaagtgatcgttaatgtagcaccggtgattgtggacgggattttgaaaggcagcgtcggcgtgattcacgatgtttccgaaattaaaatgctgacagcggagcttaatcgcgccagacaaattattcgcacgcttgaagcgaaatacacgtttgacgacattatcggcaaaagcgagcaaatgctggttgcgcttgagcaggcgaagctcggtgcgaaaacaccggcaaccatcttgctgcgcggggaatcaggaacaggaaaagaactgttcgcccatgccatccataacgaaagtgaccggaaatacaataaatttattcgcgtgaattgtgcagccctttctgaaaacctgctcgaatcagaattgttcggctatgaggatggtgcgttttcaggagcgaagcgcggcggtaaaaagggtttatttgaggaagcaaataacggcagtattttcttagatgaaatcggtgagctgacacaaaatatgcaggccaaattgctacgcgtccttcaagaaaaggaaatcgtcagagtgggcggcacgaaagcgatccctgtcaacgtcagagtgatcgcggcgacaaatgtaaatattgaaaaggcgatggcggacggaacattccgggaagacctgtattaccggatcaatcgctatccgatctccatcccgcctttgcggcagcggttggaggacattgaagcattgagcgtcagacttatccaaaagatcaaccgggattacggcaggaatgtaaaagggctctcacagcaagccttgcgcgccttatctgcctaccattggcctgggaatgtccgggagcttgaaaatgtccttggacgagccatgatttttctgaatccgcatatggaatggattgaaaaagatcacttgcctgtattcgaacttgagcaaaaagaaaatgacacagatcagggaacaggttttgattttccggatattgaaggcgaaaagctgtctgtcgcagtagaaaaatttgaagcgcatttgatccagcaaacgcttgaaaagcatcattttaaccggacaaaaacagcaaaagctctcggtgtcagcattcggaatttatattacaaaatggataaatatggccttgcaaatgaaggcatgcaataatttgcagaataaacgcaaacatctgcacgaatgtttcggtatacctggtatgacagcacccttaagagctggcatggaacttgcataataaaaggcggagtcgaaacaagaaaggtggtaacagatgaagctgaaagatttaatcggcaaagcgtcgatacacaaaaataagaccattgcggttgctcatgctgaggatgaggaagtgatccgggctgtaaagctggcagccgagcacctatccgcccgtttcttgttaacgggcgacagcaaaaaactgaacgagctgacatcatccatgcaagggcatcaagtggaaatcgtccatgccaatactcctgaggaatcggcgaaattagcggttcgtgctgtgcatcataaaacagcggacgttttaatgaaaggcaatgtgccgacttctgttttgcttaaagcggtattgaacagacaggaggggcttcggtcagcaagtgtcctttctcacgtggctgtcttcgatataccggattttgaccggctgatgtttgtgacagattcggcaatgaatattgctccttcgctggaagagctccggcagattttgcaaaatgccgttcatgtggcccatgcagtggggaacaatatgccaaaagcagctgcccttgcagcggtcgaaacggtgaaccctaaaatggaagcgaccgtgaatgcagctgctctagctcaaatgtacaaaaggggccagatcaaaggctgcattgttgatggaccgcttgctttggataacgcagtttcacaaattgccgcggcccagaaaaaaatttcgggagacgtagcgggcaacgcagatatccttctcgtcccaacaattgaggccggcaatattttatataaatcactgatttattttgccaaggccagcgtggcggctgtcattacaggagcaaaagcaccgattgctttaacaagcagagcggactctgctgaaaataaactgtattccattgcgctggcaatatgcgcatctgaagaatacacacattaggaggaacgaacatggaactttttaaatatatggagaaatacgattacgaacaattggtattctgccaggatgaacaatctggattaaaagcgattatcgccattcatgatacaacgcttggtccggcgcttggcggaacgagaatgtggacatatgaaaatgaagaagcggcaattgaagatgcgctcagattggcaagaggcatgacctataagaacgcggcggcaggcttaaaccttggcggcggaaaaacagtcattatcggcgatccgcgcaaagacaaaaatgaggaaatgttccgcgcgtttggccgctatattcaaggactgaatggcagatacatcacggctgaagatgtgggcacaacggtcgaggatatggatatcattcatgatgagacagactatgtcacagggatttctcctgctttcggctcttctggaaatccgtccccagtcacagcgtacggggtgtacagaggaatgaaggcagcagctaaagctgctttcggaaccgactctcttgaaggaaaaaccattgctgtacagggtgttgggaacgtagcctataacctttgccgccacctgcatgaagaaggagcaaacttaatcgttacggatatcaacaaacaatctgtacagcgtgcagttgaagattttggcgcccgtgcggtagatcctgatgacatttattcacaagactgcgatatttatgcgccgtgtgcccttggtgcgactattaacgacgacaccattaaacagctgaaggcgaaagtgatcgcaggtgcggctaacaaccaattaaaagagacacgccatggtgatcaaattcacgaaatgggcatcgtttatgcaccggattacgtgattaacgcgggcggtgtcatcaacgtggcagatgagctttacggctataatgcagaacgtgcattgaaaaaagttgaaggcatttacggcaatatcgagcgtgtacttgagatttctcagcgtgacggcattcctgcatatttagcggctgaccgcttagcagaggaacggattgaacgcatgcgccgctcaagaagccagtttttgcaaaacggccacagtgtattaagcagacgttaagaaattgatctggaggttatgaaagtgctacatgacgaaaaacgcattctcacaattaatccaggctcaacttcaacgaaaatcggtgtttttcataacgaaagaagcatttttgaaaaaacattgagacacaacatagaagagctgcagcgatttgaccgaattattgatcagtatgaatttcgtaaaaaccatattctcgaaacgcttcatgaacagggaatcaatatttcaaagtttgatgcagtctgcgcaagaggcggccttctccggccaattgaaggcgggacctacgtagtgaatgatgagatgattgaggatttgaaaagcggctacgccggtcagcatgcttctaatctcggcggcattatcgcgcgggaaatcgctgacggcctgaatatcccttcgtatatcgtcgaccctgttgtcgtagacgaaatgtcagtgcttgcgaaagtttcaggcatgcctgaaattgaaaggaaaagcattttccatgcgttaaaccaaaaagctgtcgctcgtaaagcggcagcctcccttggcaaacgatatgagaacatgaaaatgattattacccatatgggcggaggtattacaattggcgtccatgaccgcgggcgagtggtggatgtcaataacggcctgcacggcgagggaccattcagtcctgaacgagcaggaacagtgcctgcgggagatcttgttgatctatgtttttcaggggaatatacaaaagaagaaatcatgaaaaagcttgttggcaccggcggacttttaggctatctcggtacaaatgatgcagtaaaagtggaacagatgattcaagggggcgatgaaaaagcccgcttcatttatgatgccatggcatatcaggtagcaaaggaaatcggggcagccagcgcggcgttaaaaggcgaagttgaagcgattgtgctgacgggaggccttgcgtacggaaaaagctttgtttctgctatcagatcatacatagattggatttcagacgttttagtttatccgggtgaaaatgaactgcagtctcttgcccaaggggcgctaagagtattgcagggcgaagagcaatccaaacaatatcgtattgaatagacagacaggagtgagtcaccatggcaactgagtatgacgtagtcattctgggcggcggtaccggcggttatgttgcggccatcagagccgctcagctcggcttaaaaacagccgttgtggaaaaggaaaaactcgggggaacatgtctgcataaaggctgtatcccgagtaaagcgctgcttagaagcgcagaggtataccggacagctcgtgaagccgatcaattcggagtggaaacggctggcgtgtccctcaactttgaaaaagtgcagcagcgtaagcaagccgttgttgataagcttgcagcgggtgtaaatcatttaatgaaaaaaggaaaaattgacgtgtacaccggatatggacgtatccttggaccgtcaatcttctctccgctgccgggaacaatttctgttgagcggggaaatggcgaagaaaatgacatgctgatcccgaaacaagtgatcattgcaacaggatcaagaccgagaatgcttccgggtcttgaagtggacggtaagtctgtactgacttcagatgaggcgctccaaatggaggagctgccacagtcaatcatcattgtcggcggaggggttatcggtatcgaatgggcgtctatgcttcatgattttggcgttaaggtaacggttattgaatacgcggatcgcatattgccgactgaagatctagagatttcaaaagaaatggaaagtcttcttaagaaaaaaggcatccagttcataacaggggcaaaagtgctgcctgacacaatgacaaaaacatcagacgatatcagcatacaagcggaaaaagacggagaaaccgttacctattctgctgagaaaatgcttgtttccatcggcagacaggcaaatatcgaaggcatcggcctagagaacaccgatattgttactgaaaatggcatgatttcagtcaatgaaagctgccaaacgaaggaatctcatatttatgcaatcggagacgtaatcggtggcctgcagttagctcacgttgcttcacatgagggaattattgctgttgagcattttgcaggtctcaatccgcatccgcttgatccgacgcttgtgccgaagtgcatttactcaagccctgaagctgccagtgtcggcttaaccgaagacgaagcaaaggcgaacgggcataatgtcaaaatcggcaagttcccatttatggcgattggaaaagcgcttgtatacggtgaaagcgacggttttgtcaaaatcgtggttgaccgagatacagatgatattctcggcgttcatatgattggcccgcatgtcaccgacatgatttctgaagcgggtcttgccaaagtgctggacgcaacaccgtgggaggtcgggcaaacgattcacccgcatccaacgctttctgaagcaattggagaagctgcgcttgccgcagatggcaaagccattcatttttaaaagcataaaggaggggcttgaatgagtacaaaccgacatcaagcactagggctgactgatcaggaagccgttgatatgtatagaaccatgctgttagcaagaaaaatcgatgaaagaatgtggctgttaaaccgttctggcaaaattccatttgtaatctcttgtcaaggacaggaagcagcacaggtaggagcggctttcgcacttgaccgtgaaatggattatgtattgccgtactacagagacatgggtgtcgtgctcgcgtttggcatgacagcaaaggacttaatgatgtccgggtttgcaaaagcagcagatccgaactcaggaggccgccagatgccgggacatttcggacaaaagaaaaaccgcattgtgacgggatcatctccggttacaacgcaagtgccgcacgcagtcggtattgcgcttgcgggacgtatggagaaaaaggatatcgcagcctttgttacattcggggaagggtcttcaaaccaaggcgatttccatgaaggggcaaactttgccgctgtccataagctgccggttattttcatgtgtgaaaacaacaaatacgcaatctcagtgccttacgataagcaagtcgcatgtgagaacatttccgaccgtgccataggctatgggatgcctggcgtaactgtgaatggaaatgatccgctggaagtttatcaagcggttaaagaagcacgcgaaagggcacgcagaggagaaggcccgacattaattgaaacgatttcttaccgccttacaccacattccagtgatgacgatgacagcagctacagaggccgtgaagaagtagaggaagcgaaaaaaagtgatcccctgcttacttatcaagcttacttaaaggaaacaggcctgctgtccgatgagatagaacaaaccatgctggatgaaattatggcaatcgtaaatgaagcgacggatgaagcggagaacgccccatatgcagctcctgagtcagcgcttgattatgtttatgcgaagtagggaggaagaacaaatgtcagtaatgtcatatattgatgcaatcaatttggcgatgaaagaagaaatggaacgagattctcgcgttttcgtccttggggaagatgtaggaagaaaaggcggtgtgtttaaagcgacagcgggactctatgaacaatttggggaagagcgcgttatggatacgccgcttgctgaatctgcaatcgcaggagtcggtatcggagcggcaatgtacggaatgagaccgattgctgaaatgcagtttgctgatttcattatgccggcagtcaaccaaattatttctgaagcggctaaaatccgctaccgcagcaacaatgactggagctgtccgattgtcgtcagagcgccatacggcggaggcgtgcacggagccctgtatcattctcaatcagtcgaagcaattttcgccaaccagcccggactgaaaattgtcatgccatcaacaccatatgacgcgaaagggctcttaaaagccgcagttcgtgacgaagaccccgtgctgttttttgagcacaagcgggcataccgtctgataaagggcgaggttccggctgatgattatgtcctgccaatcggcaaggcggacgtaaaaagggaaggcgacgacatcacagtgatcacatacggcctgtgtgtccacttcgccttacaagctgcagaacgtctcgaaaaagatggcatttcagcgcatgtggtggatttaagaacagtttacccgcttgataaagaagccatcatcgaagctgcgtccaaaactggaaaggttcttttggtcacagaagatacaaaagaaggcagcatcatgagcgaagtagccgcaattatatccgagcattgtctgttcgacttagacgcgccgatcaaacggcttgcaggtcctgatattccggctatgccttatgcgccgacaatggaaaaatactttatggtcaaccctgataaagtggaagcggcgatgagagaattagcggagttttaaagacgtaagggaggatacaatcatggcaattgaacaaatgacgatgccgcagcttggagaaagcgtaacagaggggacgatcagcaaatggcttgtcgcccccggtgataaagtgaacaaatacgatccgatcgcggaagtcatgacagataaggtaaatgcagaggttccgtcttcttttactggtacgataacagagcttgtgggagaagaaggccaaaccctgcaagtcggagaaatgatttgcaaaattgaaacagaaggcgcgaatccggctgaacaaaaacaagaacagccagcagcatcagaagccgctgagaaccctgttgcaaaaagtgctggagcagccgatcagcccaataaaaagcgctactcgccagctgttctccgtttggccggagagcacggcattgacctcgatcaagtgacaggaactggtgccggcgggcgcatcacacgaaaagatattcagcgcttaattgaaacaggcggcgtgcaagaacagaatcctgaggagctgaaaacagcagctcctgcaccgaagtctgcatcaaaacctgagccaaaagaagagacgtcatatcctgcgtctgcagccggtgataaagaaatccctgtcacaggtgtaagaaaagcaattgcttccaatatgaagcgaagcaaaacagaaattccgcatgcttggacgatgatggaagtcgacgtcacaaatatggttgcatatcgcaacagtataaaagattcttttaagaagacagaaggctttaatttaacgttcttcgccttttttgtaaaagcggtcgctcaggcgttaaaagaattcccgcaaatgaatagcatgtgggcgggggacaaaattattcagaaaaaggatatcaatatttcaattgcagttgccacagaggattctttatttgttccggtgattaaaaacgctgatgaaaaaacaattaaaggcattgcgaaagacattaccggcctagctaaaaaagtaagagacggaaaactcactgcagatgacatgcagggaggcacgtttaccgtcaacaacacaggttcgttcgggtctgttcagtcgatgggcattatcaactaccctcaggctgcgattcttcaagtagaatccatcgtcaaacgcccggttgtcatggacaatggcatgattgctgtcagagacatggttaatctgtgcctgtcattagatcacagagtgcttgacggtctcgtgtgcggacgattcctcggacgagtgaaacaaattttagaatcgattgacgagaagacatctgtttactaaataagcaaaaagagcattttttgaagttttgtttcaaaaaatgctctttttctatgctttattattcagcgatccgtattttcatttcgactcgatattcttcttgttttttcggggagtaatgaatcggtatgattaactcgtatacatcactgacaactgttaattggcggtccgcgatatatttgataagcttctgtaagttgagaaaataatgttcaggcgaaaaattatacgcgatacacgcatacctccctttagggatcgttgtgatttccatatccggcgtaattgatgaaatctgtttattcgtcaatacaggtgtgaaaatatgacggtaagtcatttcatcaatgctggtgtagggctgaaaagagaaagtagcgccgtagctattgttcgtaaatccatctgctgactcgataaatttttttaatttgctgtaggaggcgttgagcacgttttcaggcccgattccttctgcctctgtctgaatgatccgtatttcttcttcatctaaaacaaacacctcaccgagcgcgggatattccatctgccgtttcatccgctttttcaccaatgaaatggtttgctccagggctgataaaaagtctaatttctccctgatttgcctctcctgctctgtataaaaagcaaacagttcttccatctctaagtcctgtgcttttttcatctcttctaaaggtgtgccgatatatttcaatgatttgatcaaatccagatgaatgagctgagaatctgtataatagcggtagctggtatccgggtcgacgtaggctggtttaaataaatcaattttatcgtaataacggagcgcttttatcgacacgtttgccagttttgatacttccccaattgagtaatacgattccttcatgccatcactccttctatcatcagtataaagaagaagcgcattctttgcagtacacaaagaatgcgcttcttatcacgtgctggctttaagatgtgcaggcgctttccaagcaatggtcagtgcaatccctatggctaaggtgaccgttgcaaagtagaaaggatagtttacatctatatcgaacagcattccgccgataataggcccgaatacattgccgatacttgtaaacattgaattcataccgccggcaaacccctgttcatttcccgcaatctttgacaggtaagtcgttaccgcaggccgcatgagatcaaatccgacaaatacggtgactgtcaccagcagaatcgcaacatatgaatgtaccgttgtcagcaagaataccagactcgtcgagagaattaagctgtaccgaattaaatgaatttcgccaaaccatcttgtgaagcggtcgaataagacgacttgcgtaatggcgccaacaatcgctcctcctgtaatcataatggcaatgtcgctggccgtaaatccgaatttatgatccacgaataatgcaaataaagattcaaatgatgctaaaccaaaagacgaaattaagataatgagaaaagctatgaaatacatgggggcaaaaattcgtttaaagcctgtcttctgtccttttatttcctgattttcagggtttcgttccggctcgcgcagcgtgaggattgataaaatggctgctaacagtgcaaaagctgccgcaaagaaaaaaggcagccgggaatggacttctgctaaaaatcccccgatgccggggccgataataaatcctgttgaaatagcggctgacatataaccgagcgcttttggccgtgttttaatggtcgtgatatctgcaataaaagccgtgaccccgggcataatgaaggctgcgctgataccgcccagcatacgggagataaataacatctcaactgtttttccaatgccgaacaaaaactccgacacactaaagaacaacaggccgattacgatcatgatcttgcgcccgaagcgatcaacccatcgtccggctattggtgagacaatgagctgtgtaatagcgaagcaggcaaccatatagccgaccgcggtccccgataaatgcaattcattcataatggtcggcgttactggaatcacaagcccgatccccaaaaaagcaataaataaattggttaataatatagttaaggtaatatttttcttctccatatgacttcccctttttcaagtgtgtatcccttatactgtaagacctcctcctaggggagagtcaacggatttgcaaaatctttctaaagccttatgacagttattcatttgcgggaacaagcatgtcgatatgctgtggcaggacctgaatgactgcgggtgtatgtgtataaacttctccatccatatccgcctttttggcagtgtctgtttcaatctcgatacgggaagcctggacataggacaactctccagtaaaacgatcaattgagccttgttccatgctcatcagctcccgcagcgcggtgaggttggtattgcggcatatgagaacatcaagtaagccgtcttcaatactggcatcgggcagaggaattcgattcgttccaatgtattggccattcatcacaagcagcataacggcttcttctttaatttcttctccatcaatttttaatgtcatcggaaacgatgcagcagatgagacggttcgcaaggcacttgtaaaatagctgatttttcccaataatgctttttccgtttcgttgatttgattcgacgtttctgcaattaagccgatcccccagaaattcaaaaaataacggtcattcatctgacatacgtctacgctggttttttttcccgccataagtgcttccgcggcctttgcaagattttgagggatgccaagcactcttgaaaagtcgttgcacgtgccgccgggcaaaattccgacagcgggttttctttctagagcgctgatagcatttatgcattgatggatcgtgccgtcgccgccgagaatgaagacggtgtcgacagaatcatcaatggatcggcaaaaatgatacgcatcatcctttttctttgtctgtttaataatcacctcatctaaatggtgagataaaaccggcaccacagcaccaagtgctttttctatatttttgttgccggcatttccgttatgaatcagtaacgctttccggtggctcatatacaactgctcctttattttacttctggttatataatcccctttttctgtaagcagtaaacgaagagcaaaaaaagtgcacggcgaagcaaagtcatttgccgatatggacgtttccttgctatcataagaacagatgatgaaaaaggagaggtcttcattgaacatggactttaatttatttatgaatgatattgtccgccaagcgagacaagaaataacagctgccggatacaccgagcttaaaacagccgaagaggtggatgaggcacttacgaaaaaaggaacgacgctcgtcatggtaaactctgtttgcggatgcgccggaggaattgcaagaccggcagcctaccattccgttcactatgataaaagacctgatcagctcgtcaccgtttttgccggacaggataaagaagcgacagcgcgtgcgcgtgactattttgaaggttatccaccatcttctccgtcctttgcgattttgaaagacggaaagatcatgaaaatggtagagcgtcatgaaattgaaggccatgagccgatggctgtagtggcaaagctgcaggaagcctttgaagaatattgtgaagaagtataagacgaacaacccggatgctcaaagcagcccgggtttttttgtgcataaatttccaaggatatatgaataaatattaagggattattcaatcggattgtacagcgatttaatttttatctagtaatatcagaagagatcactggaaagataagcctaaagataatttttaaaaatagtattgcataaaaatgagaaactgtttaaaatacaaattaacgaataaatattcaaatacaccaaaagtaatgaatacgggggaaatggatcatgaaaaaatggctcttattacttgtggctgcttgcatcacctttgcattaactgcgtgcggctcaagcaattcaggttcagaaagcggaaagaaaaaattaattatgggtacttcggcggattacaaaccgtttgaatataaagaaggagataatattgtcggctttgatgtagagctggcaaaagctctggcaaagaaggcaggctatgaaattgaagtgcaggatatggacttcaacagcttaattacagcgcttaaatcaaaacaggtggatctcgttctgtcaggaatgacaccaacgcctgagcgtaaaaaacaagttgatttttccgatgtgtattacacagcgaaccatatgattgtcagcaaaaaagacagcggcattcaatctttgaaagacctgaaaggaaaaacagttggcgttcagcttggctctattcaggaagagaaggggaaagagctttctccggaatatggttttaaaacagaagaccgcaacagaatttctgatttggtgcaggaaatcaaatctgaccgcttcgatgccgcgattattgaagacattgttgcagaagggtatttcaaatcaaatgatgacctgcaaggctttgtgattcctgatgcgaaagcggaagaagccggttcagcaattgctttcagaaaggacagtgaactgacagacaaattcaataaagcgctcaaggaaatggaagataacggagagcttgagaaattgaagaaaaaatggttcactggcgagaagtaaaaaaagcggctcaactttttcgttgagcctttttattgaataggaaacttttttcctgtaagaaaaggagacaaaggctatgaatttggatttttcagcaacgatcccccaaattccttttatattagaaggcttggcaattacattaaaaattgttgttgtatctgctattatcggacttatactcggtattgtgctaagcttatgcaagatcagcacattccgcccgtttatctggatcgctgatttttatacatcagtgttccgaggcacgcctttagtgctgcagcttatgattgtctattttggccttcctcagctgctcggatttcaaattgaccagttttgggctgcggttgtcgcattgtctttgaattccgccgcttatgtatcggaaattatcagagccggaatcaatgccattgataaagggcaaaaagaagctgctgttgcactcggtgtcccgtatggaaaaatgatgaaggatctgctgctgccgcaggccttcaaaaatatatcacctgcaattgtgaatgaattaattacgttaacaaaagaatcggcgatcgtcaccgtcatcgggcttggtgatgtcatgagacgcgcatatcaagctggcgccgccacttacaattaccttgagccgctcattatcgcgggattgatttattatgtgcttgtcctgattttaacgtttatcggcaaggctgtagaaaggaagctgaaatccaatgattaaggttgaaaagctgtcaaaatcatttgggaaacacgaagtattaaaaaacatttcaacaacaatcgctgagggtgaggttgttgccgtgatcggtccttcaggctcaggcaaatcaacgttcttacgctgtttaaacctgttggaaaagcctaacggcggaaccattacaataaaagacacagagattacgaagccgaaaaccaacacattaaaggtccgggaaaacatcgggatggtttttcagcattttcatctctttccgcacaaaacggttctcgaaaacatcatgtacgcgcctgtcaatgtaaaaaaagaatcaaaacaggctgcacaggagaaagctgaggacctgctccgcaaagtcggtttgtttgaaaagcgaaatgactatccaaaccgtttgtctggcggacaaaaacagcgtgtcgcgattgccagggctcttgcgatgaatccggacatcatgctgtttgacgagccgacctccgcccttgatccagagatggtcaaagaagtgctacaggtgatgaaagagctggtcgaaaccggcatgaccatggtgattgtcacacatgaaatgggcttcgcaaaagaagtggcagaccgtgtgctgtttatggaccaaggaatgattgtcgaagacggcaatccgaaggaattttttatgtcgccaaaatccaaaagagcgcaggactttttagagaaaatattatagaatataaaaaagaagaaggctggccgcctcttcttttttattgaagaaacaaatagaaatggagtccgacatgtttaaaattggttaccgcacaataaagaccgcgcttggaacagctttggctatttatataagccagttattgcatttgcaaaacttcgcatcagcaggaatcatcaccattttgtgcatacaaatcacacaaaaacggtcgcttcaggcctcatgggcccgcttttcggcatgctgtctggcaattgctttttcttatctctttttcgagcttattggctaccacccgtttgtgatcggagcgcttcttttgatattcattccgataacggttctgttaaaaattaacgagggtatcgtcaccagttctgttattatccttcatttatacatgtccggcggcattacgcctactttcatctggaatgaagttcagctgattacggttggcatcggcgtcgctctattgatgaacttgtatatgcctagtcttgaccggaaactgattgcctaccgcaaaaagatagaggataactttgctgtcatttttgcagaaatcgaacggtatttgttaactggtgagcaagattggtcaggaaaagaaattccggaaacgcaccagctcattacggaggctaaaaacctggcatatcgagatgtgcaaaaccacattttgcgttatgaaaatctgcattatcattattttaaaatgagagaaaagcaatttgaaattatcgaacgccttctccctaaagtgacatcgatctccatcacggtagatcagggaaaaatgatcgctgaatttattcatgatttgcgggaggcgatacaccctgggaatacagcatacaaatttctgaaaagacttgctgacatgagaaaagaatttgaggagatgccgcttcctgcgactagagaggaatttgaagcgagggccgctctcttccatcttctcggcgaaatggaacaatatttagtgattaaaagttattttaaaggaataaaagcgcaaaaatcactcggatgattcgcatgagctcttccttcattggtcaacctaatgaaaaaggaggagcttatgcgttttttcttatgttcgattttcatgatgatttcaccgatttggccgctcggcgaaaatccgctgccgggtgatccgtatgttattgtcaacaagcgaacaaatgaacttgctgttatcctcgacaacaaagtagaaggcgtgtatagtgtggcgactggaaaaacagatgatttgacgcctgaaggagagttttcggtaacggtaaaagcggaaaatccttactacagaaagaaaaatattgaagggggatctcctgataacccgcttggggcaagatggatcggatttgacgcgaaaggaacggacgggcggatttatggaattcatgggacaaaccgagaggaatcagtaggaaaatttgtgtctaacggctgtatacgtatgcataacgatgaggttgttcatttgtttcaaacgataccagtaggaacgagagtgctgatcacggacgacaaccgctcttttgaggagattgccatcgagcataaagctctgataaaaaagcaggatattcccattgaataaggcgcctgcttttttatcgttatagaaacatgacgattcctgagagtacagttgaaagaataaaaactcccaaaatcacgatcaaaacgcttttcatcagtttttgagacatgattttcactccttaaacaatctgtctatattttagcgtgttttgaatgggcggacaagcgatatctattagcgaaagcagggatgaaaatgaacaggcttgaccatatcgggatagccgttttttcgataaaagatgcaagaagcttttatgaaaatgtattggggcttgcatttcttcatcaagaaacggttgaagagcaaaaggtgaatgttgctttttttcaagctggtagcgtcaaacttgagctgatagagccgttgacagctgacagccccgtccatttatttttggagaagaaagggcagggactgcatcatattgcgtttttgtgcaactgcctatctgaacagcttcaagcattgtctgatcagcatgttcaattgattgacaggtttccaagacagggagcgaacgggaaaaagatcgcgtttatttcccctcgggaaacaaacggtgttcttgtagagctttgtgaaccgaaaggagaccaacacaatgagcatgaatgagcacatggatcatttttacacgaaacgcaagcaggcagaagaaggcggaggacgggaaaagctggctcagcagcggcaaaagggcaagctcactgctcgggaaaggatcatatttcttctagatcaggacagctttatcgaattacaccccttcatggaaagtcaagtgttaacaagagaacagcgcatgttaggggatggggtcgtgacagggtacggcacaattgacggtcgctcagtttatgtatttgcgcaagacttcacagtgtacggaggggcgcttggcgaaacccatgccaggaaaatctgcgctttgatggatctggcagcaaaaaataaggcgccgattatcgggctgaatgactcaggtggtgcgagaattcaagagggtgtgttatcattagatggatacggtcacatattttaccgaaacgtcttatattccggagtcattccgcaaatatcggttattttagggccgtgcgctggaggcgctgtatattctccggcactcacagattttatatttatggctgaacagactggccggatgtttattaccggcccgaaggtgattgaaaaagtgacaggggaacaggttgatgcggagagcttaggcggagcggggatacataatgccgtcagcggaaacgcccacttttccgggcatacggagaaggaggttctgacaggggtgagaaaactactgtcttatttgccgctgaatggccggacaacagagccgaagccagagaaagaggcgtccagaccgttattaaaccgtcttgtccctgctgatacgacaaagccttatgatgttcggaaggtgattagggagctggctgacccgcagtctttttttgagattcagccattttttgcgaagaacattgtcattgggtttgcaaggctgggtgaaaaagcaatcggcatcgtggcgagccagccgaagcatctggcgggaagcctgacgattgacgctgctgataaagcagcaaggttcatccgtttttgtgacgcatttgatatcccgctgttgactgtcgaagatgtcccggggtttctgccgggtattcagcaagagcacaacggaatcatcaggcatggagcaaaattattgtttgcttatgctgaagcgactgtcccaaaagtcacactcatcattagaaaagcgtacggcggcgcctatgtggccatgaacagcaaagcgatcggagcggaccttgtgtttgcatggccgaatgctgaaatcgcagtgatgggtccagaaggtgcggcatcgattttgtatgaaaaggaaatcaaagcttcagctgacccgcaaaagacgaaacgcgaaaaaactgctgaatacaaaaagcaaaacgccggcccatacaaagcggccgcttgtggaatggtcgatgacatcattttgccggaagaatcaaggggaagactgattcaagcttttcatatgcttacacataagacagaagagagaccgaaaaaaagcacggtaacataccgctttaatatggagggacttacaaatggtgaatgaaaaacgcctgctggaagaatttttagagcttgtccaaattgactcagaaacaaagcacgaagctgaaatctgcaaagtgctgaaacgaaaattttctgatttaggtgtggacgttaaagaagacgatacaatggatatcacgggccacggagccggtaacctgatttgcacgctaaaagggacaaaacaaacagatacgatctattttacatctcatatggacacagttgtacccggaaacggcgtaaaaccagttgtagagaacggttacgtcaaaactgacggcacgacgattttaggtgctgatgataaagcgggattggctgcaatgtttgaggcgattaaggtgctgaaagaagaaaatattgaacacggcacgattgaattcatcatcacagtaggggaagaatcgggtctgatcggagcgaaggcgcttgaccgttctatgatcactgcatcctacggctatgctcttgattcagacggaaaagtcggaaatatcattgtggccgcgccgacacaggcgaaggtaagagcggcaattttcgggaaaaccgctcacgccggggttgaacctgaaaaaggcatttcagcgattacaatcgctagcaaagccatctcaaaaatgccattgggccgtatcgatgaagaaacaacagctaatatcggccggtttgaaggcggcacacaaacaaacattgtgtgcgacgaagttcatattcttgctgaagcgcgctctttagttcctgagaaaatggaagctcaggttcaaaaaatgaaagctgcttttgaagaggcagctgctgatatgggcggacgcgcagaagtcgaaattgaggttatgtatccgggctttaaatatcaagacggcgaccaagttgttgaaatcgcgaaaaaagcggctgctaaaatcggacgtccaagcgagctgcaaacgagcggcggcggaagcgacgcgaacgtaatcgctggtcatggcatcccgacggtcaatcttgctgtcggttatgagcaaatccatacaaaaaatgaaaaaatgccgatcgaagagctcgttaaaacggcagaaatggttgttgccattattgaagaggcggcaaaataaaaaagaaaacccgagtgcgatttcccgcatcgggtttttttagctccatttcctaagcggccaaaataacacatcctgttttttagcataatgaagcaaggggtctgactccggcaatgtaataccgtgagcatcagtcaccgtattgactgaaatttctgcttcggcgttttgcagcagccacggatgatgatggatgtcttcgtaatagagcttattgcgataagtggtgtagagcctgtatcgttctgtcagccagtaatcgagcgaatccttttctgctgtaaaaggcgctgaaattggccggtatgcggcgtggaatgctgcttctttgtcatttttccgcttgctgacatagtcaatggcatcaccgtttttttcggacttcatatccgcgtaaaaataaggcagatgaaagaatgtgcgagcgccaaggaccgccagacgatgatcggcatctaagctaaaaaaataaatgccgggcttgcctttatacgtgacataggtgcggaggttaagctcaggaaatgcacgcgcaccgggaatgacagggagataacgcgccctcaggttcgtgagcataaagggaagcatgctgatccaagcttgcccgttatatgtatctaattctaaaacggacggtaccaaagcgcgaaggatagaaacatcaacaggccagtgagcaaataagacatcattccaggtttgtctcatgatccagattccatcaggtacagaaatatttttttgctgaaagcgttccgtcaacgtataggctcctttcggttggaggtgagtaaaggtattcccgatttccttctttttaaacgatacggctattttttaggatggccatttctgcttcagccatgataaacaagactgtttggcgcggtactttgcaagtaacaaaaaacaaccccggctttttgcacggggttgcttttttatttcaccgactcagtaagagcggctgtttttttacttttatgatgcgtcatctgaaggacgatgttttgcactgtcaaaaacagtccgcttgtaaaccagtacagcggaagggctgccggcacattaagcgagaaaatcgtcatcatcacagggaagatgaacaccatcaattttgcggattgctgcgctgcagggttttgcgggacagcggaatatttcgcgctcagtttttgagcgatataggcttggacaaaatacataatccctgcactaagggacatgagaatatcagattgccctaaactgaaccatagaaacgagtgtgacgcaatttcaggtgttgagcgaatcgcgtaataaagcccaatcataatcggagactgaatcagcattggaagacagcccatcgcaagcgggttgatattatgctcctgatacagcttcatcatttccatttgcagctctttttgcttttccgggtccttcgtctttttcaacttaacctggatactgtcaacctgaggtttaataacggccattttctcttggaagatgcgctgttttttgaactgattgacaaacaaaggcaatacaactatacgcacaataatggttacgaggataatagagagtccgtattctccgtgaaacagcccggcaacacccttaagcagagcggaaaacggttcgattaaataatcgtggaaaaaacctacgttgctgaggcctcccacctgattagtcgctgcaaatgcagcattgcccgagcataatacgatcaaaaagatacccatagccaaaagtttttgatatgtttttaacaattttgttctcctcctttttataaatgcggtttataaaagaagagaaccggcgtcttcctcatcgttcacaggcgaattcatgcggaagactttacgtatccaagttgtaatgcgatgatatataataataagaaagtctgttcggttaatgtgaaagaccgtctgatgttcatctgttcgttttgatttccattgctcgcccgcacggcactcccgtaagaggaatgcaatcccgattgccgttagagcaggaagaataattgtgaaaaaatcgactaagaataaaacgtcatttatcgattccacaaacattgtcatcacatccattcaatagcttcattttactatatgtacaagctgttgtctaatgaccgaaaaggagatttgtttatgccgggaaagagccgaattattttccatattgatatgaatagcttttatgcgtcggttgaaatggcatatgatccggctctccggggaaagccggtcgcagttgccggaaacgtaaaggagcgaaagggcattgtggtaacatgcagctacgaagcaagagcgcgcggcgtcaaaacaacgatgccggtttggcaagcgaagcgccattgtcctgagctcatcgttcttccgccgaactttgaccgctatagaaactcttcacgagcgatgtttaccattcttcgtgaatatactgacctagtggagcctgtctccatcgacgaaggctatatggacatgaccgatacaccatacagcagccgcgctctagagacggcaaaagaaatccaaagcaggctgcaaaaagagctgctgctcccgtcaagcatagggattgcaccgaataaatttctcgctaagatggcgtctgatatgaaaaaaccgcttggaattacgatcttaagaaagaggcaagtgcccgatatcctgtggccgcttcctgttggagagatgcacggagtcggcaaaaagacagcggaaaaactgaagggactcggcatccatacaatcggagagctagctgcagctgatgaacactcgctgaagcgcctgcttggcatcaacggtccgcgccttaaaaataaagcaaatggcattcaccatgcgccggttgacccggagcgcatttacgaatttaaaagcgtcggcaactcatcgacactttcccatgattccagtgatgaagaagagctgttaggcgtttttagaaagcttgccgcttctgtgagtgaccgtttacagcgcaaggaagtcatggcttcgaagctttttattatgattagatatgcggattggagaaccatcacaagaagcactacgctgagaaacccgattgatcaaaaaaatgacattttgaaagaagcggagcacctcttttttaaacattggaataaaaatcctgtcaggctgcttggcattaccggaacggatttagtagaaaaagagcaggcctataaacagctcgatttgttcagctttaatgaagatgcgaaggatgagcccattcagcagatgatggaaaagctgaataaaaagtacggtaccaaactgatcagaaaaggggcaacgttaaaaaaagaggagagcaaaacaaagggaacaagctttaataaagatttttttcaagatgaaaagaaaagctgaatcgcttgaaaaaaagggtgaatgtatggtaatttctttattataaatatcattttattttaatttaaattttaaaatgattaaacgtttgcagaagggacgttagaatatgtcaaaacaacaaatcggcgttatcggacttgcggtcatgggtaaaaatctggctttaaatatcgaaagccggggattttctgtttctgtttacaacagatcaagcagtaaaactgaggagtttttacaggaggcaaaaggaaaaaatgttgttggcacttacagcattgaagaatttgtccaatccttggaaacaccgcgcaaaatcttattaatggttaaagcgggaactgcaacagatgcgacaattcaatctcttcttcctcatctagagaaggatgatattttaattgacggcggtaatacatactataaagatacacagcgccgtaacaaagaactcgctgaaagcggcattcattttatcggaacaggcgtttccggcggagaagaaggagcgcttaaaggaccttctatcatgcctggcggacaaaaagaagcacatgagcttgtaaaaccgattcttgaagccatttctgcaaaagttgacggagaaccttgtacgacatatatcggtccggacggcgccggccattacgtaaaaatggtgcacaacggaattgaatacggagatatgcagctgatctctgaatcatatttcattctgaaacaggtgctgggcctttctgctgatgagcttcatgaagttttcgctgaatggaataaaggtgagcttgatagctacctgattgagattacggctgacatcttcacaaaaaaagacgaagaaacaggcaaaccgcttgttgatgtgattcttgataaagcaggccaaaaaggaacaggaaaatggacaagccaaagcgcacttgacttaggcgttccgcttccgattattactgaatctgtattcgcacgctttatctcagctatgaaggaagagcgtgtaaaagcgagcggacttctttcaggaccagaagtgaagcctgttacagaaaataaagaagagctgattgaagcggtcagaaaagcgttgttcatgagtaaaatctgttcatacgcgcaaggatttgcccaaatgaaagctgcttctgaagaatacaactgggatctgaaatatggtgaaatcgctatgatcttccgcggtggttgcatcattcgcgcggcattccttcagaagatcaaagaagcttacgatcgcgagcctgagcttgacaacctgcttcttgacagctatttcaagaatattgtagaaagctatcaaggagcgcttcgccaagtgatttcacttgcagttgcccaaggtgtgccggtgccatcattctcaagcgcattagcctactatgacagctaccgcacagccgtactgcctgcaaacttaatccaagcacagcgcgactactttggcgctcatacttatgagcgtactgacaaagaaggcatcttccatactgaatggatgaagtaatcaatagaaacccccgaagctcttaagctttgggggttttgttattaaggagattgttatacctttgttcagcgtaaaaaagccgaaaatgcttgtaaactattttcggcttttttcttcttattatatgttccaccagtgtaagccgtctttcaccaaaagatcatcagattctttcggtcccattgagcctgattcgtagttaggagataaggttttgtttgctgcccatgtttcagaaatagagtcgacaaagctccaagaaagggcaacttcatcccagtgtgcaaagtttgttgcatcgccaagaagacagtcgtgaattagtttttcatatgcttcaggggtgttcaactcgtcattgcaattgctgcaataatcgagtttgattggctgtgcgtgtgctgctccgccaagctttttagcatttaagtaaagcgtaatgccttcgtcaggctgaatatgaatgacaagcaagttcggattcatgttgttttcattaccgtagtacaggttcatcggaatgtccttaaattgaacgacaatttttgtggacttttctttcattcgttttccggttctgatgtagaatggaacaccagcccatctgaagttgtcgatcaagagcttgccggcaacaaaggtttctgtattggagtcaggagcgacattatcttcatctgtataagcaggaaccggtacaccgtcaatttcaccagcatgatattgtccgcgcacaaagtattcatccacttcgtcttttgcaataggacgcagtgctctcagcaccttcactttctcgctgcggatttcttctgtgttcaatttgataggcggctccattgcaagaagggcaaccatctgcataatatggttttgcaccatgtcgcgaagggcgcctgatttttcgtaatatcttgcgcggtcttcaacgcctagtgattcgctagatgtgatttgaatgtttgaaatgtagcggtttgtccaaagcggttcgaaaatcgcattggcaaatcgaatcacttcaatgttctgaaccatttgtttgcctagataatggtcgattctgtaaatttgatcttccgtaaatgcttcgcggatttctttattcaatgcctgtgcgcttggcagatcatggccgaacggtttttcgatgacaaggcgggaccagccggttgtagctgttacaccctctgattttaatgtttttgcaatcgttccgaagaattcaggagccattgccaagtagaacattctgttgttaggaatttgatatgtatcttccagctggttaagcaatacgtttagctcttgataagaaccagggtttgtcacgtcaaacgggtgatagtaaaaatgagacgtgaaatcatctatatgcttatctgcagatgaggaaatggatgttttaacagtttggcgaagatcctcattagaccaaggtcttcttccaactcctaccactgcaaactcttctccgatttgtccgttttgatataaacggtgaatagacggatacaattttcgttttgctaaatctccagttgcaccgaatatgacaattactgcttttggttgttggtttgttttcactaaaagtacctcactttattcgaagctttattttagtacaccccgtatatttccttcattttaaatctaaaattcaacgaaagcaaacatttaagcccttttttaagcagaatgctgaaaaaatgtttctagcacgaaaggattgttcttttcagaggcaagattcacattttccgcttgatcctgtattcttgtaggtatctggttctagtaggaggaaggaaacgtggaattactttttttagggacgggagccggcatccccgccaaggcgagaaatgtaacgtcggtggcattaaaattgcttgaagaaaggcgttcggtatggctttttgactgcggggaagccacacagcatcaaattttacatacaacgattaaacctcgtaaaatagagaaaatctttattacacacatgcacggcgatcatgtatacggacttccggggcttctggggagccgttcctttcaaggcggagaggacgagctgacagtgtacggacctaaagggatcaaggcgtttattgaaacaagccttgccgtcacgaaaacccatttgacatatccgcttgcgatccaggaaattgaagaaggaatcgtgtttgaggacgatcagtttattgtcacagcggtatctgttattcatggagtggaagccttcgggtaccgtgtgcaggaaaaagacgtaccgggttccttgaaggctgacgtattaaaagaaatgaacatcccgcccggacctgtatatcagaaaatcaaaaaaggcgaaacggtaacgcttgaagacggacgaatcatcaatgggaatgattttctggagcctcctaaaaagggaagatctgttgtgttctccggtgatacgagagtaagtgacaaactaaaagagcttgcgagggattgtgatgtgcttgttcatgaagcaacctttgctaaggaagaccgtaaacttgcttatgattattatcacagtacaacggaacaagcggctgtaacagcgaaagaagcaagagcgaagcagctcattttaacccatatcagcgcaagatatcagggagatgcttctttggagcttcaaaaagaagcggttgacgttttccccaatagcgtggcggcatatgatttcttagaggtaaacgtcccgcgaggctgaaggcggagctcttatttgacaatttgtgatgacgttgtataataaaacgtaatcattacgttttataaggagatgttaattatgagagtaaatgttactttagctttgcactgaaacgggagaccgaaattacatcacaacaaaaaataaacgcaccaatccagaccgtttggagctgaaaaaatattcaccgcgtttaaagaaatatacccttcaccgtgaaacaaaataatataaaagaccgggaatcccttacggcccggtcttttttacgttaattgactgcctggtaaagaggagcggcctgctggcacgctgcgcaccatacgtcataaatagccaagtgaacgatatgaggttcatcatgatggatgttgtgggagctgtttttagcttgaatccagccgctttggttagatagagacaatatgctgctgtgcaagttttgccactcctgttcagcagcgaatttctcagtccgttctcctgatgacaacacaagaagaggcatgtttcctaagtggacttgccgctttttgagctcctgcagactttttgaaaactctgcatgtgtgccctcaagcatcatctttctcgtatgtgatttgtgcatttcttcgggtataaaggtaaagctggcgcaatcgcctaaagctgggtcaagaaggaccatgccgataatatcatgcttgtttttgcaggcccataaaccggtgatgacagctccgtatgagtgtgaaacagccaaataaggaggttttacatcagctgctttaagcaaactctccaattctttcacttgttgatcagctgttcgtttagctctgctttgcccgctttttcctatgcctgcccgatcatatgtgaaaatgccaaattcatcatcaatgtccgccattaatggtttccacgtctcagaagaagtaccatagccggcctcaaagacaatcgttacaccgcttgatcctttccggtgctgtgtatgaaacgcacatccgtcaattgtatatgtcttttccatccaagctgatttcattggagtcatctcctctaattggttctactagggagacggagaaccttagccgatcgtttctctaaaaataaaaaagagatatcctctacaggatatctcttatgggcattaccagcctctttcgtattgaacaggggccggaatctctgtattgagctgtttcgcagcagttcttgcaaaaaatggatcccgcaaaagctctctgccgataaagatgaggtcggcacgtccgttttgcagaatttcttcagccattgaaccgtctgtaatcatgccgacggcaccagtagccatgtccgcctgttcacggattttctcagcgaagctgacctgatagccagggaatacgttaatgtctgcgtgaacaagggcgcctgagctgcagtcaattaagtcaacaccctgctccttcatccattttgcaaaaccgatgtgatcggcaatgtctaagcctttatcagtgtagtcagaagcagatacacggacaaataaaggaccgtcccatacttgtttgacttcatcaatgatctctctcaagaaacgatagcggttttcaggtgagccgccatattcatctgttcgatggttggaaagcggagacaaaaattcatgaattaaatatccgtgcgccgcatgaatttcaatcacatcaaagccggcttcttttgcgcgggcagccgcttgcttgaactcctggaccgtttcttttactttttctgctgacatttctacaggtgttgctgattgttcgtcaaacgcaatcgccgatggagcgaagatatctccttcaagctcagctttacgtccggcatgggcaagctgaatgccgatttttgaaccttgttctttgacctgctcagtcagttttgcaaagccttcaatatgctcgtcgctccaaatgcctaagtcttggtcagtgattcgtccttgagggttaaccgctgacgcctctacaataatcagtccgacctggccgattgcgcgcgatatgtaatgtgccatgtggaacggtgttaattttccgtccttttcatgagaagaatacatgcacattggcgacatgacaatgcggttttttaacgtcatatctttaattgtaataggtgtaaataattttctggccatttctttcgcctcccgtaaggtttttagagattgattatatcaagtcatttctttcccgtcatataaactgctcaaatgaaccgcttttgtcaaacatttctgtataatagacgagaaatcagtttatttttcagtatagaagcatttttattcataggaggggcggaatcaatgaattggcagacgaaggacgaattgctggcacttttaacttctcttgtgcaatacgaaagcatcaccggttcaaagggcgaggtagcgcttgcagagtatctttattttattttgaaggacaagccctattttcaaaagcaccctgatgatgtaacacttcatccgatggacgatggcagatcttttcttacggctctagtcaaaaagaagaatgtcaaaaagacagtgcttctgctgagtcattttgatgtcgttgacatagaagattacggcgaatttaaacatatggcttgcaagcctgctgagcttttgagctcctttttagagaaaaaagagctgctcccggaacgtgtgagaagagatgccgaaagcggagactggctgttcggaagagggacgatggatatgaaagcggggctttgtattcaactgtcgatgctggagagggcaatgaacgggcattttgagggcaatctgctgttgataacggttccggacgaggaagtgaattcaagaggcatgattgaagcggttcctgcattgaaggagatggagaaaaagcatgatatcacattaaccgcttgcctgaatgccgaaccgatgtttgaaaaatttcccggcgatcagcagcaatatttttatacaggaagcattggcaaggtgcttgcgggttttttctgcaaggggattgagacacatgttggagagccgttttcaggtctaaacgcaaatttaatggtatctgagattaaccgtttgcttgaactgaatgctgattattgcgaaaaggttgatggcgaggtcactccgccgccggtaaacttaatgcaaaaggacttgaaagaggcatattcagtccagacaccgcatacagccgtcacattatttaatgtgctgtcaatgaaacgctcagctagtgagctgcatcagatgctgcttaaaacagcagaacaggcggcggaggaaatcatgtcgaacgttcggaagaaaacacaggattttcaacaatttgagccatttcagccgattgagcgggacgtcactgttttgacatttgatgagctggtctcgcgtgcaaaaaagcgtgcggggatctcggaaacagagcgggctctaaattatgcctttgctaacaggggggagcttggagacagggatttttcgacgaaaattgtttctgagcttgcttcgctttgtaaggaggatgcgccgctcatcgttctgttttatagtccgccgctttatccagctgtttcttcaaaggatgatcaattgatcagaaatacagcagatcagataaagcattatgcggctgagcgatacggcattgcattacgggaggttcagtacttccccggactttcggacttgagttatcttcagctggaaaaacaggaggttgatgcatacacaagcaatatgccgctctttaacagagggtattcattgccaagcggtaaaaatcaggctttatatgtcccagttttaaatgtcggtccggctggtaaagacccgcataaatggacggaaagattgtatatgccttattcctttgaagtgcttcccgatttgctttcatttacgatctccgcgctattaaagcaatcagaatctgccggccagctgctgcgggaaaaataaaaaacagaaggcactgtgccttctgtttttgtccttacatctaagaatgtctctctaaggcggcaccggcaaactgttctttgatttctgcgctccgtttagctgtttcttcaatacagtgaataattgcttcttcaaagcgggagtcctgtaaagcgcgaagacctgcctctgtagtgcccccaggactggtgatttctttacgcagcttttccggctgtttgccgctttggaggagcatatctgttgcccctgccattgtctgcaaaatgagtgcttttgccgtttctttatctaatcctactttttgtgctgctttttccatcgcctcaatataacgatacacataggccgggccgctgcctgcgattgcagtgacagcgtcaagatgccgctcctcaaccagtgttgcatcaccgattgtttccaatagagcttttgcggcaataatatcattcttgcttgcttccgtgcttacggaaaatccggttgctgattttctgattgccgctgatgtattaggcatgacgcgaatgaccgcgagctttctgccaaaataatgctgaatggtttcgatggtaaggcctgcaagtactgaaatgacaagctggtccttgatatacggccggatgctgtcgatgctttccgccgcgtctttcggtttgaaagcgaggataatgatatcggtgtgagtgaaaaactcatttttatctctgcatggacgcacgctgtacgtttcctttaattcaatcagacgctcgtcatttgagcgatttgtaatatagatatgttctggttttgtgatgccgctttgcaaaatgccgttgatcattgcttctgccattgacccggcgccgacaaatcctatctttttcattgatatcctccttctattagaacaacaaaaaaccttttcatcacgtaaaggacgaaaaggttcgcggtaccaccctcattagcacaaattgtgctcagctcaaatccccgtaacgcgggaaacgtttaggttttcctaaccgcgacttgagggcaggttctacaaacaagcgggccgcaacacctttcagccgggggtatcgctctcttaggccattgccttgtatactattcctcgtcatagcgttccaatggttctcgttttagtttgttgttcattatgcaatggcggacaagctaatgtcaatagctttttcaaaaaggtttgttctcattctgcaataatgacacaagaccgagaaaaagctaaaatatgaataatgaatgaagacaaggagcgaaaggatgacaactgaagatgtaattgcgatccgcgtcccgacaccgtttgctgtcggcgatgttatcgtttacctcgtaaaaggtgatgcgctgacacttatcgatgccgggccgaatacaaaagaggctgccagagccttacaagagcagcttgccgctgtaaatgtgaaattgtcagatatcgagcaggttgtactgactcaccatcatgctgatcatgcaggcttgcttgatgtcttttcagatgaaatcgaagtgattgggcatacattcaacgaaccttatatcagccaaaatcaagcctttatggattggcaaaaacgtttttttcaaaagctgctgcctgaattaggcgttccatttgatacggggaaggcggaaaagctgattcgatcagcgtacgcattttcctgtacgagatctctgacaaaatcaatcagagaaggtatgggcatagatgggcttgagggctggtctgtgttggagatgcctggacatgctgaatcgcatattgttctgttccatgaaaaaagcggaaggatgcttggcggcgatctactgctggcaaacagctcgtctaatccgattttggaagcgccgaaagcgggagacgtcaggtcaaagcctttagtggattatcagcggtcattgcgaaggctgtctcaacttgatccaacaatcgtatttcctggtcacggcgagcctatcaccagtgtacaagcgctgattgagaagcgttttgacaagcagaggaacaggacggaggatgtgcgtcgcatgctggatgaaaagccgatgaccgcttttcaggtctgtcagcagctttttcctgctgtatatgaaaaggaattgtttttaacgatgtcagaaacggcaggtcaccttgatgtgttggaggctgaagaagccatcacgtcatattgggaaggaaataccgtatactttaaaacaatgaagaggtgaaatgggtgaaacatatagcgggaaaaaggatttggataaccggcgcttcaggagggcttggagaaagaatcgcatacttatgcgcggctgaaggagcccatgtcctgctgtcggctagacgcgaggatcgtttgatagaaatcaaaaggaaaataaccgaggaatggagcggacagtgtgagatttttcctctggatgtcggccgcctagaggatatcgcccgggtccgcgatcagatcggctcgattgatgtactgattaacaatgcaggcttcggtatatttgaaacggttttagactctacattggatgacatgaaagcgatgtttgatgtgaatgtcttcggcctgatcgcctgtacaaaagcggtgcttccgcaaatgcttgagcaaaaaaagggacatatcatcaatatcgcctctcaagcggggaaaatcgccacaccgaagtctagcctgtattccgcgaccaaacatgccgtgttaggttactcaaacgctttgcggatggagctttcgggaaccggcatttatgtgacaacagtcaacccgggcccgattcagacggactttttttccattgctgataaaggcggggactacgccaaaaatgtcggccgctggatgcttgatcctgatgacgtggcagctcaaattacagctgcaatttttacgaaaaagcgggagatcaatcttccgcgtttaatgaatgccggcactaagctgtatcagctgtttccagctcttgtagaaaagctggcaggacgcgcgctcatgaaaaaataatgatagaactgcctgtggtggagtggcttgtttctcacggggcagtttttgatagtggaagggagagattgttgaatgtcagttcattcagaagtccttcatgctctgcttaaagatccgtttattcagaaactgattgatgcagagcctgtattctgggcaaattcaggcaagaaagaggggccattaccccgtgcagatgagtgggcaaccgagatagcggaagcggaaaaaagaatgcagcggtttgcaccttacattgccgaggtgtttcctgagacgaaaggcgctaaaggaatcatcgagtctccgctttttgaggtgcagcatatgaagggaaagctggaagcggcatatcagcagccatttcccggaagatggcttttaaagtgcgaccatgagcttccgatttcaggatcgattaaagcgaggggcgggatttatgaagtgttaaagtatgctgaaaatctcgcgcttcaagaaggaatgcttcaggaaaccgatgattaccgcatcttacaggaagagcggtttaccgggtttttctcccgctattcgattgctgtcggttcgacaggaaatctaggtttaagcatcggcatcatcggcgcggcactcgggtttcgcgtgacagtgcatatgtccgccgatgctaagcagtggaaaaaggatctcctccgccaaaagggagtcactgttatggagtacgaaacagattacagtgaagcggtgaacgaagggagacggcaggcggaacaagatccattctgttattttattgatgatgaacattctcgtcagctgttcttaggatatgctgttgctgcaagccgattaaaaacacagcttgactgtatgaatataaagccaagtcttgagacgcccttgtttgtgtatctgccgtgcggagtcggcggaggaccgggcggtgtagcatttgggctgaagcttttatacggagatgatgttcatgtgtttttcgcagaaccaactcattcaccttgtatgctgttagggctttattcaggacttcacgagaagatctccgtccaggatatcggcctggataatcagacggctgctgacggacttgccgtagggaggccgtcaggatttgtcggcaagctgattgaaccgcttctgagcggctgttatacggtagaggacaatacgctttatactttgcttcatatgctggctgtatctgaagataaatatttagagccctctgctcttgctggcatgttcgggccggttcagcttttttcgacagaagagggaaggcgctatgctcagaaatataagatggaacatgccgtacatgtcgtctggggaacggggggaagcatggttccaaaagatgaaatggctgcgtataaccgaatcggtgctgatttgctaaaaaacgaaatgaaaaataagcagacagtgaaaaggttttccgttacaatctttgtaagggttttaacctacagagagtcaggtgtaaacagtgaaaaataaagaacttaacctacatactttatatacacagcacaatcgggagtcttggtctggttttggggggcatttgtcgattgctgtatctgaagaagaggcaaaagctgtggaaggattgaatgattatctatctgttgaagaagtggagacgatctatattccgcttgttcgcttgcttcatttacatgtcaagtctgcggctgaacgcaataagcatgtcaatgtttttttgaagcacccacattcagccaaaattccgtttattatcggcattgccggcagtgtcgcagtcggaaaaagcacgacggcgcggatcttgcagaagctgctttcgcgtttgcctgaccgtccaaaagtgagccttatcacgacagatggttttttatttcctactgccgagctgaaaaagaaaaatatgatgtcaagaaaaggatttcctgaaagctatgatgtaaaggcgctgctcgaatttttgaatgacttaaaatcaggaaaggacagcgtaaaggccccggtgtattcccatctaacctatgaccgcgaggaaggtgtgttcgaggttgtagaacaggcggatattgtgattattgaaggcattaatgttcttcagtcgcccaccttggaggatgaccgggaaaacccgcgtatttttgtttccgatttctttgatttttcgatttatgtggatgcggaggaaagccggattttcacttggtatttagagcgttttcgcctgcttcgggaaacagcttttcaaaatcctgattcatattttcataaatttaaagacttgtccgatcaggaggctgacgagatggcagcctcgatttgggagagtgtcaaccggccgaatttatatgaaaatattttgccaactaaattcaggtcagatctcattttgcgtaagggagacgggcataaggtcgaggaagtgttggtaaggagggtatgaaatgtgcatcatattgaactgtatgtctctgatttggaggcgtctaggcggttttggggctggttcttaaaagaacttggttataaagagtatcaaaaatggagctcaggcatcagctggaagaaagatcgtttttacctagtgattgtgcaggcgaaagagccatttctagagccggaataccatagatgccgagtcggtctgaaccatctcgcatttcatgctgaatccaagcttcaagtcgatcagatgactgaaaaattgacggcaaaaggctatcgtgtgttgtaccgagacaggcatccttttgccggaggagacgggcattatgcagtcttttgtgaggatccagaccggattaaggtagagctcgttgccccaagctgttaatcgtgatcttcggacaggctgttcagctttttctcaatgcgatccagctgcgcttttcggtttttcgcatacttgaagcctgtaacagccgcaaagacgacagcggcaaatataataaatacaaacagctgaaacatcacatcacctatattcatgttcttcacctcatgtttgcgggagagattcattctcttccgttttttatttaaagcggcttttccagacgggaacggtgttttgtggtctccattttcatttgccgataggcgaacgctaaaaatggcaggccgagcagggtaatgccgctcaggacagaaaaaatataaatcggccggccagcgccaaacaggtctatacatatccccccgacccaagggccgatgacgtttccgagctgtgaaaaaccgattgccccgaaataagtgccttttaatcctggttttgcaatctggtctacatacaaatccatcatagagaataaaagcacttcgccgattgtaaatgtgatgacaatcatcacaattgatggaacaccgtgtgatacggtgaaaatggccatgctgatgctaaccatcacattaccgagcatcagagaacaaagcggcgaaaaccgttttgcaaaatggacaatgggaaattgcgtcgccaacacaacgattgcgtttaatgtcagcatcagcccatacagcttcgttccattgccgatcaaggggttctgcgccatatactgagggaatgtggaactgaattgtgagtagccgaaggtgcatagcgtaatgccgaccaaagcaatggtaaaaagataatccttttgcgtgaccataaacgcttcccgcacgctcatatttcgggactgggctggtgctgataaggatggatgttttttaaattggagggcaagcacaattccgtatagtccgtaaatgactgcaggcaccaaaaagggcgtagtcgattgcgatgagccgaaatataggccaagcacaggtccgaagacaacgccgatattaatagccgcatagcgtaaattaaaaactagcagtctcgttttttcttctgtcatatcagacaacaaggcctttgaagcgggctcaaacagtgatttgcaaagaccgtttaatgcgtttactacaaaaaacacccagagattagatgctgccgcaaagcctgcaaataccagcatccatccgaaaatcgatacaagcatcatgttttttctgccgaatttatctgagatatatccgccgtaaaagcttgcgaggatgccgactgatgagctcgcggcgatgaccagccctgcataggaagctgatgcgccttggacggctgtcaaataaatcgctaaaaaaggaatgctcatcgatgttgccattctgccgaaaatggttccgattataattgtccagctgatcgggtggatatctttccatttcttcatgaattatattctctcctgtatgtatgatctttctctatcatatatgaaaaaatttccttctccaatagatcgttcaaaatatttcgttattgacatgtagtatgcctgattgtatggatggcaatatactatgcgttgaggatgcgtgtggctgacggagtttacatcttgaaagaaggaaaatgacgggatgtccgatgaaaagcaaagcgattggtcagtgagggtgtgttagtttaagccgccagaacgtggatcatatcggcagtgaaaccggctatgagatcaagatgtacgctgaaaaccggcatggaccgcatgacagaacaagagagcacatctcttcgaaaaagtgtatacgcgtgatcatggacagcttattccgttttgcgcgagcattgaggggaattttacgccaggccatatgaatctatggagcgtgagaaaatcctgctttttttctgtaagcctgagactgtttatttgtttcaggcggtgttttcaaagggaagccgcatcagcggctgaaagaactgacagtcatgcgtttaagagaacaggccttggtttgtgacatagtcataaatgatatcttctatatgcgcatgcaaatcctcatctggttcttcattccgtctctcttgtagagccgctttcaggctttgtttttcatacgggcttaacggatctatagcaacgtttctgccgtattgccgcaatgcctgtcccagcattttttcgacaaatttctccatcatgactctcctatccttatgcttcgcttttattctactaaatgtttttcttctctcaaacccttggatcatattttctgtcagacaagaatcatttaccagtataaaacgaacatactttcgcatataatgaaaagcgaacataagttctttttagaggtgtgtatgatgaaagaaaaagtgatttttctcgttgacatgcaatcgttttatgcatctgtagagaaagcggaaaatccacatttgaaaaataggcccgtcattgtttcgggtgaccctgaaaaaaggggcggagtcgtattggctgcctgcccgctggcgaaacaaaagggtgtggtgaatgcttcacggctgtgggaggcgcaggaaaagtgtcctgaggctgttgtgctccggccgcgtatgcagcggtatattgatgtatcactgcaaattacggccattctcgaggagtatacagaccttgtggagccgtattccatcgatgaacagttcatggacattacaggcagccagaagctgtttgggacgccgatggagatcgcgaaaagcattcagggcagaatcatgcgggagatcggcgtttatgcacgggtcggaatcggccctaacaaagcgctggccaaaattgcgtgtgacaattttgccaaaaagaataagaacggtatttttaccttaacgaaagaaaatatgaaaaccgaaatgtggccgctcccggtgggcagcatgtttggcgtcgggagccgcatgaagcatcatttaaatcgaatgggcatcagcacgatcggcgggctcgcggcttttccgctcgatcttttaaaaaagaaatggggcattaacggccacgtgctgtggatgacggcaaacggaatcgactattcccctgtgtcaacttcgtctctggacgggcaaaaggcgataggtcatggaatgactctcccgagagactacgaacactttgacaaagaaatcaaggtcgtattgcttgagctgagtgaagaggtgtgcaggcgaagccgaaacgccggggtcatggggcagacagtgtcagtgagctgccggggtgctgattttgattggccgacgggcttcaaccggcaagtgaagctggcagagccgactaattctacgcaggatgtatatgaggctgtacgacggctgtttcttacattttgggacgggaaacccgtccgccgcctcggtgtcaatctgtctcagctctcatctgatgacatatggcagctcaatttatttcaggattatgcaaagaaaatgagcctaggctatgtgatggatggcattaaaaatcgattcggcgatacagcaatcatcagggcggcgtcactgacagcggcaggccaggcatttgaacgtgcggctaaaataggggggcattataaatgaacgaccatttaaaaaggggcaacctgctgtgggaagggagcaggatgtttctgccggaacataagcaaagcctgctggagagaaagcgacttaaacagaagctgcaaaagccgatccttgaccccgataagctggaagagatgaatcaaacgctttgcgccgcgatggagtttgctcaggatatcactgtcagctgctttcaggacggtgagattgtctgctgcaccgggaaaatctgccggtatgaagagtttgaaaaagcagtatggataaaaggagacgaggatcagctttataagctgaaacttgatcaagtgcttgatattgtgctgtaaagtctctcctcctgtttgggggagaaataggcgtaaaatgatcaaacattgttccctcggcagtctggaaacgtatgatacaggaaagaaggcatttacaattccagccaggcaaaatataatttttatattgtgagaaaaagagctgacattcgttttgccagacggagggagatcaaatcgtaatggatattcgaacaatcacgtcttcagattatgaaatggtaacgtctgtactgaatgaatggtggggcggcagacagctgaaagaaaaattgccgagactattttttgagcattttcaggacacaagctttattacatccgaacataacagcatgacgggatttttaatcggatttcaatcgcaatccgatcctgaaacggcgtacattcatttttccggtgtgcatccggatttcagaaaaatgcaaattgggaaacaattgtatgatgtatttatcgaaacagtaaaacaaaggggctgcacccgggtgaagtgtgtcacttcacctgtgaataaggtatcaatcgcatatcacacaaaattggggtttgatattgaaaagggcaccaaaacggtaaatggcatctcagtgtttgcaaactatgatggcccgggccaagacagggtactatttgtcaaaaacatatgagggggaaatatgatggattttttatcaaaaacacctgagcctccttactatgcagtcattttttcttctgtcaaaagcgaaaatgacacaggatatggagaaacagcggagcggatggtatcacttgcggcggatcagcctggatttttaggcgtggaaagcgtacgtgaagcggatggaaggggcatcacagtttcctattgggacagtatggacgcaattaaccattggaggcatcacactgaacatcaagcagcaaaagaaaaaggaagaagcgtttggtacgagtcgtatgcagtccgcgtcgcaaaagtcgacagacagcggctgtttcaggagaacacgaatgattgaatttctccagcataaggaagccactatagcgcgtgagattttagccgtacagatccccgcctacataaaggaaacagagattatcggttttgacggtattcccgctttacaagagaaggtaaaggatattcaagcatcccatgaacggtttgcgggatatcggaaaaacggcaagctgatcggtgtcatttcatatgagaaaaacatgcattatctcaccatttgcaggcttgttgtgcatcctgacggtttcagaaaaggaattggacgagcgcttctgcaatttgtcattgatcataatgaagacgctgagaaaatcgaagtagtcacagccgagaacaataccccggctgtgtcactctatacacaggccggattccaaaaggcagaaaccgtcaaagcagcgcagggtctattgctgtcggtctttcatttgtatccgaaaagaaaagttgagatcattctctacaacgaaaaatgggcagaatgtttcgatgaagaaaaagaacggctgaaacttgtgttcgggccggagattatcgctattcatcacatcggaagcacatcaatacctaacatggcagcgaagccaatcattgatatgttaattgaagtcagaagcattgaagccgtgagccaatttgatgaacaaatgaaggccaacggctatacaccaaaaggtgagaacggtatagcgggcaggcgttatttccaaaagggcggaaataaacgcactcatcatgtccatatgtacgaacagggaaaccctgctattgaaaggcatctgttattcagagattatctcagagctcatccaaacatagcgaaagaatacgccgttctcaaaaaacagctggcggcccagcaccctgacagcatcaatcagtatatacaagggaaagatgagtggatcaagactgcagaagaaaatgcgaagcggtggaaaaaaggcagaaacaatgcgaatggcagtattgtatgctacaatagcgaaaatgatgaaaacgggggtttcaccttatgaacatacatgtgacagatgcagcaaaacaggcactgcagcaggcgtttgacgccaacccgggaaaaaagcccagcttcgttacgatgcagaaggatgcggctgcgcggtaagcggtgtcccgacaatctggctggcagaagaattaacgggacagtgcgagcagctggaaacgaacggcattccgctgtatatccaatcgtcgcaaaaagtgttttttgacgatcaaatgacgatcgattacaatgaaaaagccaaaacattggcgctgaaaagcccggctgaaatgctcagccccagaatgagcatattagtaaagtaggagacgcgaaacgtggaacaaaagctgaaggcaatgaagaacacagcacaaaataaaacgtgggtatccttcctgaatcaaaaccatccttataccttgcttcactggtcaatcggaggagcagagtccatcaagaaagatgtctggctattgcaggatgaaatgaccttcgagacgcaggagtttacaacgatagatcttgcgattgaatggatcagagaaaatatggatggcattaccgacgttctgtaacataaaaaagcgaaagagccgaagaggcctttcgcttttttattctgttgaatcattcatgttgtctaaaaactcctgcactgtttttcggtacgtatgccgatttttggtatatgacatggcgtgttcaccgttctcggcaatgtacagcgctttcggaccgcgtttcttttcataaagccgctcggttgaagaaacaggaatgtagtcatcatccttactgtgaataaagaggaccggcttttcaattttatcaatgacagcaagcggagatacttcacgtgcgcgatagcctcccctcagcttcaaaaagaagtcggcgataggaagcaggggccaagacgggagcctgtattccgctctcagccgataggcaagctgttcatcaaaacatgcgaacggacaatcggcaatataaaaatcagcgccatcgctgcagtgtgcaccagcataaagcagggcggtcacggcccccatcgactcaccatgaattccgatcaatccgcgatgatttgttttgtttttgagcaagctgacaaccttattgagatcatccttttcgtaaaacccgtagctggtcgtctttccgccgctttggccatgccggcgatggtcataaatgagcacattccagccgagatctagaaataaatgcatatacttaagagaattcagtacattcatcgtcaccccgtggcagatgatgatggtatttggtgtgtcatgcggtgcgacatggtatccttttatgtcgtacccgtaagcggagggtatcacaaaagcggttttctccatttgttcaaatgattcaaacacatcatgtccgttgtctgtctctcttttgataatgtcttcatccgtttttttcttgatgaatagaatcatatgtgaaaaaacaattccgattgcgatgacagctgttacgagcgcgccaatggccaaaaggattttcttcaaaagtcacagcacctttcaacgaaatatataggcaattcgtgtttaagatcattatacctaaacactgctacgctgagaaagtgatcagaagagagtctgcttgttcagtttatatgctccgtgataaactggcttcaaaacaaaacatgggggaagtctgcatgaaaaaacaaaaatccattgacaaacaccagctaaaagacggccttcaatccgatatcaaagcaaagcttatggagatgaagagccaattgaaggaagaggatgaaaagaggcagaaaagagaaaaagcagaacagattagaaagaaaaaagagatcgaaaaaataagagctttgaagaactcctaaatgaaagccaaatggattggcatcaatataaataaaccagcacccgtacaggtgctggtttttctgctatgagcgatgagctttgtaaatgtcttgtttcgtatgagattggagcgctttgatttcctcttcggttaaacgccgtgcatttgctgcctgaatattttcccgtaactgctcaatcttactggcgcctgtaatcactgaagcgacagccggctgtgctagcagatactgcagcgacttttctgtcatggaaagatcgggagccacttcctccattgccttacgggcatttgtcagttcctcgaatgaataggacaagtacccgttttgtttcatactttctgaagcttgatcaagcggtttttcagttaagagccctttggcaacaggacctctggcgactacgctgatttgatgttcctctaaaagcgggagccattcctcagggcgtctgtcaaacaggctgaattgcatcataatgctgacgatgtttgatttttttacatattctttaatcacattcgggcggatggaagaaatgccgtagtagcggatgacaccttcttgttttaattcctcaaacgcttcaatcgtttcatcaatgttgtcctctatcgtgccgccgtggagctgataaaggtcgatataatctgttttcagacgtgtaaggctcttttttaccgcctcttttatgtaagcttttgaagggtcccaataccagccctcgcttccgtcatcccaacggtttcccgcttttgttgccagaataatatcatggcgtctgttttggatcgcatcaccgacaatttcttcattgcgtccccggtcatacaaatccgctgtgtccaaatagttgatgccaagctcgatcgcttcatccagaatggacaatgctttgtttttttcagttccaagagacatacagccgagtccgacttcgctaatgtctaaatcagatgtacccaatttgcgctttctcatgtgcacactccttttttaggctttgtattgaccgtaatataaaggagctaaagtttcaacttttatggctttgagatccaatctttcacatattgaaatgtgcgtccatactcttttaacttcgctcgaatttcccatgcttttccgactaagacaacaccttttggcatgcggtgcactttcacgaagaagcccccttttgctctagtatgataaaatgtatggggcatcatatagagacagaacgggagatgaagaaatgaaatcattagaagaaaaaacaattgccaaagaacagattttttcgggtaaagtcattgatctttatgtcgaggatgtagagctgccaaacggcaaagccagtaaacgtgaaattgtgaaacaccctggagctgtagcggtactagccgtcacagatgaagggaaaatcatcatggtcaaacaattccgtaagccgcttgagcggacgatcgttgaaattccggccggtaagcttgaaaaaggtgaggagccggagtatacggcacttcgggaacttgaagaggaaaccggttatacagcaaaaaaactgacaaaaataactgcgttttatacatcacccggatttgcagatgaaatcgttcacgtttttcttgctgaggagctttctgtgcttgaagaaaaacgggagcttgatgaggacgagtttgttgaagtgatggaggtgacgcttgaagatgcgctaaagctggttgaatcgcgtgaagtatatgatgctaaaacagcctacgcgattcagtatcttcagctgaaagaagcgctccaagcacaaaaatgaaaaagatttacgcggatttgcacattcatatcggccggacctttacaggaagggctgtcaaaataacaggcgccaaaacattaacgctggacagaattttggttgaagccagtgaacataaaggaattgaactcctcggcattatcgactgtcattctccggaagtcattctagagcttgaggaaggcatttcatctggaaaatatcgcgagcttgacgggggaggaatccgttatcgcagcacgactcttttattggggagcgagctggagatttatgatgaagcctgcagcggaccgatccatgtgctcgtatttatgccgacgctggctgatatgaaacagttttcaaactggctgtcagcccggctgaaaaatattcatttaagctcgcagcggatttatgaaacgggcttaaacctgcaaaaaaaagtgcaggatatgggcggcctgtttatccccgcccatatctttacgccgcataaaagcttatatggaaaaggggttaaatcaagcttaactgaggtttttgatccatctatgatagacgcggtggagcttggattaagctgtgatacagacatggcatcacacgtatcgcaattgaatccgtatccttttttaacaaattctgatgcgcattcgttggggaaaatcggcagagaatataatgaattatatgtgcagtcagctgattttactgaatttgctcttgcattaaagggacaagatgacaggaaaattatcgcaaattatggcttggacccgttattggggaaatattatcagacggcttgcgaagcgtgcggagagcctgctgtaagcggggaaacagcgtgcgcgaattgcggaaaagccagatttaccaagggagtcagcgatagattgcgtgaattgagtgatcagcttgaagttcgcgtcccgcgtccgcgatatgtacatcagatcccgctgcaatttgttccgggtgtaggcccgaaaacgctggacaaactaaaaaaagccttcggaacagaaatggctgttcttcatgaggctgcagaagaagatttggctcgcgttgtcccgccgaaaaccgcggcgcttatcgtaaaagcgagatccggaaaactggaattgaaagccggaggaggaggaacctacggtaaaattaaaccgtgagctaaagattaactcagttcctcctgtacttttctttttgtgcgtataaaggtaatcagctggatgatttcatcttcactcagcggctggccatcaacagaaatggtaaagtcgaggctgctccacgtggccaattctatggcctgaggagcagtctgcttttgtttctcgcggcctaaaagttcatcgcaggttgtgtcaaagaggtcagccagcatggcaagcgcttcaagtgaaggccgtcggtagcctgactcgtagccggcatatgtgctttttgcgataccgagaaggtcagctgtatattgaagcgaccaatttttctttttctcaattcagttaaacgatctagattcatgaacttccgctcctttttcaccttgagctgattatatcatataggtattaggaagtgtacgcgaattgaataataatgtcttgcgtattttattttccgtgtctataattgcattaaaagtatgcgaaaagcgaataccttctcgcaacccatctttagatacagtgaagaggtgcatggtatgaaaaaattattgatgttgacaactgggggaacgattgcttcagttgaaggggaaaatgggctggctcccggagtcaaggctgatgaattattaagttacgtatcaaaacttgataacgattacacaatggaaactcagtcgcttatgaatatagacagcaccaatatgcagcctgaatactgggtggaaatagcagaagccgttaaggaaaattatgatgcctatgacgggtttgttattactcacggtacagatacaatggcctatacatctgccgcactatcgtatatgctgcagcatgccaaaaagccgattgtcatcaccggctcgcagattccgatcacgttccaaaaaaccgatgccaaaaaaaatattacagatgccattcgatttgcctgtgaaggcgtgggcggcgtttatgttgtgtttgacggcagagtcattcagggaacgcgtgcgatcaaattaagaacgaaaagctacgacgcatttgaaagcatcaattacccatatatcgcttttatcaatgaagacgggatcgaatacaacaaacaagtaacggaacctgagaacgacaccttcacagttgacacttcactatgcacagatgtatgtctgctgaagctgcatccaggcttaaagcccgaaatgtttgatgccctgaaaagcatgtacaaaggaattgtcattgagagttatggcagcggaggagtgccgtttgaaggcagagacattttgtcaaaagtgaatgaactgatcgaaagcggcattgtcgtcgtcattacgactcaatgtcttgaagaaggcgaagacatgagcatttacgaggttggccgcagagtcaaccaagacttaattatccgatcaagaaatatgaacacagaagcaattgtgccaaaattgatgtgggcgctaggtcagtcttcggatcttcctgtcgtcaagagaattatggaaacgccgatagctgatgacgttgtcctgtaaaatgtaaaaacgataaccagcaaagagaaagaaggttaaagattatgttaaacggccaaaaagaatatcgcgtggaaaaagacttccttggggaaaaacaaattgaagcagatgtttattacggaattcagacgctccgtgcttctgaaaattttccgatcacaggatacaaaatccatgaggaaatgattaacgcactggcgattgtgaaaaaagctgcggctcttgccaacatggacgtgaaacggctgtatgaaggaattggccaagctatcgtacaagccgctgacgagattctggaaggcaagtggcacgatcagtttatcgtcgatccgattcagggcggtgccggaacttctatgaacatgaacgcgaatgaggttatcggaaaccgggcgcttgaaatcatgggacataaaaagggagattatatccatttaagtccaaacacacatgtgaacatgtcacagtctacgaacgatgtgttcccgactgctatccatatttccacattgaagctcttagaaaaactgctgaaaacaatggaagatatgcatagtgtgtttaagcaaaaagcacaggagtttgactctgttattaaaatgggccggacacaccttcaagatgcggttccgatccgtcttggccaggaattcgaagcttacagccgtgttctcgagcgtgatatcaaacgaatcaagcaatcgcgccagcacctgtatgaagtcaacatgggcgcaactgctgttggtacagggctgaacgctgatcctgaatatatcaaacaggtagtaaagcaccttgctgatattagcgggcttcctcttgtcggcgctgatcatcttgttgatgcgacacaaaatacagatgcctatacagaggtatcagcttcattaaaagtctgcatgatgaacatgtcgaagatcgcaaacgacctgcgcttaatggcgtcgggaccgcgcgccggacttgcggaaatttctctgcctgcacgtcagccgggttcatctattatgccggggaaagtcaatccggttatggcggagctgatcaaccaaattgcgttccaggttatcggaaatgacaatacaatctgccttgcttcagaagccggccagcttgagttgaacgtcatggagcccgtgcttgtctttaatttgcttcaatccatcagcatcatgaacaacggcttccgttcgttcactgacaactgcttaaaaggcattgaagccaacgaaaagcgtatgaagcaatacgtagaaaaaagcgcaggcgtgatcacagctgtcaatccgcatcttgggtatgaagcggcagctagaattgccagggaagcaattatgacagggcaatctgtccgggatctttgtctgcagcatgatgtgctgactgaagaagaattggatattattttaaacccatatgagatgaccaaaccaggtatcgcagggaaagaactattagaaaaataaaatttgtataaaatacagcttattcatctccgaatagtcggatgaataagctgtttacaacatagggatgaggaagtatagtatacgtgttgcactatatattgaaagcgttttagcttttacatgaagggggacttcttttgaaggatgtaagattgccaacactatttgaaattattattgtactaggagtatttttagcacttgttctatcgtttacagtctttctcgacttgccgatacagctggcgctttttgtttcatggtttattgcaatgcttttaggtattagactcggttattcttataaagatttacaaaatgcgattgtacatgggatatcaaatggccttgaagccgtactgattctcgtttcagttggggcgctcatcggaacatggattgccggaggcgttgtgccgactttgatttattacggactggaatttattcacccaagtatctttttactggcaacgttaattatttgttccattatgtctgtggcaacaggaacgtcatggggaacagtcggaactgccggcattgccatgatcgcaattggagaggggttaggcattccgcttcctctagtagcgggagctattctttcaggtgcttattttggggacaagctgtctccgctgtctgacagtacagttctagcttcttcactatcaaaagtcgatgtattggctcacgtgagagcaatgctttatttatcaatacctgcttatgtcattacagctatactctttacagttgttggatttatgtacggcgggaaaaatattgatcttgataaagttgaattcttaaaatcatctttgcaaaacacgtttgacattcatatttggatgctgatcccggcagttctcgtcatagtcttattggcgatgaaaaagccatctatgccagttatcgtaattggcgctttactcggtgcaatctgggctgttgttttccaaggaatggatattgcccatgcgattgcaactgcgtacaacggcttctctattaaaacggatgttgaatttttgaacggcttgttaaaccgcggtggaattgtcggtatgcttgattctctcgtcgtcatcatctttggccttggttttggcggtctgcttgagaaactcggcgtgttaaaagtcattgtttcaacgtttgaaaagaaattaacttcagccggcaatgtcacattgtctacactgatcgtagcgtttttagcaaacatcttcggctgtgcgatgtatgtatctcttattttgactccgaaaattatggaagacagctatgatcgcttacatctggacagaagagtgttatcacgtaactcagaggtcgggggaacattgacttcggggatggttccttggtctgataatgggatttacatggctggtattttaggtgtttctaccttctcttatctgccgtttatgtggctcagttttgtagcaataggtcttgcaattatctatggttatacaggaaaatttatatggtatacgaaaaacaatacagttaaagccgaaaaactaggctaataggggaggatcactgaatgatagcgaaacacatgattcggacactgatgatcgaaacgccttcggttcccggaaatcttggaagggtggctacggccatcggccttctgggcggggatattggtgaagtggagacggtaaaagtcggacccaattacacaatgcggaatattaccgttcaagtggagaatgaagaacagcttcaggaagtgatcgcggctgtacaggccctcggagaagggatcaggcttcacaccgtatctgatgaagtcctgtccgcacatgaaggcggaaaaatccaaatgaaaagcaaaatgccgatccgttcactggcagagctgggacgtgtctacacaccaggtgttgcggacgtgtgccgactgatcgaaaaagaacctgaaaaagcttctatttatacaacgatcagcaattctgttgcaattgtaacggatggaaccgcaattttaggccttgggaatatcggctctgtggctggcatgcctgtcatggaaggaaaggctgctttatttgatcagctggcgggtattagcggcattccgatactgcttgatacgagtgatcctgaagaaatcatcaaaacagtaaaacatatttctccgggctttagcggcatccttcttgaggatatcggttcgccgcattgttttgaaatcgaggatcgcctaaaagaggagctgaacatccctgttatgcacgatgaccagcatggtacagctgtagtgacgctggcagctgccatttcggcatgcaggagtgcgggggttgacctgaaggaagcgaaagtggggcaaatcggccttggcgcagcaggcgtggccatctgccggatgttcatggcttatggtgtgaatgctgtatacggaacagacaaatcagagtcagcaatgaaccgtctcgaacaatacggcggacaggcagtttccagtattgaggagcttatggaaacatgtgatattgtcattgctacaacgggcgttccgggtttaataaaaccggcatttgtacgttctggtcaagtgattctggctttatcgaatccgaagccggaaattgagccggaggccgcactgcaggctggcgccgcatatgcagctgacgggcgttctgttaataatgtactcggttttccagggatttttagaggagcgcttaacgcaaaaagcacggagattaatcatgatatgcttgtcgcagcagcagaggccatcgcagcttgcactaaacaaggtgatgttgtccctcagccgcttgattcaaaagtccatcatgcggtagcagcagctgtcgagcatgcagctcttacagcagtgaaataaatgtagctaaacagcacctgtcgtagcaggtgctgtttttttcttatcattgttcaattttgttatcattactatgaaaataaaaaagggagtgatcacatggcaaaaagccaagcgaaaaagaagcgggggcatcgattgagaaacggcggacgtgacgtcttattatcaagaggcagcacaccatctttcagcacacatggaagaatgacaaaaagcaaaaaagagattttgaataaacggaagcataagaatccttatgatcatacagcagttgatgataaggatttttttgtgccccaaaaagccgcctagcattcatctctattgtttctttttgaaaaagggcatgtttttctgtttctttcatacaatctattaaatcaaatcactagagcgggcgggaggaaacggtatgcgaaaaatctcttataaggacatgtttctcaggcatgtcaaagatcatctctctctttatatatttgtgtcagtgctgtttttcatgggtgtcatctttggcgcgattattgtcaacagtatgaccatcagccagaaagaagatttatactactacttaagtcaattttttggacagctttcggatggaaaacaggcaagttcagctgatatgtttgggcaaagtatctttcataatgcaaagtatttaggcctgatgtggatactgggaatttccgtcattgggatgccgattattttcattatgatctttctgaaagggatcgtcgtcggctttactgtcgggttcctagtcaatcagatgggagtaagcgggtttttcctatcatttgtctccgttttgccgcaaaatgtgctgctgattccggcttatctcattatgggcacatgtgcaattgcgttttctttaaagttaatcagacagctgttcgtgaaacgaagcctgcatgacgcgccgattcaatggttcgggcggtatgcctttgtgctgctggtcattctgtttttagcgctgatttcatctctctttgaagcatacttatctcctgttttaatggaaaagcttacatctagacttttttaaaatcattattaaaagaaaaccattttatttatcagtttataataattatagttggaactctgcgcgtattttgttataatgagtcatggaatgcggcgtaggagggaaagacatggaaaaccgtattgatcgtattaagaaacaactgcactcatccagctataaacttacgccacagcgtgaagcgacagtaagagtgctgcttgaaaacgaagaagaccatttaagcgcagaagatgtatacctcctcgtaaaagagaaatctcctgagatcggtctcgctacagtataccgtacgcttgaattattaactgaattaaaagtcgtagataaaattaactttggagacggtgtgtcccgttacgaccttcggaaagagggcgcagctcactttcatcaccacttggtgtgcatggagtgcggagccgttgatgaaattgaagaagatttgcttgaagacgtggaagaaatcattgaacgtgattggaaatttaagattaaagatcatagattgacgtttcacggcatttgccaccgctgtaacggaaaagaaactgaatagacggtgccgagcgcgaaccttttctcatggggaaagggttttttgctgtttctatgtataaaacctttctgatttggcatatggtttatataactggaaccatagggaaaggatcgattaggacatgggaagattcctgaaaacagctgtcgatgcattgaaagttttcatcctgtttaccggttttaccgctttgttctattatgctatgatatgggtgaatcaagagtatgaaaactatcatcggtatgataaaccggaaggctccgctgtaaaagttgttgaaatggatcaggatgaaaaaggcggatggttcgaccggttgatctttttttaccaaaacggggagtagatcaagagtgaaagatcaaataaaggatttcatccactacgttatggtagagagagggctctctcaaaatacgatcgtatcctatgaacgtgacttgaaaagctattctctctacttaacagaaacccttcatgttacagattggaatcacgttacccgcatacatattatccaatacttaaagcatttgaaggactcggggaaatccggcaagacatcggcgcggcatttggcatccattcgctcttttcatcaatttctgctcagggaaaaagtaacggataaggacccttccgttcatatcgaaacacaaaagacggaacgggcgcttccgaaggtgctcgcgctcaatgaagtcgagcggttattggacacgcctaagctgacgagccctttcggatatcgggataaagcaatgctggagctgctttatgcgacaggcatacgagtcagtgaaatgattgaattgaaaacggctgatgttcatttatctatggggtttatccgatgcttcggcaaaggaagaaaagaacggattgtgccaatcggtgaagccgctgcttccgccattgaggaatatatgacaaaagccaggggaaaactgttaaaaaataatgtatctgacgccctctttttaaatcatcacggcaaacagatcagccgccagggattttggaagaacctgaaaaaaatcgcattggaagccggcattaagaaagagctgactccgcatacactcaggcattcctttgcgacgcatctgcttgagaacggggcagatttaagagcggtgcaggaaatgctcggtcatgcggatatatccacgacgcaaatttatacgcatgtgacgaaaacaaggctgaaggatgtgtacaagcagtttcatccgcgagcatagccgcaggtggctgcggcttttttgtttagagcgacagaaaatattgaagtttctcattatttccaaatacattgtcaacgggaatgaaaacggtttatacttgagttgtcagacctcttagcgatacaatagacgtatagaaaaaaaggaggctttcaagatgcctgcatacaaatataatcgtgtgtttttaattgtgatggactcagtcggaatcggcgaagcgccggatgccgctgactttaatgacgaaggcgctcatacgctcggtcatattgccgagcatatgaacggattacatatgccgaatatggcaaagctcggccttggtcttatcgaagatatcaaaggtgtagaaaaaacagaacatccgcttgcctattatggaaaaatgcaagaagcgtcaaacggcaaagatacgatgaccggccattgggagattatgggtttatacattgataaaccgtttaaagtgttcccggaaggctttcctgatgaattgcttcaagagctggaaaagagatctggccgcaaaattattggaaacaagccggcttccggcacagcgattttggatgagcttggccaggagcacatggagacaggggctttaattgtttacacgtctgctgactctgttctgcaaattgccgctcacgaagaggttgtgccgcttgaggagctgtatcgcatttgcgaaacggcgagagagctgacgcttgatccgaaatatatggttggccgcattattgcacggccgttcgtcggagagccgggtcaattcaaacggacgccaaaccgccatgattatgcgctgaagccgtttgaccgcactgtcatgaatgaattgaaagactgcggcttagatgtgatttcaatcggtaaaatctctgatatttacgacggagaaggcattacttcttcacgcagaacggtttctaatatggacggaatggacaaggtgatcgatacgctgggagaagattttacgggtctgagctttgcgaaccttgttgattttgacgcgttattcggacaccgccgtgaccctgaaggctacggacgcgcgcttgaagaatttgatgcgcggcttccggaagtgtttgaaaaaatgagagaagacgatctgttaattattacagccgaccacggcaatgatccgattcatcatgggactgaccatacacgcgagtatgtgccgattctcgcttacagcaaaaaacataagaaagcgcaaatgctgccgcttgcagatacatttgccgatattggcgcaacgatcgctgataatttccaaacaaataaaccgaaatacgggaaaagctttttatctttattacaatagggggactgtttcttgaaggacagaattgaacgcgcagccgcttttattaaacaaaacctgccggaatctccaaagatcggccttattttaggctcaggtcttggcattttggcggacgaaatcgaaaatccggtcaagctgaaatatgaagatatacctgaattcccggtatctactgttgaagggcatgccggacagcttgtgcttggcactcttgaaggagtttccgtcattgcaatgcagggccgctttcatttttatgaaggctactcaatggagaaagtcacattccctgtacgcgtgatgaaagcgctcggtgtggaagcgttgatcgtgacaaatgccgcaggcggtgtcaacactgaattccgtgcgggagatttaatgattattaccgatcatatcaactttatgggaacaaacccgttaatcgggccaaacgaagcagatttcggcgccagatttccagatatgtcttcagcctatgacaaagatctgtccagcctggctgaaaagattgcgaaagaccttaatatcccaattcaaaaaggcgtgtacactgctgtgacaggaccttcttacgaaacaccggcagaagtccgtttcttaagaacgatgggctctgatgcagtcggcatgtctactgttccggaagtcattgtagcgaatcatgcgggaatgcgggttcttggcatttcctgcatctctaacgcggcagccggaattctggatcagcctttaagtcacgatgaagttatggaagtgaccgaaaagtaaaagctggattcttaaagcttgttaaagcgatcgtcgctcagtacgaataaatatgaatcaatgcaggaccaaaagacagctgtgtctgatatcacacagctgtctttttttatgcccaaaattcgaaacattttccatcagtggcgtataaaaccatcacgcttggaaaaaataaaaaggattatgaaatggagggcttttgagatgaaacgtcttttatccactttgttgattggtataatgctgcttacatttgcaccgtctgcatttgcaaaacaagacggaaaacgtacatcggagcttgctcatgaagcgaagtctgcggtgctgatagaacgtgacacgggaaaagtgctttacaacaagaacagcaatgagagactggcgcctgcaagcatgacgaaaattatgacgatgcttttgattatggaagctttagataaaggcaaaatcaaaatgagtgataaggtccgtacaagcgagcatgcggcgtcaatgggcggctcacagatattccttgagcccggcgaagaaatgactgtcaaagaaatgctgaaaggcatcgcaatcgcttcgggaaatgacgcttccgtcgccatggctgaatttatttccggctctgaagaagaatttgtgaagaaaatgaataaaaaagcaaaagagctgggattgaaaaatacatcctttaaaaacccaacaggactgaccgaggaaggacactacagctctgcttatgacatggcaatcatggctaaggaattattgaaatacgaatcaattacgaagtttaccggcacgtatgaagattatctgcgtgaaaatacagataaaaagttttggcttgtaaatacaaatagccttatcaaattttatcctggtgtagacggcgtaaaaacaggctatacaggcgaagcgaaatattgtctgactgcttcggctaaaaaaggaaacatgcgggccatagcggttgtattcggagcgagcacgcctaaagaaagaaacgcgcaagtgacaaaaatgcttgacttcgcctttagccaatatgaaacgcatcctttatataaacgaaatcaaacagtagcaaaagtaaaggtcaaaaaagggaaacaaaaatttatcgaactcactacatctgagccgatttcaatattgacgaaaaaaggcgaggatatgaacgatgtgaaaaaagaaatcaagatgaaggacaatattagtgctccgattcaaaaaggccaagagcttggcactcttgttctgaaaaaggatggagaagtactcgctgaaagtcctgttgctgcaaaagaagatatgaagaaagccgggtttatcacattcttaaagcggacgatgggagactggacaaaatttaagtaattatgccgaatgaccactagttttgtcacggtgaaggaattcattccgtcgaaatcgaaacactcattatccgatcatatcaaggaggaatgagcatgagccttggaattgacatgaatgtcaaagaatctgtgctttgtattcgattaacaggcgaactcgatcaccatacggctgaaaccctgaagcaaaaagtgactcaatcattggagaaggatgatattcgccatatcgtgctgaacttggaggacctttcctttatggacagctcggggcttggcgttattttaggaagatacaagcaaattaagcaaattggcggagaaatggttgtttgcgctatctctcctgcggtgaagcgattgtttgatatgtcgggtctgtttaaaattatccgatttgaacaatctgaacagcaggcactcctgacactgggggtggcatcatgaaaaatgaaatgcaccttgagttttctgccctcagtcagaatgaatcgttcgcccgtgtgacagttgcttcatttatagctcagctggacccgacaatggatgaactgactgaaatcaaaacagtcgtgtcagaggctgtcacgaatgcgattatccatggatatgaagagaactgtgaagggaaagtttacatttcagtgacgctggaagatcatgtcgtatatatgactattcgtgatgaaggcttaggcattacagatcttgaagaagcccgtcagcctctatttacgactaagcctgagcttgagcgctctggaatgggctttaccattatggaaaatttcatggatgatgtcagtatcgattcatcgcctgaaatgggaacaacgattcgcttaacaaagcacttatcaaaaagcaaagcgctttgtaattaaggagatttgttatggatgtggaggttaagaaaaacggcaaaaacgctcagctgaaggatcatgaagtaaaggaattaatcaaacaaagccaaaatggcgaccagcaggcaagagacctcctcatagaaaaaaacatgcgtcttgtttggtctgtcgtacagcggtttttaaacagaggatatgagcctgacgatctcttccagatcggctgcatcgggctgttaaaatctgttgacaaatttgatttaacctatgatgtgcgtttttcaacgtatgcagtgccgatgattatcggagaaatccaacgatttatccgtgatgacggaaccgtaaaggtatcacggtcattaaaagagcttggaaacaaaatccggcgcgcgaaggatgagctttcgaaaacactgggcagagtgccgacggtgcaggagatcgctgaccatttggagattgaagctgaggatgttgtactggcccaagaggcggtaagggctccatcttcgattcacgaaaccgtttatgaaaatgacggagatccgattaccctgcttgatcaaatcgctgacaactcagaagaaaaatggtttgacaaaattgcgctgaaagaagcgatcagcgatttggaggaaagggaaaaactaatcgtctatctcagatattataaagaccagacacagtccgaggtggctgagcggctcgggatctctcaggtgcaggtttccaggcttgaaaagaaaatattaaaacagatcaaggttcaaatggatcatacggatggctagtctgcagtgcaggctagcttttttgtgcaaaagcgtggtaatttatggtcttttcgagcggatgaatgagaacaaaatcgaaccacatactacatatataaccaccgaaagatggtgatcaatgatggaacgacgaatatttatccggcttcgccaccgagtgctggcacatccaggggatattattaccgttggagatgccgcgcaaatagaagggcagcttcagctgaaaaagaaactttcggctatgccgctttatcaggtgagcgaaaaagataaaaatatcgtaattctggatatcatacaagtcctcagagccattcatttacaagacccgacaattgatgttcaaaccgtaggcggagcagaaaccattgttgaaattcagtatcgaaagcgaaatttatcaacggttctatttatcggtgtctggctgcttctgtttattggatcgtgtcttgccatcatgaactttcatgaggatgtaagcatgagagatgttcatatcgcactatatgaaatcataaccggagagaggaatgactatccatatttgcttcaaatcccatacagcatcggtttgggactggggatgatcgtgttttttaaccacatatttaaaaagcgcctaaatgaagagcccagcccgctggaggttgagatgtttaactatcagcttgatctcgatcaatatgtggccatgcatgagaatcaagaaaccataaaggatctgcatgatcgttagtgtattgttcatcatttttgtcgggctcggcggaggcataacggtgggggcgggtttcgttgcttttttaaccgtaatgggaatcattccgcggctgatgcagctcaccaaaacaatgagatttgttcaggcttatgaagcggctgttattcttggcgcggtttgcgggggatgggagacgcttcatatgaatcatctttatctaacaaaatggatagctgtgccggtcgggcttctggcaggtttgttcgtcgggatgctagcggctgctcttacagaggttttaaatgtcctgccgattttggcgaaacgaatcgggctcagaagtaaaatcattattctgttaatggccatcgtgattgggaaaatcgcgggatctttatttcactggctgtactttattgaccattcataaggaggtttcaagatgacaaacataaaagaaaattacaaatcaaaagtgaaaacatatcagcctaagccgccttacgtctggaactgtgtaaaagcctttttagtgggcggactgatttgtgcaatcgggcaaggtctgcaaaatttttatatccatttttttgatttcaatgaaaaaactgcggggaatccaacagctgcaacgctgatattaatttctgccctgcttacagggtttggaatctatgacagaatcggacaattcgcaggcgcaggttcagccgtacctgtcacgggttttgccaacagtatggcaagtgcggctcttgaatataaaagcgaaggattagtgcttggagtagcgacaaatatgtttaaactggcaggaaatgttattgttttcggagttgtagctgcatacatcgttggaatgattcggtttgcttttgagaaactgatgtcataggaggagaagaaaatgaaattaacaggaaagcaaacctgggtatttgaacatcccatatttgtcaactcagcgggaacggcagcaggaccaaaggaaaaagacggaccgcttggctctttatttgataaaacctatgacgaaatgcattgtaatcaaaaaagctgggaaatggcggaacggcagctgatggaagacgctgttaatgttgcacttcaaaaaaacaatctgacaaaagatgatattgacctattgctggcaggcgacttgctgaaccaaaacgtgacggctaactatgtggcaagacacttgaaaatcccatttctttgtatgtttggcgcctgttcaacatcaatggaaacagtggctgtcgcatcagccttagttgatggagggtttgccaaaagggcactcgctgccaccagcagtcacaatgcaactgcggaaagacagtttcgctatccgacagaatacggaggccaaaaaccggacactgctacctccactgtaaccggaagcggtgcagttgtcatcagtcagacaccgggtgatatccaaatcacaagtgcgactgtcgggaaggtttctgatttaggaattacagatccttttgatatgggatcggctatggctccggctgcagctgatacgattaagcagcactttaaagatctcaaccggacagcggatgactatgatctaatcctgacaggtgacctgtcaggcgtcggttctccaatcgtaaaagacattttaaaagaagatggatatccagtcggcacaaagcatgatgattgcgggcttctgatttacactccggatcagcaggtctttgccggggggagcggctgtgcttgttcagcggttgtcacctactctcatatttttaagcagctgagagaaggaaaactaaaccgtgtatttgtcgtggcgaccggggcgctattaagcccgacgatgatccagcaaaaagaaaccatcccgactatcgcccacggggttgtatttgagcgtgcaggaggtgcatcttaatatggactaccttttggcttttgtctgcggcggggccatctgtatcgtcggccagctgctcttggatatttttaaattgacgccagctcatgtcatgacatcatttgttgtaatcggtgcaatattagatggtttcggcatttacgataaatttattgaatttgccggaggaggcgccaccgttccgatcgtcagcttcggtcacagtcttctgcacggcgccatgcatcaggcgcatatacacggatttatcggaatcggcatggggatttttgagctgacctcggccggtatctcagccgctattcttttcgcctttatcgtagctgttattttcaaaccgaaaggataatgccgacatgacgacaaaacgcaaggtcatactggtaacagacggggatgtttatgccgctaaaacaattgaatacgccgcaagcaaagtgggaggccgatgtatttcacaatcaaaagggaatccttccacccgcagcggcgccgagcttgtcaagctgatcgcctcagcaccgtatgatcctgtatttgtcatgtttgacgactccggccttcaaggagagggcccgggagaagccgctctaacctatgtcgcaacccatccgtctattgaagtgctcggtgtgattgcggtcgcgtcaaaaacacatcaggctgaatggaccagggtcgatgtaagcattgaccgcaatggagaaataactgaatacggcgtcgataaagtcggggaaagggaatttgatgaccacagaatgagtggagatacagtctattgccttgataaacttgatctcccgcttattgtcggtatcggggatatcggcaaaatgggcagaaaagacgatatctcaaaagggtcgccaatcaccatgaaagcggtcgagtttattttagaaaggagcgggtatcatgccggaccacaaggaagagaaaattcgggtttatcggaatccagctaaaaatgaagagtatttcaaaaaccgtgttgggatggggacgagctatgatgtaggtgttcgcaagctcacgattttagataaagagatccagctttactatctaaatggattatgcgatacagcctatattattcatttaatgagagagcttgttgccattaacaatcggaaagaagaccctgatgagctggtcgacatcgtcgaaaacaggctgcttaacgcccaggtcgaaaaagtaaaaaccttggatgaaaccaccgaccaagtgctgtccgggctcgtcgctgtcattgttgaaggtgcaggcttcgcatttataattgatgtcagaagctatccgggcagaaacccggaagaacctgatacggaaaaggtggtcaggggagccagagacggatttgttgaaaatatcgtcgtcaatacggcccttctcagaaggcggatcagagacgaacgccttcgagtcaagatgactaaagttggtgagcggtcaaagacggatttaagcatttgttatatagaagatatagctgatccggatctggttgagatcgtagaaaaagaaattgcatccattgatgtcgatggattaacaatggcagacaaaactgtcgaggaattcattgttaatcaaagctataatccttttccgctcgtgcgctatacagaaagaccggatgtggccgcaaatcatgttctagaaggccatgttatcattatagtggacacatcgccgagtgtgatcattaccccgacgactttatttcaccatgtgcagcatgctgaagaatataggcaggcgccttcagtcgggacctttttaagatgggtaagatttttcggtattcttgcttctactttatttcttccgatctggtttctctttgtgcttcagcctgatctgctcccggacaacatgaaatttatcggtttaaataaagatacgcatatcccgatcatcctgcagatatttttagctgacttaggaatcgagtttctcagaatggctgccattcacacaccgacggctttatcgacagcaatgggtttaattgccgctgttctgatcgggcagattgcgattgaggtcggccttttttctcctgaggtgattctgtacgtctcacttgcggcgattggaacctttacgacgcctagttatgaattaagcttggcaaacaaaatgagccgtcttgtcctcatgatactcgttgctttatttcatataaaagggctcgtcatcggatttacagtgctaattattgccatggcaagcatcaaatcccttcagacaccgtacttatggccgctgattccctttaacggaaaggcgctgtggcaggttcttgtccgcacagcgaaacctggcgcaaaagtaagacccagcatcgttcaccccaaaaatcgcttaaggcagcctaccaattcataatcgcattgaaactgactgaagagtatgataatgtatgtcttaattatgaagggacagtccataaaactgtcctttcatccataagcggagaaagagggaatgacattgttcttacacggcacaagcagacaaaatcaacatggtcatttagaaatcggaggtgtggatgctctctatttagcggagaaatatggtacacctctttacgtatatgatgtggctttaatacgtgagcgtgctaaaagctttaagcaggcgtttatttctgcagggctgaaagcacaggtggcatatgcgagcaaagcattctcatcagtcgcaatgattcagctcgctgaggaagagggactttctttagatgtcgtatccggaggagagctatatacggctgttgcagcaggctttccggcagaacgcatccactttcatggaaacaataagagcagggaagaactgcggatggcgcttgagcaccgcatcggctgcattgtggtggataatttctatgaaatcgcgcttcttgaagacctatgtaaagaaacgggtcactccatcgatgttcttcttcggatcacgcccggagtagaagcgcatacgcatgactacattacaacgggccaggaagattcaaagtttggtttcgatcttcataacggacaaactgaacgggccattgaacaagtattacaatcggaacacattcagctgctgggtgtccattgccatatcggctcgcaaatctttgatacggccggttttgtgttagcagcggaaaaaatcttcaaaaaactagacgaatggagagattcatattcatttgtatccaaggtgctgaatcttggaggaggtttcggcattcgttatacggaagatgatgaaccgcttcatgccactgaatacgttgaaaaaattatcgaagctgtgaaagaaaatgcttcccgttacggttttgacattccggaaatttggatcgaaccgggccgttctctcgtgggagacgcaggcacaactctttatacggttggctctcaaaaagaagtgccgggtgtccgccaatatgtggctgtagacggaggcatgaacgacaatattcgtcctgcgctttaccaagctaaatatgaagctgcggcagccaacaggatcggagaagcgcatgacaaaacggtatcaattgccggaaagtgctgtgaaagcggagatatgctgatttgggatattgacctgccggaagtaaaagaaggcgatcttcttgccgttttttgtacaggcgcttatggatacagcatggccaacaattataaccgtattccgagacccgccgttgtatttgtcgaaaacggtgaggctcatttagtcgtgaagcgagaaacatacgaagatattgtaaaacttgatctgccatttaaaacgggtgtaaagcaataaaagaaagcgccgatttttcggcgcttttcttatttgaatatagatacaatcgcattccagatagatacgaagaaatcaatgactttctggatgaagtttttgccttcatctgattctatgaatttcgtaatcttatctttcgctttatctagctggtcactgacctgtccccagtcaatgtcagcgtttttcatcttattgaatagggagacaagctgattcttttggctgtctgtaagtgtgacgtttaaatcagaagctgcgtcatccacttgtttttcgatgtcagctttattatcaggcaccccgtttttagcaaactcttctttgatttttgcaatcagggctgccgcattttcgttaccgattttgtctccaagctctgatgtcgtgacaagctcttggttggcgacctgcttaacatcctccgagatcgcttcgtcagaagaaacttcatacgccttaatcaatccagttaaagcggcagtcccggatacttcaaacggtgctgtaacatacaccttcgcatctttaacaccggctgtcatcagtgcattcaggtacatttcatctgtgatgccgctgatattatgggtctcaacattcaatccggagccttttttggcaatggtgattgacgatgaagaaatcgctctcgatccgatttgcgcgttcgatatatattttcctaaatattcatgttcttccttattggtcacggttaccgttgtggcattatcagggacattcatttcatcaagcactttttgtttgtcagattctgacaaatcagcacccagtgttacaatgacatctccaactgcggcatccgcgagactgaccttcggaaccatcagcagcaaaacggccgctgccagcattccaatccaaattttcttcaaagcagtttgacctccttcaatttcacaagcagctggatagtgctgctttgtgaggacctgaatcatgaaaaatacagttccgttaggttagacggagataaagagattcaggtttcatttttattttttagtaaagctcgggagattcgttttcccccgaaaggtgtggtataatagccgcgacaaggagagacaggctataacctatacataatctcctttgaaaattaaaataaagaaagtaggcatacaattgaaaacaggttactttttattagaagacgggaacaaaattgaatttgaactttatcctgaagctgcacctggaactgttgcaaactttgaaaagcttgcgaacgaaggcttttatgacgggcttacattccaccgagtgatccctggcttcgtcagccaaggcggatgcccgcacggaactggtacaggcggtccgggatacacaatcaaatgtgaaacagaaggcaacccgcatacacatgaggcgggcgcactttctatggcacatgccggaaaagacactggcggcagccaatttttcatcgttcatgagccacagcctcatttgaacggtgttcacactgtatttggtaaagtaacaagcggattagaattcgcgaaaaacatgtctaatggcgatgtcatgaaagaagttcgtgtagaaggctaatcggcaggcaaaaggcttcctcttagagaggaagctttttttattggccaaaaatgttcaataaaaaaccgccgaatgctgatggcggttggcaaaaccaggtgtttagttagtgacccccgtgtattgaatacattaaaaagttttggtgacgttttgatcagtaaattgatgattaatcattttagctttgcttacaaagttattttcaaagacaattcctgtgtttaaacctccggagccaaacacagatttggacaaagttaaaggcctgatcataaaagcgccgcctacgttaattacactgttcccggaaacgttgtttatattaataggataatcaatcatactatcaagtctcctttcatatcattctattttttatatgtattagtgctagagttgattagcgtaaacttatcggcaaaaatatttaggagatgcctgtttttattgatttataaaaatgctcgaaaaaagagcctcctttaaagcttccggaagcccagatatctgtctattcttttaactactctgaatgcggcagctgcttttctggcgaatgtaataggatcatcctgtgctgactcaaagtgcatatacattgctcacggctcactaaataaccagtggttatgcaatgtagaaatcgccatacgccgctatcctagttcggtgagcaaagaatttacctcttcatgtaagaaactaagtgaaatactttaccatttcgaacctcaaacgggaaaaatggggaattgacaagggatgaggtgggcaaacaaacacctgactcggtggcagaacgaactgcccaaaattttggcaaactccctgcgtatcttttgtttcctcccatttcatgctattgctcctcctatgtcaaaaaagaatgtatgagagaagatcccgccatagacaatgttgttggacgactgaagataaaattgtgctgattatacaaaaagtggattgggaatgataaaagaacaaaaaagtttaaggagaatcacatgcaagttttgacggggttgctcgaacagtacggatatgccgtcttgtttattgtcttgatgttagagcttctagctttacttggaccgggagagtttgccggtgttctcgtgtttcaagaaaagttaaactgggtgctaagcatgttagcggccggattggggagctgtgggagtgagcatgtcgtattggatcgggtatagactgggcccagctgcaattcagaaagcttttgcgtcgagaggtgttctgttagccgttattgttctaacttttttttggacggtattcagagggcaagatcggaaaatcgaactctctttcttatttttcctagtcattggtggggagctttatgaagagggaatcagacggctctttcattcccttcatcctgttcacgctcctttggaaagtcatgtattatatccattcccgagcgaacagactttaacggcatttgtcatttttggtttttgtgcttatctttttgttcgtcattctcacaagacgcgtctgcaaactgttgcatttttttgtttattatcgttttattcctcatcgggctgagccgtgtgtactttatgagcagtatccgagtgatgttgctgcgggttacgccttcggcggtgtttggctgagtttgaatgttttggtcatggagcttttccgtttctccagaagatttaccaagctgagaaacgaacccaattagtatgtaatcaaaattaagtaaactttaaagtagtacgggtcattgggattgatattttgtagtaaaataaatcaaacaaacgtgatgtaatgaaaaggagatcgcgatatgaacaacaaaggctgtataaaatgcggtagtactgaagccggacaaaaagaaatagctacaaccggcacgggattatcaaagctgtttgacgtgcagcataaccgatttctagtggtttactgtaagaactgcggatattcagagttttataataaagagtcttcaactgccgggaatatattggatttattttttggaggctgatccatgttttcgagcttgaatgattttaaacatattatgaaagcaaaaaacggggtgcggttatcacctgtgaaataggttgccgcaaacattccagtaaccttcatgacgttaattgttttgtcaagtgccatgggtatcatggactgggagatcaatggaatgcagtaaatgaacaaactgcccgtaacctcatgctttatatacgatctaaagattttgcatatgagaactctctttcttctgagtccatcgcttctgaattatgcgattcatttctttcaatattttcaggcctagttatgatcgacaagaaaaaataggcatgatgtgggtagaagatgaagattaacagtttgtaaaatcacttcaatggtcctaatgggattttttttcgattcgtgataacataaattgaagaccgttgtttattggaggaaatcagttgaaatcagaaaatgtttcgaagaaaaagtcaatattagaatgggcaaaagcaattgtgattgctgtcgttcttgctttgctcatccgcaactttatttttgcgccgtatgtcgttgatggtgactctatgtatcctacacttcacaaccgtgaaagggtttttgttaatatgacagtcaaatacatcggcgagtttgatagaggagacatcgtcgtgttaaacggagatgatgttcactatgtcaaacgtattatcggccttcccggcgatacggttgagatgaaaaatgaccagctctatatcaacgggaaaaaggtggacgaaccttatttggcggctaataaaaagagagcgaaacaggacggttttgaccatttgaccgatgatttcggcccggttaaagtgcctgataacaagtattttgtgatgggtgacaatcgtcgcaattccatggacagccgtaacggccttggcctcttcacgaaaaaacaaattgcgggtacgtcaaagtttgttttctacccgtttaacgaaatgcgcaaaacaaattaggatcaagcagcttcccattggggctgctttttttatatcttttttacggtcatcccctaaaaacagaacataaattcgtatatctatagaaaagaaatttttgcagaaatgtgaaacatattcccgttatgcatcgttatattaataatttacgagaatttacggtttttattcatgaaaaaaaggaataactcatatgaatgaatagattcatattggctggaggtttagaaatgggaagaataaaaaccaagattaccattctgttagtgcttttgcttttacttgcaggcggttatatgtacataaatgatattgagctgaaggatgttccgacagcaattggacaaaccttgtcctcggaagaagaggaatacaccatccaggaatataaagtgacgaaaattgacggctcagagtatcatggagtagcagaaaacggaacgaaaatcatcttcaacggaaaaaattaaatcaggatttatctgatataaaagaaggtgacaagattaaggcttacttcagcaaatcaaagcggatcgacggattaatcaaggttgcaaaagtgaatgattaaaaaacatcacctttcggatcgaagggtgatgttttgtttttctcaaattgtaagtttatttcattgcgtactttaaaaaggatcgctataataaccaataaggacaaatgaataaagattgtatccttcggggcagggtggaaatcccgaccggcggtagtaaagcacatttgctttagagcccgtgacccgtgtgcataagcacgcggtggattcagtttaagctgaagccgacagtgaaagtctggatgggagaaggatgatgagccgctatgcaaaatgtttaaaaatgcatagtgttatttcctattgcgtaaaatacctaaagccccgaattttttataaattcggggcttttttgacggtaaataacaaaagaggggagggaaacaaatggaagagtattatatgaagctggccttagatcttgcgaagcagggcgaaggacagaccgaatccaatccgctcgtcggcgctgttgtcgtaaaggacggacaaattgtcggaatgggcgcccatttaaaatatggtgaagctcatgcagaagttcatgccatccatatggctggagcacatgcagagggtgccgacatttacgttacactcgaaccgtgcagccattacggaaaaacaccgccatgtgcagaattgattatcaactctggtatcaaaagagtgttcgtggcgatgagagatcctaatccgcttgtggctggaagagggatcagcatgatgaaagaagctggcattgaggtaagggaaggcatcctggcagaccaggcggagaggctgaatgaaaaatttctgcactttatgaggacaggccttccgtacgtcacgctaaaagcggctgccagccttgacggcaagatagctaccagcacgggtgacagcaaatggatcacgtcagaggctgcaagacaggatgctcagcaatacaggaaaacacaccaaagcattttagtcggagttggcacagtgaaagccgacaatccgagcttaacctgcagactgccgaatgtaacaaaacagccggttcgggtcatacttgataccgtactctcgattcctgaggacgctaaagtgatttgcgatcaaatagcgccgacatggatttttacgacggcacgcgcagacgaggaaaagaaaaaacggctttcagctttcggagtgaacatatttacacttgaaaccgagcgcattcaaattcctgatgttttgaagatcctagcggaagaaggcatcatgtcggtgtatgtggaaggcggttcagctgttcacggaagctttgtcaaagaaggctgttttcaagaaatcatcttctattttgcccctaaactaatcggaggaacgcatgctcccagcttaatctccggtgaaggttttcaatcaatgaaagatgtccccttattacaattcactgatataacccaaatcggccgtgatatcaaactgacggcaaaaccgacaaaggaataggatggtgaccatgtttacaggaattatcgaagaaacaggcacaatcgaatccatgaaaaaagcagggcatgcaatggccttaactattaaatgctcaaagattttagaggatgttcatcttggcgacagcattgcagtgaacggcatttgtctgactgtcactgattttacaaaaaatcaattcacagtggatgttatgcctgaaacagtcaaagctacgtcactgaatgatttaacaaaaggaagcaaagtaaatctggaaagagcgatggcggcaaacggccgtttcggaggccatttcgtctcaggccatgtcgacggaactgcggaaatcacacgaattgaagagaaaagcaacgcagtttactatgatttaaaaatggacccgtcattaacaaaaacattggttttaaagggatcaattactgtggatggcgtgagcttaaccatattcggcctgacagaagacacagtgacgatctccttaataccgcatacgatcagcgaaacgatcttttcagaaaaaacgatcggctctaaagtgaatatcgaatgcgatatgatcggaaaatatatgtatcgatttttgcataaagccaatgaaaataagacccaacaaaccattacaaaagccttcttaagcgaaaacggcttttagagaggaagatttgcatgtttcatccgatagaagaagcactggacgctttaaaaaaaggcgaagtcatcatcgttgtagatgatgaagacagagaaaatgaaggagactttgtggctcttgccgagcatgcaacgccggaagtcattaactttatggcgacacatgggagaggactgatctgcacgccgctcagtgaggaaatcgcagacaggcttgatcttcaccctatggttgagcataatacagactctcaccacactgcatttaccgtaagcatagaccatcgtgaaacgaagacaggtatcagcgctcaagaaagatcttttaccgttcaagcattgctggacagcaaatccgtgccatctgattttcagcgtccggggcacatttttccactgattgcgaaaaaaggaggtgtcctgaaaagagcgggccatacagaagctgctgttgatcttgctgaagcttgcggatctccaggagccggcgtcatttgtgaaattatgaatgaagacggaacgatggcgagagtgcctgagctcattgaaattgcgaaaaagcatcaattaaaaatgatcaccattaaggatttgattcaataccgttacaatctgacaacacttgtcgagcgtgaagttgacattacgctgcctactgattttgggacatttaaggtttatggatacacaaatgaggtagatggaaaagagcatgtcgcatttgtgatgggagatgtgccgttcggagaagaaccggtattggtccgggtgcattcagaatgtctcacaggtgacgtgtttggctctcatcgctgtgattgcggaccgcagctgcacgccgcgctgaaccaaattgccgcagaaggccgtggagtgctcctgtacttgcgccaagaaggacgaggcatcggtttaatcaataaattaaaagcttataagcttcaggaacaaggctatgacaccgtagaagccaatgaggcgcttggattcttgccggatcttcgcaactatggcatcggagcacaaattttacgcgacctcggtgtccggaatatgaagcttttgacgaataatccgcgaaaaatcgcaggccttgaaggctacggactcagtatttcagaaagagtgccgcttcaaatggaggcgaaagaacacaataaaaaatatttgcaaaccaaaatgaacaagctaggtcatttacttcatttctaatcacaaatatcacaaaaaaggatgggaatcatatgaatatcatacaaggaaatttagttggtacaggtcttaaaatcggaatcgtagtaggaagatttaatgattttattacgagcaagctgctgagcggagcagaagatgcgctgctcagacatggcgtagacacaaatgacattgatgtggcttgggttccaggcgcatttgaaataccgtttgctgcgaaaaaaatggcggaaacaaaaaaatatgatgctattatcacattgggcactgtcatcagaggcgcaacgacacattacgattatgtctgcaatgaagctgcaaaaggcatcgcgcaagcagcaaacactactggtgtacctgtcatctttggaattgtaacaactgaaaacatcgaacaggctatcgagcgtgccggcacaaaagcgggcaacaaaggtgtagattgtgctgtttctgccattgaaatggcaaatttaaaccgctcatttgaataatttgctgaaaacagtttaaaaatatggcgaaaatgatataatgtgagaaaacggatcacctattcgtatccgttaatagcagactggacattttggatatagaggggtttttatgttaattcgttataaaaaatcgtttgaaaagattgcgatggggcttctttcgtttatgccgaatgaaaaagaccttaagcagcttcagcagacaattaaggactacgaaacggatacagaccgccagctctttctttggaaagaggacgaggatatcgtcggagcaatcggagtcgaaaaaaaggattctgaggttgagatccggcatatcagtgtgaatccttctcatcgccatcaaggaatcggaaaacagatgatggatgctttaaagcatttattcaaaacgcaagtactggttccaaatgaattaacgcagagctttttcgaacgttgtcaaggtcagcaggatcaagacatttcatacaataattaagcagaggctgtgatcagtctctgcttttttttctgcgttctatttctttttcacgttcacggatgacgtcagtccgatcccgcaaacggtgtttgtcgataagaaatatgttgctgagtgcactgggctgcccccatgtatacttttttttcctgcattcgatcctgcatgcttcctccagtttctcatctttgattggcagtataatgcttttataggcagagacggtttcgatttgttcgtaaaccgattgcataagttcgagcaaacggccatgatcaagccctaagtcttcgactgcccggtgttctgcttgaagaatccggatgctgttcgccatcagtctttttgccccggctgtattctgccttctgtgatgatataaagccactgcaagctgaataaagcccacccaatagcgttttcgtttctttggcggatcttccttccaatattcttctaatatttcatggcattcaaaataatcccgtgtcgcatgaaactcaacgagataatctatataagctttcggatacaaggtgcttcctcctttaatgtgcttttagtgtaccatagaagggataaaaggaaaaaagaacgcccggcctctagtgcttcttagaaaggaaaaccagaagcaaaggctttttctcccgcttctgcgctccgagcaaacacctcttgtgttttgaatattctgtacaaactccttcaaaacaggatatgaaatagtattggacgagagctttttggtggcttatactatagggtagccagtttttccggcaatgagagtgatacttgaaaatggtgagatgatggaagaatatcaagtgaaaattgatacgtttgagggcccattggacctgctgcttcatttaatcaatcgtcttgaaattgacatatatgatatacctgtggcgaagatcactgaacaatatttattatatgtacatacgatgcgcgtgcttgagctcgacattgccagcgagtatttggttatggctgccacgctgctcagcattaaaagcagaatgctgctcccgaagcaagaggaggagctttttgaagatgaattacttgaagaagaagatccgcgggaggaactgattgaaaagctgattgagtaccgaaaatataaagatgcggcgaaggatttaaaagaacgggaagaagaaagacaaaaatcgttcacgaaaccgccgagtgatttgagtgaatatgcaaaagaagtaaaacagtctgagcaaaagctctctgtcacggtctatgatatgatcggagcttttcaaaaagtgctgaaacgcaaaaaaataaacaggccgatggaaacaacaattacaagacaggacataccaatcgaagccagaatgaacgaaatcgtgcacagcttgaaatctagaggaacgagaattaactttatggatctgtttccatatgagcaaaaagaacatttagtagtgacctttctagctgttcttgagctgatgaaaaatcagctggtcctcattgaacaggagcacaatttttcagatatttacattacggggagtgaatccattcatggggcttgatatcgtgaattggaaagctattgtggaagcccttctttatgcggcaggcgatgaagggcttacaaaaaagcagctgttaacagtgcttgaaatcgaagagcctgaactgaacacgatcatggcggatgtggcggacgaataccgcggagatacacgagggattgaacttattgagtatgcagatacgtacatgctctctaccaaaaaagactttgcgccttacttgaaaaaactgattgaagtgccgtcaaagggcctttctcaagcatctttagaagtactggccattgtttcatacaaacagccaattacgagagcagaaattgaagaaatcagaggagtaaaatcagagcggattttacacagtcttgtcgcgaaggcgctattgtgtgaagtagggcgtgccgatggtccggggcgggccattttatacggtactacgccgacttttcttgaacaattcggtctgaaaacgctggacgagcttccgccgctgcctgaaaatgcggaagaagacgttcttcaagaagaagcagatttattttttgaaaactttaaccaaaccttcgaagatataaaatagaagtttaatgaatcgcgctttttcatcatcataagatataaggaagaagctatcatgaaagaagcaaaatgtgagagacaaatacatgaggggaagataccaaacgaaatgggacattcgattgtgcgagcgcagactcaaaaaacaggcgaattcttatcaatggttgtcaataccgtgaacgattacctaaatcaaacgacgcttgagtccttacaggctgaattgcctattgaaaaaggatactgctgtgatgtgcttagcactctgagaagaatggcagtattttgtgaaggaggcgcagaagcgtgccgtcgtctcctgatgcaggagccttttcaggaagccagagcggaaaaaacactttataatgtgtatcaccaatgcattgaagagttctttatgccgaaaaaagacacgtggtgtgaaaatagccgggcgtcttataccggggtcagcgcaattgagttttatcatgctgttcctgcgtcgcttgagcaattattattgccgttgagcgcggcctttctgaagatgagggaagagctggctcattacgaagcgtccggatcaagcatggcgccaatcagataacgtttactctccctttttcagggtagagtttttttatgtttgcttccagaaatataattgttattcataactgatggacatgcgcataaacttgtacaaaccaccacaaggacgtgagcaaacatgcgcattttcaaaaaagcagtattcgtgatcatgatttcttttcttattgcaaccgtaaatgtgaatacagcacatgctgctatagatgtcagtgcaaaaagcgcgatcattattgacggtgcgtcaggcagagtgttatatgccaaggatgagcatcaaaaaaggcggatcgcgagcatcacaaaaattatgaccgccgtcctcgccatcgaatccggcaaaatggatcaaacagtgacggtttcggcaaatgctgtcagaacagaaggctccgccatttatttaacagaaggtcaaaaagtgaagctgaaagatcttgtgtatggcctgatgctaagatcaggaaacgatgccgctgtcgcgattgctgagcatgtcggtgggagcctcgatgggtttgtttatatgatgaatcaaaaagccgagcagcttggtatgaaaaacacccgttttcaaaacccgcacggattggacgaccatgaaaatcattattcaacagcctatgacatggccattttaactaagtatgctatgaagctgaaagactatcaaaagatttcaggcacaaaaatatacaaagcggaaacgatggaaagcgtatggaaaaacaaaaacaaactgctgaccatgctttatccgtacagcacaggaggaaaaacaggctatacaaaacttgcaaaacggacactggtctctacggcttcaaaggacggcattgacctgatagccgtcaccattaatgaccctaatgattgggatgaccatatgaagatgtttaactatgtgtttgagcattatcaaacctatttaattgcaaaaaaaggggatattccaaagctgaaaggcacattttatgaatcgaaggcttttatcaaacgtgatatcacctatttgctgaccgaagaggaaaaagaaaatgtaaaaattaataccacactgctcaagccgaaaaaagcatgggaaaaagatgcctcgaaaatccctgacatcgtagggcacatggagatcatgttcaacgatgcaaccatcgcaaaagtgccgatctattatgaaaatgagcggcatcaaaaaccgaagaaacaattttttgaaacgtttaaatcaatctttctgaatgcggcaggcggagcaaaatggtcaatataatttgggtcagtttaaccgtgatcggactcgtttttgcgatgtgcaacggaactctgcaagatgtaaatgaagccgtgtttaagggtgcgaaagaagcgattacgatctcatttggattgatgagcgtgcttgttttctggcttggcttaatgaaaatcgccgagcagtcagggcttttggatattttcagccggatgtgcagaccttttatatctaaactgttccctgatataccgccggatcacccggcgatgggctatattttatctaatcttatggcgaatttcttcggcctcggaaatgcagcaactccgcttggcattaaagcaatggaacaaatgaaaaagctgaacggaaaccgatcggaagcaagccggtcgatgattacttttttagctgttaatacgtcctgcatcacactcatcccgacaacggtgatcgctgtccgaatggcttattcctccaaaacgccgacagatatcgtcgggccaagcattttggcaacgcttatttccggaatcggtgccattatcattgatcggtatttttattaccgccgcaaaaagaagggaaggtgagcggatggaaatcatcaactggctgtctttagccatgattccaatcattattgccggaattcttctttatggaacgatcaaaaaggttccgacatatgaatcgtttgtcgaaggcgggaaagaggggatagaaattgccttttccattatcccctatttagtcggaatgcttgtcgctataactgttttcagatcatcaggcgcgcttgattttataatggatcttttaaaaccggctttctccgctatcggcatccctgctgaagtagtgccgcttgctctgatccgcccgatctccggtacggccgcacttggaatgacgaccgatttaattgcagtatacgggcccgattcctttatcggcaggctggcttccgtcatgcagggatctacagatacaacgctttacgtactgactgtgtatttcggagcagtcggcattaaaaaaatgggtgatgcattaaaggtgggacttcttgcagatttaatcggcgtagttgcatctatcatcatcgttacgttattatttgggagcgcctgaaaacggcgttttttttagatttggcataggaatttgaaaaagcttgtttgttaaggttgaaaaaagtaagataatacttgaggtgaaagacatggaaagactgcaaaaagtgattgctcatgccggagttgcgtcgcgcagaaaggcagaagagctgattaaagaaggaaaagtaaaggtgaatggcaaagtagtaacagagctaggtgttaaggtcaccggttctgatcagattgaggtaaacgggttaaaggttgaacgcgaagagccggtttactttctcttatataaaccaagaggcgttatttccgcagcgcaagatgataaaggacgcaaagtggtgacggacttttttaaaaatattccgcagcgcatttatccgattgggcgtctggactatgatacgagcggtcttttgcttttaaccaatgacggcgaattcgccaataagctaatgcatcctaagtatgaaatagacaaaacatacgtggcgaaggtgaaaggaatcccgcctaaagagctgctcagaaagctggagcgcggaattaggctggaggaaggcaaaacagcgcctgctaaagcgaagctgctgtctttggataagaaaaagcagacaagcattattcagctgacgatccatgagggacgcaacagacaggtgcgccgcatgtttgaagcgatcggacatgaggtaatcaagctgaagcgtgaggaatacgcgtttttaaacctgcgaggcctgcacacgggcgatgccagagagcttacgcctcacgaagtaaaaaggctcagagcactggcggatcacggtaaaaacgctttctaaatttcacataaccttcaaaaagtaagaaatgtgaaatgaacgtgcaatgatataattgaatggatctgcaatagggggaagggggcagtggacaatgaagaaaaaaaggcgtttattcattcggaccggcatccttctcgttttaatctgcgcactcggctataccatttacaacgctgtatttgccggcaaagagagtatatccgaagggtccgacgcaccgaattttgtcctagaggatacgaatgggaaacgtatcgagctcagtgacttaaaagggaaaggtgtttttttgaatttctggggtacatggtgtgaaccgtgcaaaaaagagtttccttatatggcaaaccaatataagcattttaaaagccaaggtgttgaaattgtcgctgtaaatgttggggagtcaaagatagcagtacataattttatgaaatcctacggagtcaatttcccggttgttctggatacagatcgccaagtgcttgatgcctatgacgtatctccgcttccgacaacctttttgatcaatccggaaggaaaagttgtcaaggtggtgaccggcactatgacagaaagcatgatacacgattatatgaatctcataaaacccggagagacttcgggatgaagcaagtcaaatgtgaatgcggacatataaacccggtcggaaccgttttatgcgaatcgtgcggaagagctcttcaggaaactcaacctccgctcgctgatatgagatatgacggaagcgcaagacgttcgcaaacctataacaaaacgatcatcgacaaaatttggaatttcttttcctcggttaaggtgggaatatggcttatcgtcataacccttgccgcatcagcgttcggcaccatttttccccaggaagcctatctgcctccgggcgcacaggctgatacttattacaaggagcagtacggcacgtttggccagctttattatttgctcgggtttcatcatttatatggttcttggtggtatttgctgctcattgcctcgatcggcatttcactcgtgatttgcagccttgatcgggtcattccgttgtatagagcgttaaaaaaccaaggtgtcagaaggagcccggcctttttaagaaggcagcgcttgttcagtgaaacagttactgtactgaacggggaatcgaaagaaaagatagttactctattaaagaaaaaacattatagaatcagagaaaaagagggcagcattcttgctgaaaaaggacgcttttcccgctggggcccgtatgtcaaccacattggattgatcatctttctgattggtgcgatgctgagatttgtgcctggcatgtacgtcgatgagacgctttgggtcagagaaggcgaaaccgcagcaattccgggtacagacggaaaatattatttgaaaaacaatcaattcagcgtagagacctataacagcaaaacggaaaaaaaggtatttgcagatgccattgacagagtcggggacggtagagtggcaaagaactttcaaactgatgccgtactctacaagagagaaggaaaaattgtttatggcgagaagccgaagctggaaaaagtaacagaagaagacatccgtgtcaatcagccgctgcgttttgattctttttccgtttaccaggtggattacaaagagaatcagcttgaccaaatggtgttccagctgattgataaaaaacaaaaaatcctttgggagcctgaagatcaaccttctggatccagattcagtctatgatcttggtaacggttacaaggtggaaatcgccagctacctgcctgacttctattttaatcaggacggagagccgagcacaaaaacaaagatccctaacaatccggcttttgtctttaatatcataacgccggacaaaccgaaaggcgaaaagagctttgtcgccatccaagaaaccatcgaaggatcaggcaataataaatacaagctgaaatttgaccatgtcgaaacgaaaaacattactggacttacagtcagaaaggatctgacactctgggtgcttgctgtcggcggagccatttttatgatcggtgtcattcaaggtatgtactggcagcatcgaagaatttggctgcactcacaggacggtgcagttatggtagcagggcataccaataaaaactggtttggcctgaagaaggatttagcatttatattggctgattccggactgactgaaccggtggaccaaaaagaattaatcaaaacacagaaataggcgaaaagggagtgatgtcatggcagagctgagcggaaattttctttatgcggcctttcttgtgtatttaatcgctgtcccaatcttcggcggggccatacgcgggaataaagataaaaagggcaggccaaaccgatgggccaacattggaatcaccctttctattgtcggttttttctgccacctaggatatttcatcacaaggtgggctgcaagcggccatgcgcctgtcagcaatatgtttgaattcaccaccgcttttggcatgatgcttgttttggcgtttatcattctttattttctctatagattgccttcattaggcctgtttacgctgtcaattgctttattgctgattgcctacgccagcatgtttccgacagatatctcgcctttaattccttcgctccaaagtaactggctgtatattcacgtaacaacggccgcgcttgggcaagctatacttgccatcagctttgtcgctggtgtcatctttcttttgaagcatgtagaccagacaaagccaagcaaaaagaccttctggcttgaagcgattatgtttatcctggtcacaaccgtcgcctttattgcaatcacatcggcatttcgtcttgcaggctatgaagcggagtttaactgggtggacaaaagtaaagaaaaaagcgtgatggtgtacgaaatgcccgcgcttgtcggtccgcatcagggagagcttttgaccgaaggaagaatggaaccgcttgttgatcttcccgcgcttttctcaggcagaaaagtgaacactgtcatttggtcatttggagcaggtcttgtgttgtatggggctctccgtctgatcatcagaaaaagaatcagcgctctattacatccgctggtgaaaaacgtcaatcttgatctggtggatgaggttgggtacagggccgtatcaatcggatttccgatctttacactcggcgcgctgatctttgcaatgatttgggctcagctcgcgtggaccagattttggggctgggaccctaaggaagtatgggcgctgatcacatttttgttctatgccgcttacttgcatttaagactgtcaagaggctggcacggtgagaagtcagcatggctggccgtaatcggttttgctattattatgtttaatttaatattcgtaaatcttgtgcttgccggacttcattcttatgcatagtcctttgaaagcgacacagttctcaaactttctcacgatttgataaaatgaaagtaacagaaggaaagcagggggaaaacatggaccaaacgaacgaaacaaaaatattagtagttgatgacgaagccagaattcgccgccttttaagaatgtatcttgaacgtgaaaattatgctatagatgaagctgaaaatggtgatgaagccattgccaaagggcttgaagccaattatgacttaattttgcttgatctgatgatgccggggactgatggaattgaagtgtgccggcaaattcgtgaaaaaaaagcgacacccattattatgctgaccgcaaaaggagaagaagcaaaccgggtgcaggggtttgaagcgggaacagatgattatattgttaagccgttcagcccgagagaagtcgtgctgcgtgtaaaggcccttttgagaagagcatcccaaacctcttatttcaatgccaatacaccgacgaaaaatgtgctcgtgttttcacatctgtcaatagaccatgatgctcaccgcgtaacagctgatggaacagaagtgagcctgacgccaaaagagtatgagcttctatatttcttagcgaaaacgcctgacaaggtgtatgatcgggaaaagcttctgaaagaagtgtggcaatatgagttttttggtgatttacggacagtggacactcacgtcaaacgcttgagagagaagctgaacaaggtatctccggaagctgcgaaaaaaattgtcaccgtatggggtgtaggttataaatttgaggtcggcgctgaatgaaattttggaaaagcgtagtaggcaagctgtggtttacgatcctttcactcgtcttgatcgtattgttcattttaacggttcttttgctggagtttattgaaaactaccatgtggaagaagctgagaatgatttaacacagcttgcgaataaagttgctgtcatcctagaaaatcacgaggaccaggcactggcaaggtcaatcacttgggaactcgctgataacttaacaagcattgccatcatccaggatgagaagaaccactggtattctccgaatgataaaaatcgcctgtcgtctattacggttgagcaaatacagcatgacaaagacttaaataaagctctcaaagaccataaaaaagtaagcaaacggacgggactgagcgatacagacacggataatgaacgcctgattgtaggtgtcccgtatgaaaaagacggaaagaaaggcatggtctttttatcccagtctttgcttgccgttaaagatacaacaaaacatacgacccgctatatttttcttgccgctggaattgcgattgtgctgaccacatttttcgcattctttttatcaagcagggtcacgtaccctctccgaaaaatgagagaaggcgcgcaggatttggcgaagggcaagttcgatacaaaaatcccgattttaactcaggatgaaatcggtgaactggcgaccgcttttaatcaaatgggccggcagcttaactttcatatcaatgcgctcaatcaagaaaaagagcagctttctaacattttgagcagtatggctgacggggttattaccattaatattgacggtacgattcttgtgaccaacccgccggctgaacgttttcttcaggcttggtattatgaacagaacatgaatatcaaagaaggcgacaatcttccgcctgaagcaaaagagctgtttcaaaacgctgtcagcactgaaaaagaacaaatgattgagatgacgcttcaaggcagatcatgggtgcttttgatgtcgccgctttatgcggaatcgcacgtcagaggagcggttgccgtactgcgtgacatgacagaagaacgccgccttgataagctgcgggaggactttatcgcaaatgtcagtcatgagctgagaacaccgatctccatgcttcagggatacagtgaagcaattgtcgatgacattgcaagctctgaagaagaccggaaagaaattgcccaaatcatttatgacgaatcgctccgaatgggccgtttagttaatgatttgcttgatttagcccgaatggaatcaggccatacaggcttacattatgaaaaaatcaatgtgaatgagtttttagaaaagatcattcggaagttttccggtgttgcgaaagaaaaaatattgctttagatcatgacatttctctcacagaagaggaatttatgtttgatgaagacaagatggagcaggtatttaccaatttgattgataacgcgctgcggcatacttcagccggcggcagtgtctccatttcagtccattctgtgaaggatggattgaaaattgatatcaaagactccgggtctggcataccggaagaagatctgccatttatctttgagcggttttataaggcagataaagcgcggacaaggggcagagcaggaaccgggttagggctggctatcgttaaaaatatcgtggaagcccacaacggatcaattactgtgcacagccgaatagataaaggaacaacattttctttttatattccgacaaaacggtaaaatcgagtctgaatttgccgaagaatcttgttccataagaaacacccgctgactgagcgggtgtttttttaatagccaacattaataaaatttaaggatatgttaatataaattcccttccaaattccagttactcgtaatatagttgtaatgtaacttttcaagctattcatacgacaaaaaagtgaacggaggggtttcaaatggaagaaacctttcaattattatatgatacatatcatcaagatttgtaccaatttttattttatatggtaaaggataaaaaccagacagaagaccttcttcaagaggtttatatccgggtattaaattcttatcatacgtttgaaggaagaagcagtgaaaaaacatggcttttgtctatcgcacgccatgttgcgatagactggttccgtaaacagcaaacaatcagacagcgtatactcggtacatttgactgggatacacaggatgtcagggatcagcaattgctgccggacgaacttgcggttcaacatgaaaatgtccgggaaatttatgctgcgcttgatcaatgtacaatcgatcaaagagctgtgattatcttgcggtttattcagggatattcaatacaggaaacagccaaggctctgcgcttctcggaaagcaaagtaaaaacgacccaacacagagggctcaaagtacttcggaaacatatggagcttttgagggaggagctaatggatgatgaagtcagaatggaacgaagaacagataaaggagttgttaagtcaacttccggcagttaaagaccatcgttcgcctcaggatatttacaagcggctgacgatggcaaagcgtaaaaataagcccgctgtcaggtggattggccccgcgtgtgccgctgcaattgcggtttatatcgccttcattatttctcctcatttctttgatcaggcacagcctcaacaaaaagaagcgtcccaagagaacgcagtaacgaaaactgagacagaagacagcccaaaagctgcatcgtccttggatcagacatcgtttgtcgttcctgaaaaggaacaagacaattacatcactgtagcggttgctgatgccgatacatctgcaatcatacccgtcagcattcaaaaaacaaatgcagaccaaacgatccaggatatgctgtttgaaagtagtgaattgggcatccttgatcatgccattacaattccaaccttcatagatgaagtagaaataaaggaaaaaccaaagcagaaggaattaagtatacgagtccatcagccagctacggcattttctataaaagatgatacactgttaaaaaaattgcttaaagaatccttaaaatggagtccttatgaaaaagtcaaatttttatcggatcaaaatgagactggggttcggattggctcatatggcacttttacggaaatttcgattcccaaacagtcaaaacgatcctactacttgtaccaaaataaacaaggacaagactttctcgttccgtcaaatcattcttttgatacagtaaaagaagcgattaaggaaatggaatcgagcagccaagaagatacgacacctcttattcaagcgggtgctgtccaatctgtaacgaagaaacagaaacacttatatatccgcttttcaaaggagtcagaagttgatgattctattgccggtattttaatgattgagggactacttttgactgcaaaagagtttggcttcacagaagtgacctttacggaaaccagaacgaaaaaaatcggcaaatatgacatatcagatgcaattccggtgccagctgctccaaatccgatttccttaaactaaaaagagccctttaaggctcttttttagttgctattcatataatagaaattttcaaaaaaaagttgtacgtgtataataaaacaaggtaaagattgaaaggatttgagacgagtgaacgtgttaacgattaaaggagtttccatcggggaagggatgccgaaaatcatcattccgctgatgggaaagacggaaaaacaaattctgaatgaagcagaggcagtaaaattactgaatccggacattgttgaatggagagtcgacgtatttgaaaaagcgaatgacagagaagcggtcacaaagctcatttctaagcttcgtaaatctttagaagacaagctatttctatttacattcagaacccacaaagagggcgggagcatggagatggacgaaagctcctatcttgctttgctggaatcggcaatccaaacaaaagacatcgatctgatagacatcgaattattttcaggagatgcaaatgtaaaagcgttagtatcgctggcggaagaaaacaacgtctatgtggtgatgtcaaatcacgactttgaaaaaacacctgtaaaagatgaaattatttccagacttcgaaaaatgcaggacttaggcgcgcatattccaaaaatggctgtcatgccgaatgatactggagatctcctaacactgcttgatgcgacgtatacaatgaaaacaatatatgcagaccgccccattattacaatgtcaatggctgcaacagggctcatcagcaggctgagcggtgaggtttttggatcggcttgtacttttggagctggagaagaggcgtccgcaccaggccaaattcctgtttctgagctaaggagtgtcttagatattttgcataaaaacacacggggatagaacaataaaaaactcaagctatatagcttgaggtttttttaattatggcagatcaatgagcttcacagacacaatatcagggacatttgttagttctttcacaattttatcttccagatgtctgtcaaaggaaagcatcatgatggcttctccgcctttttccttacggccaacctgcatagttgcaatgttaatatcattatctccgagaatacgtcctactcggccgatgacacctgttgtatcttgatgctggatatacaccaagtgaccagtcggataaaaatcaatattaaatccattgatctcgacaattcgttctccgaaatgaggaatatacgtagccgttacagtaaaggtgctgcggtctcctgtcacttttacgctgatgcagttatcgtatccagattcagaagaggaaattttttcactgaagctaatgccgcgttcttttgcgacacccccggcattgacctcattaacagtagagtctacgcgcggttttaaaaagcctgacagaagggcttttgtaatgaacgatgtttcaagtttagcaattgtgccttcatattgaatggcaacatcctgtactggttctttcatgcactgtgatacaaggctgccaatttttcctgcaatttgatggtaaggcttaattttagcaaattcatcttttgtcatggcaggcaggttgatagctgacatgacaggcaggccttttgcgaactgcagaacttcttctgacacttgggcggcgacattgagctgtgcttctttcgttgatgctcccaagtgaggagtggcaatgactaatggatgatcaacaagtttgttgtcaactggcggttcgacttcgaaaacgtcaagcgctgctcccgcaacatgcccgttttccaaagcttcgagaagtgctgcttcatcgataattccgcctcgcgcacagttaattaagcgaacgccttttttcgtttttgcaatcgtttctttattcaataagccttttgtttcttttgttaaaggcgtgtgaacggtaatgatatccgcactttcaagcacttcttcaaatgtacggctgtttacgccgatttttttcgctctttcttccgttaagaaaggatcaaaaacgtgcacagtcataccgaacgctctcgcacgctgtgcaatttcacttccgattcggcctaatcctacaataccaagcgtttttccataaagctctgaaccgacataagctgtgcggttccactctctggatttcactgagatattagcctgcggaatgtgtctcattaaagaagagatcattgcaaatgtatgctcagctgtcgaaatggtgttgccgttcggagcattgatcacgattaccccgtgtttcgtagcctcatcaatatcgatattatcgacaccgacaccggctcttccgacaatttttaaagaagtcattttgttgaaaaggtcttctgttacttttgtcgcgcttcgcaccaaaagagcatcaaaagtatgtaattcatcttctgcatctgctacgtttttttgaacgatttcaataaagtctgattcaataagtggctgtaaaccgtcgttgctcattttgtctgagaccaatactcgaaacatcgttagatttcctcctaaattgacaaactaaatatctgataatttaacatattctcaaaagagtgtcaacgtgtattgacgcagtaaaggataaaagtaaagcctaataaatcaatgatctgacagcttgcaggtaatatatttaatttgaagcaattctctatacagccaaccagttatcgtttataatgtaattaaatttcatatgatcaatcttcggggcagggtgaaattccctaccggcggtgatgagccaatggctctaagcccgcgagctgtctttacagcaggattcggtgagattccggagccgacagtacagtctggatgggagaagatggaggttcataagcgttttgaaattgaatttttcaaacgtttctttgcctagcctaattttcgaaaccccgcttttatatatgaagcggtttttttattggctggaaaagaacctttccgttttcgagtaagatgtgatcgaaaaggagagaatgaagtgaaagtaaaaaaattagttgtggtcagcatgctgagcagcattgcatttgttttgatgctgttaaatttcccgtttccgggtcttccggattatttaaaaatcgattttagcgacgttcccgcaattattgccattctgatttacggacctttggcgggtattgccgtagaagcgataaaaaatgttcttcagtatatcattcagggaagcatggccggagttcctgtagggcaagttgcgaattttattgcaggaacactctttatattaccgactgctttcttatttaaaaaactcaactcagcaaagggcttggctgtcagcctgcttttgggaactgcagcgatgaccattttaatgagtattttaaattatgttctgattcttccggcatacacgtggtttttacattcaccggcattatccgacagcgcgctaaaaacagcagtcgtcgcaggtatcctgccgtttaacatgataaaaggtattgtaattacggttgtattctcactaatttttatcaagcttaagccatggattgagcagcagcgaagtgcacatatccattaaataaaaaagctcccgttcgggagctttttttagttacttctattcaaatttaagcgggtcgccttcaaatggctcatccgccactttgatggaatcagtagggcatccttcaaatgcgtcaatcatatcttcttccagtacctcaggaacttcgacaacacctttgttttcatcaagcgttacgaacgcgatgccttcatcatcgtaatcgtaaatgtctggtgcagcagctccgcaagcgccgcatgcaatacatgtatctttgtctacgattgtgtactttgccatgaataaaacctcccagattgttcttggtggaacaaatggatcaatctttatatttaatcaatttaacacctattcctcttacttattgtaatgatgttgctgccacatttcaacagaaaaatgattgagaatgcttatcacataaggggttatctacataacatcccccttaatgatgactttaaacgtcgatttctgtttgaaatctgttaaaataaaaagagcaaatcaacgatttttgtcaggaagaatgtaggtggataggttgtcattaaattacttcgatattatggttctcgattgtctttgcaaaataaacggggaacggtcgggaagcgctgtttttcacctattcaaaggcaagagatcgtcacagaccattcaagatgccggcttatttcagactgcaaaatactttggaatggcggcaaaatgttcgagaagcgatatttctgcgtcgcttgacaagcttgaaaagcattcatatctcgcgccaatgtctgaatcagatacatacaaagtgacagccagcggcgcagcagttttgagacatgcccttagcgagcggccttggcccgttcattgtcacggcgctcattatcagcaggctgccggcgtgctttggaaaaggctttcgctgcttgtgcaggtcctatcccataaacagcaagggagcaggcagtatatccctgtcacaaaggatcataagacacttcactgggtaaagaaatacctgtcccggcatacggatcatatagagatggcaaaaagcctttttgccatgcttgaggcgcatttgaaaaagattgaaaacaaagcagcgcaaatttttgtctactccttaacctcgcaccatcggatcggttatacgagcaggcagcttgctgatacgctgaaagaagacgaatggtatgtctatatcatgttttgggcttcggtacattattttattcattctcttccggagtgtgaagatgctttgttaaaggatctcctttctgatgtgcacttagataatgccctgacagagtcgacgaggaaaacatggcagatggtcaaacaagggtttccgatacagcgaattgctgaaatcagaaagctgaaaacagcgacgattgaagaccacattgtcgagatttctctccatgagcctgcgtttatgattaatgactatgtatcagcagaagaccagcttcaaatcgcagagtttgccaaacggatgcggacgaataaaatcaaacaaattcgcgacgggctggaacagcggttcagctactttcaaatcagactggcattgacaaagcaggtgcagcaatatgactaaattacagcaaacgttatatcagttttttggttttacttcctttaaaaaagggcagcaggacattattgaaagcatactcagcgggaaggataccattgcaatgctcccgactgggggagggaaatcgctttgctaccagctgcctggttatatgcttgatggcatggtattaatcgtttctccactgctttctttaatggaggatcaggtgcagcagctcaaagcccggggggaaaagcgtgctgcagctttgaacagcatgcttaacaggcaggaaagacaatttgttttagaacatattcatcgatataaatttttgtacttgtctcctgaagctttacagtctccatatgtattggaaaaattgaaaagcgttccgattagcctatttgttattgacgaagcgcattgtatttctgaatggggacacgacttcaggcctgattattcaaagctcggacagctgagaaaaaaacttggacacccacccgttctggcattgaccgccacggctacaaaggaaacgctgcaagatgtcatgaacctgctggagctgcagcatgctgtacgccatctcaactcagtcaaccgcccaaacatcgcactgagggttgaaaatgcggcggatactgccgaaaaaatagatagggtcattcagctggttgaaaacctgcaaggtccgggaattgtttattgtccaacacggaaatgggctaaggaattagcgggtgaaattaaaagcaaaacgagcagcagagccgacttttaccatggcggtttggagtcaggggacaggattttaattcagcagcagtttattcataaccagcttgatgtgatatgttgtacgaatgcgtttggaatgggtgtcgataaacctgatatcagatatgtgattcattttcatctcccgcagacggcagaagcttttatgcaggaaatcggcagagcgggacgcgacggaaagccgagtgtcagcattttgctgcgggcgccaggggattttgaattgcaggaacaaattatccagatggagagtgtcacagctgaagaaatcgccgacgtaatccgtgtgctagagaagacggaggagcgggatgagagaaggctgcgtgacgtattacttcagtatggcgtcggagagacacaggcccgtatgatgattcatctctttatgcagggaaaaacatcagttgaactgatgaagaaagaaatttcatatcgcatggagctgaagctggaaaaaatgcaccgtgtatcatttttgcttcagcgtgacggctgtttaaggcaggcactgttaacctactttgatgaatcatacgagcctgatgacggaaacctcccgtgctgttcacattgcggttttgatttatccttgtatgaacaaaaaggggaacggagtaaaatggcgccattagacagctggagttcggaattgcaccggatattcagcttgcagactgtaggtgagctgaactgaaacagcaaaaagattatattcagcatatgactgaccatgatatgctgaagcagttatatttgacgcagctactcatcatctttgccgctgctgcagcaggactgttcttttttgaggatgtacgggacgtattaaagctctgggacattcgcgatatgcgaatcatctggtatggtgtttctatagctgttattgttattttagccgatatggcagtaatgaaatggtttccgtctcatttatatgatgacggcggaatcaataaaaaaatattcagtaagaggtcaatccctcatattatatttttaacgcttctgattgctttcgcggaagaaatgttattcagaggagtgctgcagactcatatcggtttatggacggccagccttatatttgccgctctgcactttcggtatttgtcaaaatggctgttatttattatggtgacagcaatcagctttttgctcggtctgatgtatgaatggaccggcaacttatttgttccgatgacggcgcattttatcattgatgccgtgtttgcctgtcagattcgttttgaacatgtgaggagggataaacatgacgaacatgtcgagagtagagagaagaaaagcccagaatctttatgaagatcaaaacgccgcattggcggacgattatgtcgatgatggagaaagccttccgacaagacaatctgtaaaaaatcaaagagaacagaaaaaaaagcaaggcaaaacaaaaacgccattattcacagtactcgcagtaatatttgtatttgtgccggttatcgttttagtcaccttattttatctaaagagccacccggataatcatgacgattatgaagatgtttttattgacagcagccaaagcaaatatgaggttgtcccgaaatcagaggataaaaacgataccgcagacactaaagaaaccgcactgcagaaggagtcaaaaaaagagccagaagattccaagccaaaagagcaaacagctgctgataagaaacagactgctgtagcggaaaaagaagactcgccaaataaggaggaagcaaccgccgcggctgcttcctcttcccaatcaacagtacaacagcaagaacagccagctgagccagttcaaaatgtgccgaatcgcgttgtcaagcacaccgtccaaaagaaagaaacgctataccgcatttccatgaagtattataaaagccggacaggagaagaaaaaattcgagcatataatcatctgaatggaaatgatgtttacaccggacaagttttggacatccctttaatggatgaatagggtattatttttattttacgttcatatattgtagcaatgaaaatggacaaggtgtgaagcgtatggaatccttatggaatcagctggatcagtttacagacgcgccgaccaaacagatgctccaagcgctggtaaaacgaaaacaaaaattcgaaaattatgcagcacaatgccgcagatggcgatgggcttcacttatctgcctaggcttattatgtgttatgatcatgatcaaaagcccggagcctcagcttatacttcaagaaatacttagccataccttttatttattttggatgctggcaaccgcttttgcctactgcacttcatattatttcaagaaaaaggaagaaaaatccgagactgatttccataaactgagatgtgaaattattcagaaaagcactgatctctggccgcagcccgataaatggaaggcgagagagtctgtttttcatatgatgaagcacaaatatgacattaatctatattttgaaagtaaataaaatggggcgttttctcaaacgatagaaacgtcttttttattgtccgtcttattgataagttctaaaaagaatggagagttttttatgaagctatcagtgaaaattgccggtgtactaactgttgcggcagcggcaatgacggcaaaaatgtatgcaacagcaaaaggcaatcatttgaagacacatacgtttcctttatcaaagatgaagggcaagccgcctctgacaatcttttttatttcagacattcacaaacgtctcatcgatcaagaccttttagaaaaagcgcgaagccatgccccccacttggttataatcggcggtgatttagctgagggcggggtgcccagtgcgagaatcgaggaaaacatcaaaaggctcgtacatttcggggtccctatcgtgtttgtgtgggggaataatgattatgaagtcaggcagcataagctgtattccatatttaaagcgcacggcgtcatcactctgagaaatgagtcagtcccgttttcatacaatgggcatacgattgcgattgcgggggttgatgatatcaggatggagatggatcattatgaggaagccatcaaagaacttgatgaaagccagctgaatattctggtttgccataatccggagattcatgaacaaatcaatgaagatgacggtattgatgtgatactcagcggacatacccatggaggccagatcaggtttggaaaattcggtccttatgaactggggaaaacaggtattgttaaaaacgcggcatatctgatcagcaacggctacggcacgacaaaagtgcctcttcgtttaggtgctgagcctgaaactcacattgtgactctttgcgggccagaataacttctaaaaagcaaaaatccgtatggcaataaaaactgcattgtgcttgtcttactagtgaactcagtgtaaactgataacaattaagaacctatgactcatcatctcatataatgtgttatatgatttgtgtgcaagtagaggcaggagggaacgttatgcggcttgagcgtctgaattataataagatcaaaatctttttaaccctcgatgatttgacagaccggggattgacaaaagaagacctctggaaggactcatttaaagtccaccagttatttaaagatatgatgaatgaagcaaatacagagctcggctttgaagcgaatggaccgattgcagtggaagtgtattctctccaagcacaagggatggtcgtgattgtaacaaagaaccaagacgccgattcagaagacgatgagtatgatgatgattacatcgaaatgcaagtcaagcttgatgaaagcgcggacatcatatatcaattccattcctttgaagatatcattcagctttcagaaagcttacagcgaatcggtatcacagggggaactgtctaccactatgacgggcagtactttttaagccttgaagatctagggtcacatacggctgaaggggttgtggcggttctggctgaatacggcaatccgacaactttaacgatttatcgcctgcaagagtatggtaagctcattatggacggtaatgccgtagaaacgatacaaactcatttttcataagaatgcaacggaaaactgctgatttcagcagtttttttcgttaaaaaacatggaaaaacataacgtttattctatgcacagatcatatgaaggtgtatactattctctgaaagggagcatgtgagaaacagaagattctaggaggttaactcaaatggcagccgatcgaaacaccggtcatacagaagaggacaaacttgatgtattaaaatcaacccaaaccgtaatacataaggctctggaaaaattgggatatcccgaagaggtatacgaattgttaaaagagccgatgagattattaacggtaaaaatacctgttcgtatggacgacggttcagtaaagattttcacaggatatcgtgcgcagcacaatgactctgtcggtccaacgaaaggcgggatacgttttcacccgaacgtaacagaaaaagaggtgaaggcgctttcaatttggatgagtttaaaatgcggcataattgatcttccatatggcggtggtaaaggcggaattgtttgtgatccaagggatatgtcgtttagagagctggagcgtctgagcagagggtatgtcagagcgatcagccaaattgtcggcccgacaaaagacgtgccggcaccggatgtatttacaaactcacaaatcatggcttggatgatggatgagtattcaagaattgatgaatttaattcgcctggatttattacaggcaaaccgcttgtgcttggcggatctcacgggagagaatctgcgacagcaaaaggtgttaccatctgtattaaagaagcggctaagaagagaggcatcgatattaaaggtgcgcgtgtcgttgtccaaggcttcggaaacgcgggaagctatttggcaaaatttatgcatgatgcgggggcaaaagttgtcggcatctcagatgcgtatggcggactttatgatccggaaggccttgatatcgattatttactcgaccgacgcgacagcttcggtaccgtaacaaagcttttcaacgataccattaccaaccaagagctgctggagctggattgtgatattctcgttcctgctgcgattgaaaatcaaattacagaagaaaatgcccataatatccgggctaaaattgtcgttgaagcagcgaacggaccaacaacgcttgaaggaacaaaaattctttcagaccgggacattctgcttgtaccagacgtgctggcaagtgccggtggcgtaacagtttcttattttgaatgggttcagaataaccaaggcttctactggagtgaagaagaggtagaagaaaaattagaaaaaatgatggtcaaatcatttaacaatatttacgaaatggctaacaaccgaagaattgacatgaggctcgctgcatatatggtcggcgttcgcaaaatggctgaagcttcgcgttttagaggctggatataagttgatgatttgcataaaaataaaaaatctcctatgataaaataggagatttttttattcggaaatagaaaatatgaagtgaaatgccaatcgcaggagttgacagaaatgattcaagaaaaagcaattattataggcggaggaccttgtggactatctgctgccattcacctaaaacaaattggcattgatgccctcgtcatcgaaaaaggcaatgtcgttaacagtatttacaattacccgacgcatcaaacctttttcagttcaagtgaaaagctcgaaatcggagatgtggcatttattacagagaacaggaagcctgtcagaattcaggctttatcgtattaccgggaagtcgttaaacggaaaaacatccgtgttaatgcgtttgaaatggtgcgtaaagtgacgaaaacgcaaaataacacattcgttattgagacgtcaaaagagacctacacgacgccatattgtatcatcgccacaggctattatgatcatccaaactatatgggcgtacccggtgaggatttgccgaaagtatttcattattttaaagaaggccacccgtattttgataaagatgttgttgtcatcggcgggaaaaattcaagcgtggacgccgcccttgaactcgtgaaatctggggcgcgtgtcacagttttatataggggcaatgagtattctccgagcattaagccgtggattctgccggaatttgaagctctcgtcagaaacggtacaatccgtatggaatttggagcttgtgtcgaaaaaatcaccgagaatgaagttgtgtttcgctccggagagaaagaactcattaccattaaaaatgattttgtatttgccatgacaggctatcatcccgatcatcaatttcttgaaaaaattggtgttgaaattgataaagaaacagggcgtccatttttcaacgaagaaacgatggaaacgaacgttgaaggtgtctttattgccggtgttattgctgcgggaaacaatgcaaatgaaatatttattgaaaacggcaggtttcacggggggcatatcgcagcggaaatcgccaaaagagaaaaccattaaagatgaggagcatatgatgcattcgtatgctctttttgtttttttaagtgcagacagatgtaaaattttaaacaacatggtaggatagatgtaggaatataaaggaaagaggttgcctgatgtttgcaatcatctctgcaggaattgcccccggcatcgcgttattaagttatttttatttaaaagatcagtatgataatgaacctgtacatatggtgctacggtcgttttttctcggggttgttcttgtatttcccatcatgtttatccagtatgtacttgaaaaagagaatgtaggaggcggaagctttttcgtttcttttttatcttcggggtttttggaggaatcattaaaatggtttatactgatgatcagtgtttacccgcacgcccactttgatgagcattatgacgggattgtgtacggtgcaagtgtatcactcggttttgcaaccctcgaaaatattctttatttaattggccacggcgtggagcatgcgtttgtcagggcgctgctgcctgtttcatgccatgccttgattggcgttataatgggattttaccttggaaaagcccgtttttccgctgataaggcgcgtgtaaagtggcttactctttctttagttgtcccatcccttttgcatggatcatatgattttatcctaacagcgcttagcaattggatttattatatgcttccatttatggtatttttatggtggtttggtttgcgtaaagcgaaaaaagcccgttccgttaatatgatgcaagtatagaagccgcacagcaaccgtgcggcttttttgtgtgcagtttttatgttctgagggataacaaggaaagagtgtataaaaataacctcgttacagaaaatacgattacacttaaaaatttgcagtaggaggcttgaaaagatgaagtccaaaggatcgattatggcatgtctcatccttttttcctttacaataacgacgtttattaatactgaaacgatctctgccttttcgaatcaggtcattcaaagaggggcaacaggggatgatgtggtcgagcttcaggcgcgtcttcaatacaacggatattataacggaaaaattgacggggtttatggatgggggacgtactgggcagttcgaaattttcaggatcaattcgggttaaaagaggttgacggccttgtaggagctaaaacaaagcaaaccttaatatgtaaatcaaaatactatcgtgaatatgtcatggaacagctcaataaagggaatacattcacgcattacggaaaaattccgctaaagtatcagacgaaaccatcaaaagcagcaacacaaaaggcaagacaacaagcagaagcacggcagaaacagcctgcggaaaaaacaacgcagaagcctaaagcgaatgcgaataaacagcaaaacaatacaccagcaaaagcaagaaaacaggatgcggtagcagcgaacatgcctggtggattttccaacaacgatatcaggctgcttgctcaagcggtttatggcgaagcccggggcgagccgtacgaggggcaggttgctattgcagcagtcattttaaaccgtttgaacagcccgttatttccaaattcagtagcgggggttatttttgagccgcttgccttcacagcagtagccgacggacaaatttacatgcagccgaatgaaacggcacgagaagcagtgctggatgccatcaatggctgggacccatcagaggaagcactttactactttaatccggatacggctacaagtccgtggatttgggggcgtccgcagattaaaagaatcggtaaacacattttctgtgagtagcagatatgagaaagcataaaaagaggtgtgataaatgatcagaggaattttaatcgccgtgcttggtattgcaatagtcggtacaggctactggggatacaaagaacaccaggaaaaagacgcagttcttcttcatgctgaaaataactatcagcgggcgtttcatgagcttacctatcaggtggatcagcttcatgataaaatcggaacaacacttgccatgaacagccaaaaatcactgtcgcctgcattgatcgatgtgtggaggattacatcagaagctcataacagcgtcagtcagctgccgcttacattaatgccgtttaataaaactgaagagctattatcaaagatcggcgatttcagctataaaacgtcagtcagagatttggaccaaaagccgcttgataaaaacgagtatacatcactaaataagctatatcagcagtccgaagatatacaaaatgaattgcgtcatgttcagcaccttgtcatgagcaaaaaccttcgctggatggacgtagaaatggctctggcttctgacgaaaaacaaagtgataatacgattatcaacagctttaaaacagtcgaaaaaaatgttggtgcattctccactggcactgatcttggcccgagtttcaccagtacgaaaaaagaagagaaaggcttcagccatctgaagggaaaacaaatttccgaacaggaagcaaaacaaattgctgagcgctttgccccagatgacaattattcaattaaagtggtaaagagcggaaaaaaaacaaatcgcgatgtatatagcatcagcatgaaagacccagaccataaagcagtgatttatatggatattacgaagaagggcgggcatccggtatacttgatccaaaacagagaagtgaaagatcagaaaatcagtttaaatgacggatcgaaccgagcgcttgcatttttaaagaaaaacggatttgaaacagatgatttggaaattgatgaaagtgcccaatatgataaaatcggtgtattttcatatgttcctgttgaaaataaagtccggatgtaccccgaggcaattcgtatgaaagtggccttggatgacggtgaggttgtcggcttttcagcaagagacttcctcacatctcacagaaaaagaaccatacctaagcctgcaattactgaagcagaggcaaagtctaaattaaataaaaatgtacaagtgagagaaacaaggctcgctttgattacaaatgaactaggtcaagaagtgttatgctacgaaatgcttgggacaattgaaaatgacacattcagaatgtatatcaatgccaaagacggatcggaagaaaaggttgaaaaactaaaaaatgcagaacctatatataaagacctataaaaacaggaggaaaggactaaatgtcttttcctttttttcattacgtgctttaataaaaacgtgagtatattgaatgcgaaagagtgaagtcaatgatagagattggagaaaatgtacttttagaatatatagaagaaaatgaattgaaaaaggcaaaaagcaaggcggtcagcatcgaaaacaatgaacttttgatcgcgtatcctgttgatgtagttacagggcgaactgtgattttacataacgatatggaagtaacggtagagtttgtgggaaaagacgaagttccttatcgctttataagccgtataaaaggtaaagtgaaggacaaacttcaaatgatctgtcttgaaatgcctccccgtgaaaaaatgaaaagaatccagcgccgccaatatgtaagaactgatgcggtattagatgtgcaaattcagccgggaaatgaagaagagatccgcacactatcctataacatcagtgcaggcggcatcgccgtggttttagctgatggcctttcttttcaatcgggggaatcattgcgcctgatcatccgtcttcctgaagaggagcacacacgtcaaatagaaacagaagcagttgtcagacgaatctttaatgaccccaagtcagaaaaacgaaaaatgactttagagtattcagaaattgcagcaggtgaccagcaggctttgcttcaatactgcatcaggcgccagttaaataagagaagaaaggcccgaatggaataaacatcggcaaacacttccatactatttgtaatggaggtgctccaatgaaaacatttgaacggctgctgatcaaattattgttcattcaggccatcattttacttggtgtccaatttctttttcactatcagcatattgaaccatacgtatcaaaagtgattcaatatgaaggggtggataaaatggaggaaaacaataggattgaaaccttcaaacattaattattcatcaatttttcaccctttttcataaagttcgtgatacaatccttagaggagaaaagagcaaggagaggaattatggaaaagaaattatcgattgcaatcgacggcccggcagctgcggggaaaagcaccgttgccaaaattgtggctgagaaaaaatcgtacatatatattgatacaggagcgatgtatcgggcgattacgtacgcggctttacaggaaaacgttgatctgacagatgaagaaaaactggctgagctgctaaagcggacagacattgagctgattacaacaaaagatggacaaaaagtgtttgtaaacggcaccgatgtaactgaggcgatcagaacagatgaaatcagcaaccaagtttcaattgcggccaagcacagaagtgtcagagaagaaatggtgaaacgccagcagcagcttggggaaaaaggcggcgtcgtcatggatggtcgtgacatcgggacgcatgtgctgccaaatgcagaagtaaaaatctttcttttggcatctgtggaagagagagcgaaacgccgttatgaagaaaatgtgaaaaaaggctttgatgtcaactacgaaacattaattgaggaaattgcaagaagagacaagcttgattcagagcgcgaagtatctccgctgcgtaaagcagaagacgctcttgaaatcgacacgacatcgctttccattcaagaggtagctgataaaatcctcgaggctgtggagcaaaagtcccgctgaggatggcaaatgccactttttttgaatttttcaacgaagatagaatgttattgcttgacaaacctgtccttttattagaagttaatactaataaaactttttattgatcattcaaaaaacttttttggatgattctttaatacatattcggctaaaagcgggcatgttatatgttcagctttcaaaccgttttaattaagctgtgtaggtttggaccaaggaggttattcaaatgacagaggaaatgaatcaaattgatgttcaagtgccagaggttggagatgtagttaaagggattgtgacaaaggtagaagacaaacatgtagatgtagaaattatcaatgtcaaacaatccggtattattccaatcagtgaattatcaagtcttcatgtagagaaagcatcggatgttgttaaagtagacgacgagcttgacctgaaagtaacaaaagtggaagacgatgctttgattttatctaaacgtgctgttgatgcagaccgcgcttgggaagaccttgagaaaaaatttgaaacaaaagaagtgtttgaagctgaagtgaaagatgtcgtgaaaggcggccttgtcgttgatatcggcgttcgcggttttattccggcatcacttgttgaagcacatttcgttgaagacttcactgactataaaggaaaaacactgtcactgctcgttgtagagcttgaccgtgataaaaaccgcgtgatcctttcacaccgtgctgttgttgaaagtgaacaagcgaataaaaaacaagaacttcttcagtctcttgaagttggaagtgtacttgatggcaaagtacagcgcctgactgactttggcgcgtttgttgatattggcggcatcgacggacttgtacacatttcacagctttcccactctcatgtagagaagccgtctgacgttgttgaagagggacaagaagtaaaagtgaaagtgttatcggttgaccgtgataatgaacgtatttctttatcgatcaaagatacactgcctggaccttggaaccaaatcggcgaaaaagtgaagcctggcgatgtgcttgaaggaactgtacagcgtcttgtaagcttcggtgcctttgttgaaatccttccaggtgttgaaggtctcgttcatatttctcaaatttccaataaacacatcggcacgccgcatgaagtccttgaagaaggacagactgtaaaagtgaaggttcttgatgtgaatgaaaatgaggagcgcatttcattaagcatgcgtgaacttgaagaaacgcctaaagctgaccaggaagattaccgtcaatatcaagcgaaggaagaaacaagcactggcttccagcttggagatctgatcggagataagctgaataaactaaaataattggtgataaacgtgactcgagcagaacgaaaaagacaacacatcaatcatgccttgtccatcggccagaagcgggaaacaggtcttgatgatattacgtttgttcacgtcagtctgcccgatcttgcattagaacaagtagatatttccacaaaaatcggcgaactttcaagcagttcgccgatttttatcaatgcaatgactggcggcggcggaaaacttacatatgagattaataaatcgcttgcgcgagcggcttctcaggctggaattccccttgctgtgggatcgcaaatgtcagcattaaaagatccatcagagcgtctttcctatgaaattgttcgaaaggaaaacccaaacgggctgatttttgccaacctgggaagcgaggcaacggctgctcaggcaaaggaagccgttgagatgattggagcaaacgcactgcagatccacctcaatgtgattcaggaaattgtgatgcctgaaggggacagaagctttagcggcgcattgaaacgcattgaacaaatttgcagccgggtcagtgtaccggtcattgtgaaagaagtcggcttcggtatgagcaaagcatcagcaggaaagctgtatgaagctggtgctgcagctgttgacattggcggttacgggggaacaaatttctcgaaaatcgaaaatctccgaagacagcggcaaatctccttttttaattcgtggggcatttcgacagctgcaagtttggcggaaatccgctctgagtttcctgcaagcaccatgatcgcctctggcggtctgcaagatgcgcttgacgtggcaaaggcaattgcgctgggggcctcttgcaccggaatggcagggcattttttaaaagcgctgactgacagcggtgaggaaggactgcttgaggagattcagctgatccttgaggaattaaagttgattatgaccgtgctgggtgccagaacaattgccgatttacaaaaggcgccccttgtgatcaaaggtgaaacccatcattggctcacagagagaggggtcaatacatcaagctatagtgtgcgataaatgataaaagcccaaaaccatatgtggtttgggctttttgtattatgattttcgctttttgaatcttccgttttgttcaaggcttgtcgctccgtcatagtgaatggactggtcgcgatctgattcgactctgcctgaagctttgagttttttctcttgtctgtcttttcccatgatcatactccttaatgtgagatcgattgtttaaaaaatgtgcttgaactccatactgggaatatggaggaagtaaaatggaacaattttattactattggtcaatgtggtttctgtgggttctgacaacatttatttttgaaaagacgaaaagacgaattgccgtctctgtctttattttaactaatattattctaagcatacatgacatcgctttatatttttccctgaatgctgcatatttgatgtttttcgtttgcggatgtgtctatgccgggtatttgggaatgtatcgttttcgttacatcatggtctatctgacgcttgttgccgcgtatgcgtttgtttatctttttgcattatatgacccggtttggttcatcataaaacctgagtgggctgctgttatattaatagtgcttttaacagcttctgttgaaaggaattttgagaagcagcttgtcttatttgtcctagggatgtgccaaggcgaactggtgtattcatttgtgatccagaagttggccggggctatggctgtcggcggctttcaatggctgaatgcgtgttctgcggggatgatattgctgtttggcatatctaaatacgaacacctcgcaagccagattggtcagaaaagcaaaagatcaaacaaaggagctaccaaaatgtcatgagtgattacatctatccgattattgctggggtcattgccggaattgcgacaaggctttatatgctgaaaacggattaccgccagtatccgacctatgttcatgggaaagtgattcacatcgcactggggttgatagcggctggtttaggtgcaattattatgccggcgcttttgcaggaggaatttacggccatcacatttttaacattggcagcgacgcaatttagagatgtccgaaacatggag

SEQ ID NO: 52 - DNA, 98591 bp, Bacillus subtilis WAUSV36
ggtccgggactgtttgttgataatatttatatgatgaatatcgggcttccagagaaacaggaactgattttaaagcatggcatgggctttattttgacgccgaaaaactttaattcagcagcgacgatagcaaatttagggcagcgtcaggccattttatttgatgtttccaatgtgctcggggtttatcgggattcaggagagccatctttgacaccaattgcaaaacgggatttaaatgatgggagagtggcagtatttgttctcccgcaaattcaccatcccgaaacggctgttcaaattattagcaatgttccaaccctggaaaatgcgattagaatgccgactgaatttatcaagaatcaggataaggtgataggatgagtgaatctcttacgaaagtgattttgtctgtaatcacgacaaatcgaaatcgggttgcagggggagcacctgtctttttttgcaatgaccaaaaggagatggagcttttcgctaaaaatcttgaggcgatccttgatggaatagctcacagaatcggagatgacgtgtatttgatcgtgaaacatttttaagaatagttgtgatcccagtaaaaactgatataataaatgagttaagcccttcctctgaagggtttcttttcataaaagtgaatgaaatgattttaataaccggttgaaaatttatgtaaaaatgaaagcggctggattgaaaggaagggtactatgggtaaacctgtcgtagccattgtcgggagaccaaatgtaggaaaatccacaatctttaaccggattgcgggagaaagaatttcaatagtagaagatacccctggcgtgacaagggatcggatatacagctcggctgaatggctgaattatgattttaatttgattgatacgggcggtattgatatcggtgatgagccgtttttagcgcagattcgccagcaagctgaaatcgccatggatgaagcggacgtgattatttttatggtgaacggccgtgaaggcgtgacagctgctgatgaagaagtggcgaaaattttgtaccgcacaaaaaagcctgttgttttagcggttaataaactggataacacagaaatgagagcgaatatttatgatttttattcgctaggctttggcgagccgtatccaatttcgggaacacacggactcggactgggtgatttactggatgccgttgcagagcattttaaaaacattcctgaaacgaaatacaatgaagaagttattcaattctgtctgatcggacgtccaaatgtcggaaagtcttcacttgtgaatgcgatgctcggcgaagaacgcgttattgtcagcaacgtggctggaacgacaagagatgctgttgatacgtcatttacttacaaccagcaggagtttgtcattgtcgatactgcaggtatgcgaaaaaaagggaaagtctatgaaacgactgagaagtatagtgtactgcgggcgctaaaagcgattgaccgctcagaagtcgtggcggttgtgctggatggcgaagaaggcattattgaacaggacaagcgtatcgccggttatgcacacgaagcgggcaaggccgtcgtcatcgtcgtaaacaaatgggatgctgttgacaaagatgagagcacgatgaaagaatttgaagaaaatattcgcgatcattttcaatttctggattatgcgccaatcctatttatgtctgccttaacgaaaaaacggatccatactctgatgcctgcgattatcaaagctagtgaaaatcattcacttcgagttcaaacaaacgtcttaaatgatgtcatcatggacgctgtggcaatgaatccgacaccgactcataacggttctcgtttgaaaatttactatgcgactcaagtgtcggtaaagccgccaagcttcgttgtgtttgtaaacgatccggaactgatgcatttttcatacgaacggtttttagaaaaccgaatcagagacgcgttcggttttgaggggacaccaatcaaaatatttgcaagagctagaaaataaaaaggtgtgaatcaaacatgaaaaaagtcacaatgcttggagcggggagttggggaacagcactggctttagttctaactgataatggaaatgaagtgtgtgtgtgggctcaccgtgcagatttaattcatcaaattaatgagttgcatgaaaacaaagattatttgccgaatgttaagctgtctacatccattaaaggaacaacagatatgaaagaggctgtttcagacgcagatgtcattatcgttgcggtcccgacaaaagcaattcgggaagtgctgagacaggctgtcccttttataacgaaaaaggcagtctttgttcatgtcagcaagggtattgagccagattcacttctgcgcatttctgaaattatggaaattgagctcccgagtgatgtcagaaaagatatcgttgtcctttccggcccgagtcatgcggaagaagtagggctgcggcaccccacaactgttactgcatcttcaaagagcatgagggcagcagaagaggtgcaggatctatttattaatcacaattttcgggtgtacacaaatcctgacattatcggagttgaaatcggaggggctttaaaaaatattattgcccttgctgcaggaattacagatggtttagggtacggtgacaatgccaaagctgctttgattacacgcggacttgccgaaatcgcgagactcggaacgaaaatgggcggaaatcccttgacgttctctggattgacaggagtaggcgatctgattgtgacgtgcacaagtgttcattccagaaactggcgtgcgggcaatttgctcggaaaagggtacaagcttgaagatgttcttgaagagatgggaatggtagtcgaaggcgtccgcacgacgaaagcggcttatcagctttcgaagaaatatgatgttaaaatgccgattacagaagctctccatcaggtcctattcaacggacaaaaagtggaaaccgctgttgaatctttaatggcgagagggaaaacccacgagatggaggatttggtaaatacgtttgaaaatcaagtgaagtaaaagtgtcaatcaaatggtgaatcgcatatcttaattgaacgaaagcccgaaaaacagaagaacacccaagtcttgggatctcctgaaacattttgccgatttaggcaatagaggatgcatctgtatgccaagtcgcatactatagcatcgaagtccaagagagtgtttcttaaacgtgcaggtgaatatagtcaagttgactgaagcgaaggtccccctctttgcttcagtttttttgttctatcaatggatggaaaatctggttgatcttttccggcgctgtatattaaaatataatataacgcttatatcttacatatcggggaggcgcacgtcattgaatctggcattgatgaaaatgtggtttgctctagggtccatgggtctgatgtttctggctgtagcttccatctatttaagccgctttaagtgccaaaaccgttttttgaagattgcgatttcatcattcgcatacatgtgtatgctcatatctggaattattgtgtttgtcgtggtttttagcggccctgtcaatgaataaagctgtaaaaggaagtgctgtatgggtaaactgaagtgcgcaatcatttttgcggcagtcgtgtttttatccggatgtttatatccaaatgaacggaaaagcagtgtgcatgccattccttatcaagaccagctaaagcaggttcaatctgctgttgatgaatttcaaaaggcaaatggagggctgcttcctattcaaaccaaagatatgtcgacaccgctatatcaaaaatatccgatagactttaaccggttagcgccaagatacatagctgaacctccaagtacggcatttgaaagcgggggagactatcaatacgtgcttgttgacgtagagaacgatccgactgttaaattaattgatctaaagatggcagaaaaaattcgcgatgtgaaattgcgcatccaaatgtatcgtcaggagcatcaatatccgccttacaaggatgtgctatctcgtgatttatttacactcgatgagaagaagcttggggatggcagctctcttacagtgacaagcccaatctcagggaattccttgccgcttatgattgacggagacggagaaatatatgccgattaccggactgagctggcttcttgcctcaaaaaaagcaaaaaaacgtttaaacccgggactgaaatccaggatatgatttggcatgaaaccccctttgtccccgcgttttctgtaaaatatacggtaaatgacaaacaggaacctgtttttttagaaaatgatatgaaaaaggaatgaacctttctcccttgcatacaaatagggagaaaggtttttttatattaatagattgaggatgagaaattttctaaagatgtcatattcaaataggacaacgtcatacacatatagtgtcctgtgtttgattgaaagagcttaataaaattgaaaaggataggaagtccgggaggggatcacttggaaaaggtcgatattttcaaggatatcgctgaacgaacaggaggcgatatatacttaggagtcgtaggtgctgtccgtacaggaaaatccacgttcattaaaaaatttatggagcttgtggtgctcccgaatatcagtaacgaagcagaccgggcccgagcgcaggatgaactgccgcagagcgcagccggcaaaaccattatgactacagagcctaaatttgttccgaatcaggcgatgtctgttcatgtgtcagacggactcgatgtgaatataagattagtagattgtgtaggttacacagtgcccggcgctaaaggatatgaagatgaaaacgggccgcggatgatcaatacgccttggtacgaagaaccgatcccatttcatgaggctgctgaaatcggcacacgaaaagtcattcaagaacactcgaccatcggagttgtcattacgacagacggcaccattggagatatcgccagaagtgactatatagaggctgaagaaagagtcattgaagagctgaaagaggttggcaaaccttttattatggtcatcaactcagtcaggccgtatcacccggaaacggaagccatgcgccaggatttaagcgaaaaatatgatatcccggtattggcaatgagtgtagagagcatgcgggaatcagatgtgctgagtgtgctcagagaggccctctacgagtttccggtgctagaagtgaatgtcaatctcccaagctgggtaatggtgctgaaagaaaaccattggttgcgtgaaagctatcaggagtccgtgaaggaaacggttaaggatattaaacggctccgggacgtagacagggttgtcggccaattcagcgagtttgaattcattgaaagtgccggattagccggaattgagctgggccaaggggtggcagaaattgatttgtacgcgcctgatcatctatatgatcaaatcctaaaagaagttgtgggcgtcgaaatcagaggaagagaccatctgcttgagctcatgcaagacttcgcccatgcgaaaacagaatatgatcaagtgtctgatgccttaaaaatggtcaaacagacgggatacggcattgcagcgcctgctttagctgatatgagtctcgatgagccggaaattataaggcagggctcgcgattcggtgtgaggctgaaagctgtcgctccgtcgatccatatgatcaaagtagatgtcgaaagcgaattcgccccgattatcggaacggaaaaacaaagtgaagagcttgtacgctatttaatgcaggactttgaggatgatccgctctccatctggaattccgatatcttcggaaggtcgctgagctcaattgtgagagaagggattcaggcaaagctgtcattgatgcctgaaaacgcacggtataaattaaaagaaacattagaaagaatcataaacgaaggctctggcggcttaatcgccatcatcctgtaataccggtagacctctttatagaatgggaggtcttttttctttgctcttaataatggaaaaggatcaaggaataggatgaaaaaaggaaaaaaggaatattcgttcggtaaatcaccttaaatccttgacgagcaagggattgacgctttaaaatgcttgatatggctttttatatgtgttactctacatacagaaattcttcactttgttggacaaacattcctcagagtgcagtttttcttaaaaagccgtttaattgtctttctcttacttgctctcatttttttctgagacaggtttagaatcagactgaactgtgaagaaatgataataaacgaactgaatgtatccttttgggaggaggtgaaaggcatgaacaaaacagaacttatcaatgcggttgcagaagcaagcgaattgtctaaaaaagacgctacaaaagcagttgactctgtttttgatacgatcttagatgcacttaaaaacggtgataaaatccaactgatcggttttggtaacttcgaggtgcgtgaacgttctgcacgtaaaggacgcaatcctcaaacaggtgaagaaatcgaaattccagcaagcaaagtacctgctttcaaaccaggtaaagcgcttaaagacgcagttgccggaaaataattgtgaatatagatcgtgtatgcatctagcttacatacactttatttcttcacagaaaagcccctttctaaggggcttttcatatttcaagagcatgggcttcctgacagggcattcactttgcttttagcggggcatatgtgctagaatcgaaattaaatgtattcattggtggaggacatagaacatgaaagaagttaataaagagcaaatcgaacaagctgttcgtcaaattttagaagcgatcggagaagacccgaatagagaagggcttcttgatactccgaaaagagtcgcaaagatgtatgccgaagtattctccggcttgaatgaagatccaaaagaacatttccagactatcttcggtgaaaaccatgaggagcttgttcttgtaaaagatatagcgtttcattctatgtgtgagcatcaccttgttcccttttatggaaaagcacatgttgcatatatcccgcgaggcggaaaggtcacaggactcagcaaactggcacgtgccgttgaagccgttgcaaagcgcccgcagcttcaggaacgcatcacttctacaattgcagaaagcatcgtagaaacgcttgatccgcatggcgtaatggtagtggttgaagcggaacacatgtgcatgacgatgcgcggtgtaagaaaaccgggtgcgaaaactgtgacttcagcagtcagaggcgtttttaaagatgatgccgctgcccgtgcagaagtattggaacatattaaacgccaggactaataaagatagagggtgctataaatgaaccaaaagcattcaagtgattttgtcgtcattaaagccgttgaggacggagtgaatgtgatcggcctgacaagaggaacagacacaaagtttcaccattccgaaaaactcgacaagggagaagtgatcatcgctcagtttacagagcatacttctgccattaaagtcagaggagaggcactgattcaaaccgcgtacggagaaatgaaaagcgaaaaaaaataagctggctgtccccgctgttaaaagcaaatgctcgcaaacagcgggaggatacagccaatttctttttttatgctataatgatacctgcgtaagcgaatgaaaagataaaactcatacatagattaagaaataaatgtgaatttggggacaagggtgatatttttgcaagacatctacggaactttagccaatctgaacacgaaattaaaacaaaagctgtctcatccttatttagcgaagcatatttctgcgccgaaaattgatgaggataagcttcttctttttcatgctttatttgaagaagccgacataaaaaacaacgacagagaaaattatattgtaacagcgatgcttgtacaaagcgcccttgatacccatgatgaagtgacgacagctagagtcataaaacgagacgaaaacaaaaaccgccaattgactgttctcgcgggcgattatttcagcgggctgtactactctttactatctgaaatgaaggatatctacatgattcggacgcttgctacagccattaaagaaatcaacgaacataaaattcgtctgtatgaccgttctttcaaggacgaaaacgattttttcgaaagtgtcggcatcgttgaatcagctttattccatcgtgtggcggaacacttcaacctcccgcgctggaaaaagctgtcgagtgatttttttgtatttaagcggcttatgaacggaaatgatgcatttctggatgtgatcggcagttttatacagctgggaaaaacaaaagaagagatattagaagattgttttaaaaaagcgaaaaacagcattgagtcacttctgcctctaaattcacctattcagaacattttaataaaccgtctgaagacaatcagccaagatcaaacctatcatcagaaagtggaagaagggtaaaccattatgcaggactcaaaagaacagcgcgtacacggagtatttgaaaaaatatataaaaattatgaccaaatgaactctgtcatcagttttcagcagcataaaaaatggcgcgacaaaacgatgcgcatcatgaatgtaaaggaaggcgcaaaagcacttgatgtctgctgcggaacggctgactggacgatcgctcttgcaaaagcggcaggcaaaagcggcgagatcaagggcttggatttcagtgaaaatatgctgagtgtcggcgagcagaaagtaaaagacggcggattcagccaaattgaactgctgcacggaaatgcgatggagcttccttttgatgatgatacatttgattatgtcaccattggcttcggactccgcaatgtccctgattacttgactgtactgaaagagatgagacgtgtagtgaagccgggcgggcaggtggtatgtctggaaacgtcccagccggaaatgttcggattcagacaggcttactttatgtactttaagtatattatgccgtttttcgggaaactgtttgcgaagagctataaagaatattcttggcttcaagaatcagccagagatttccctggaatgaaggaactggcaggcctgtttgaagaggcgggcctgaaaaatgttaaatatcattcgtttactggcggagtcgctgccacgcatatcggatggaaatgaaaacacagatgtttgggtgaatgatatgaaatttaaaatggcctactcttttttaaatgacgatattgatgtaatcgaaagagaacttgaacaaaccgtacgttccgattacccgcttttaagcgaggcaggtcttcacctgctgcaggccggagggaaacgtattcggcctgttttcgtgctgctttctggcatgtttggcgattatgatattaataagattaaatatgtcgccgtcactctggaaatgattcacatggcatctttggttcatgatgatgtcattgatgatgcagagcttcgccgaggaaaaccgacaatcaaagcaaagtgggacaatcgtattgcgatgtacacaggcgattatatgcttgcgggatctcttgaaatgatgacgagaattaacgaaccgaaagcccataggattttgtcacagacgatcgttgaagtttgtctaggggaaattgagcagatcaaagacaaatacaacatggaacaaaatctcagaacgtatctccgccgtatcaaaagaaaaacagctctcttgatcgcggtcagctgccagcttggtgccattgcgtctggagctgatgagaagattcataaggcattgtactggtttgggtattacgtcggcatgtcttatcagattattgatgatattcttgattttacttcaactgaggaagagctgggtaaacccgtaggaggagatttgcttcaaggaaacgtcacattgccagtgctgtatgccctgaaaaatcctgcattaaaaaaccagcttaaattgattaacagtgagacaacgcaggaacagcttgaaccaatcattgaagaaatcaaaaaaacagatgcaattgaagcatctatggcagtaagcgaaatgtatctgcagaaagcttttcagaaattaaacacgcttcctcgagggcgcgcacgctcgtctcttgcagccatcgcaaaatatatcggtaaaagaaaattttaatttttgtagatattaagaaatttctccgccccggattgattaattatcagaaagatgttacgatttcggtgtgcagtgtgaaagcctatacatacataatgatggggtggagaatatgatggaaaagacttttatcatggtgaaaccagacggtgtccaacgtcagctcattggggacattttatctagattcgaacgtaagggcttacaattagctggcgccaagttaatgagagtgactgaacaaatggctgagaaacactacgccgaacatcaaggtaagcctttcttcggagagctcgttgagtttattacttcaggacctgtattcgcaatggtgtgggaaggcgaaaatgtcattgaagtgacgagacagctgatcgggaaaacaaaccctaaagaagctttacctggtacgattcgtggggattatggcatgtttgtcggaaaaaacatcatccacggctctgattctctcgaaagtgcagaacgcgagattaacattttctttaagaatgaagaattagtatcatatcagcagcttatggcaggctggatctattaatcattgtgaaaataagcaacagagccggcaacatataacgccgccggtttttgttctgttttgtaaaggtttacattaaagtgaataaagggttgaatggcagtgtgcatcagacctctgcctttcccaacgatctaaaatcagctgaaaagctgatttttttattgaaacaatacaatttcctgataaaacaagctatactaggacaaaaagacagcgagactgggagagtagagatggatacatacagcgtatttacaacgaaatggaaacaattaaccggagtcgatttaacactatataaagaagcacaaatgaagagaaggctaacgtcactttatgagaaaaaggggttccaaagctttaaggactttgctgcggcattggaaaaggatcaagctctcttaaatgaaacattggacagaatgacgatcaatgtttcagaattttatcgtaattataaaagatgggaagttcttgagactgcaattctgccgttaatcaagacctctaggcctttaaaaatttggagtgccgcctgctcaacgggggaggagccatacacgcttgccatgcttttggaccagcaaaaaggtcttccgggctatcagattttagcgacggatattgatgaaaaagcattggaaaaagcgaaaaaaggcgtttatcaggagcggtctttacaggaagtgccgctatctgtgaaagatcgttattttacgcaaaacgcaaatagaagttatgaagtgaaaacggaaatcaaaaagaatattacattcaaaaagcacaatttgctggcggatcgttatgaacaagactttgacttaatcgtgtgccgcaatgtatttatttattttacagaaagcgcgaaggaagagctgtatttaaaaatggcacatagcttgaagaagaatggagttctttttgtcggcagcaccgagcaaatcttcaatcccgagaaatttggcctagtcccagccgatacattcttttatcaaaaaagatagactgactttttgctgaaaaatatgttatagtagtcttacttaaaagcgttaatgcgatgaagggagaagaagtcatgagatatttaacagccggagaatcacacggcccccaactgacaaccattattgagggtgtacctgccgggctttacataacggaggaagatatcaattttgagcttgccagacgccaaaaaggacacggccgcggccgccgcatgcagatcgaaaaagaccaggccaaaattatgagcggggtgcgccatgcacgtacactcggttcgccaattgctctcgtagttgaaaataacgattggaagcattggacaaaaatcatgggcgccgctccgattacagaagatgaagaaaaggaaatgaagcgccagatttccagaccgagacctgggcacgctgacttaaacggtgcaattaaatataatcatcgtgatatgagaaatgtgcttgagcgttcttcagcaagggaaacaactgtcagagtggcggcaggggctgtagctaaaaagattctttctgagcttggcattaaggtggcgggccacgtgttgcaaattggcgctgttaaagctgaaaaaacagagtatacgtcaattgaagacttgcagcgtgtaacggaagagtctcctgtcagatgctacgatgaagaggcaggcaaaaaaatgatggctgccattgatgaagcaaaggcaaacggagattccatcggcggaatagtagaagtcattgtcgagggaatgccggtaggcgtgggcagctatgtccattatgaccgcaagctggatagcaagcttgctgccgctgttctgtcaattaacgcatttaaaggtgtggaattcggcatcggatttgaggcagcagggcgaaatggaagcgaagtccatgacgagatcatttgggacgaggaaaaaggatacacccgtgctactaacagacttggcggactggaaggcggcatgacgacagggatgccgattgttgtccgcggagtcatgaagccgattccgactttgtataaaccgctgaaaagtgtcgatattgaaacgaaagaaccgttttctgccagcattgaacgttcagacagctgtgctgttcctgcggcaagtgtagtcgctgaagcggctgtcgcttgggaaattgcgaacgcagtcgttgaacaattcggattagatcaaattgaccgcattagagaaaatgtggagaatatgagaaaactgtcgagggaattttaatgaagacactgcatgttcaaactgcttcctcgtcatatcctgtttttatcggacaaggtatcagaaaaaaggcttgcgaactattaacctctttaaacaggcctttaacaaggattatgtttgtcacggatgaagaagtggaccgcctgtatggtgatgaaatgctccatttgctgcaagaaaaatggcctgtgaaaaaagtgacggtaccgagtggagagcaggcaaaatccatggacatgtacacaaaattgcagagtgaagcgattcgttttcatatggatcgctcctcatgcatcatcgcattcggtggcggtgttgtaggggatcttgccggttttgtggctgccacttttatgcgcggcattgatttcatccaaatgcctacgacgctcttggcgcatgacagcgcagtcggaggaaaagtagccgtgaaccatccgcttggaaaaaatctaatcggtgcgttttatcagccgaaagccgtgctctatgatacagatttcctgcgttctctgcctgaaaaagagcttaggtccggaatggcagaagtgattaaacacgcttttatctatgacagagcgtttctggaggagctgctgaatatccactcactgcgtgatatcactaatgatcagctgaatgacatgatttttaaaggcatttcaattaaagcgtctgtcgttcagcaggatgaaaaagaagaggggataagagcttacttaaactttgggcatacgctcggccatgccgttgaggcggaatatggatatgggcagatcactcacggtgatgccgtagccctcggaatgcagtttgctttatatataagcgaaaagactgtaggctgtgaaatggacagaaaacgtttggtcagctggctaaaaagcctgggttatccaagtcaaatcagaaaagagacggaaacttcggttctcttgaaccgtatgatgaatgataagaaaacccgtggcgggaagattcagtttattgtgctcaacgaattagggaaagttgctgatcatacattttccagaaatgaacttgagagctggctgaacaaatggcgattggaggagacatcatgatgattcgcggaattcgcggagcaactacagttgaacgggatactgaagaagaaattttacaaaaaactaaacagctgttagagaaaatcatagaagaaaatcatacaaaaccggaagatgttgttcaaatgcttctgtcggctacacctgatttgcacgctgttttcccggcaaaagctgttcgcgagctttcaggatggcagtatgtaccggtaacatgtatgcaggaaatggacgtaacaggcggtctgaaaaagtgcataagagtcatgatgacggtccagacagatgtccctcaggatcagatcagacatgtatatttagaaaaagctgtcgtattgaggcccgatttatcattgacaaaaaatactgaattgtaatacgataagaacagcttagaaatacacaagagtgtgtataaagcaattagaatgagttgagttagagaatagggtagcagagaatgagtttagttgagctgagacattatgtttattctacccaaaagaagtctttcttttgggtttatttgttatatagtattttatcctctcatgccatcttctcattctccttgccataaggagtgagagcaatgaatttccaatcaaacatttccgcatttttagaggacagcttgtcccaccacacgataccgattgtggagaccttcacagtcgatacactgacacccattcaaatgatagagaagcttgacagggagattacgtatcttcttgaaagcaaggacgatacatccacttggtccagatattcgtttatcggcctgaatccatttctcacaattaaagaagagcagggccgtttttcggccgctgatcaggacagcaaatctctttacacaggaaatgaactaaaagaagtgctgaactggatgaataccacatacaaaatcaaaacacctgagcttggcattccttttgtcggcggagctgtcgggtacttaagctatgatatgatcccgctgattgagccttctgttccttcgcataccaaagaaacagacatggaaaagtgtatgctgtttgtttgccggacattaattgcgtatgatcatgaaaccaaaaacgtccactttatccaatatgcaaggctcactggagaggaaacaaaaacgaaaaaatggatgtattccatcaaaatcatctggagcttcaaaatctcattgaaaaaatgatggaccaaaaaaacataaaagagctgtttctttctgctgattcatacaagacacccagctttgagacagtatcttctaattatgaaaaatcggcttttatggctgatgtagaaaaaatcaaaagctatataaaagcaggcgatatcttccagggtgttttatcacaaaaatttgaggtgccgataaaagcagatgcttttgagttataccgagtgcttaggatcgtcaatccttcgccgtatatgtattatatgaaactgctagacagagaaatagtcggcagctctccggaacggttaatacacgttcaagacgggcacttagaaatccatccgattgccggtacgagaaaacgcggtgcagacaaagctgaagatgagagactgaaggttgagctcatgaaggatgaaaaagaaaaagcggagcattacatgctcgttgatcttgcccgaaacgatatcggcagagtagcagagtatggttctgtttctgtgccggagttcacaaaaattgtttccttttcacatgtcatgcacattatctcggtggttacaggccgattgaaaaaaggggttcatcctgtcgatgcactgatgtctgctttcccggcggggactttaacaggcgcacccaaaatccgtgccatgcagcttttgcaagaactcgagccaacaccgagagagacatacggagggtgtattgcctacattgggtttgacgggaatatcgactcttgtattacgattcgcacgatgagtgtaaagaacggtgttgcatcgatacaggcaggtgctggcattgttgctgattctgttccggaagccgaatacgaagaaagctgtaataaagccggtgcgctgctgaaaacgattcatattgcagaagacatgtttcatagcaaggaggataaagctgatgaacagatttctacaattgtgcgttgacggaaaaacccttactgccggtgaggctgaaacgctgatgaatatgatgatggcagcggaaatgactccttctgaaatgggggggatattgtcaattcttgctcatcggggggagacgccagaagagcttgcgggttttgtgaaggcaatgcgggcacacgctcttacagtcgatggacttcctgatattgttgatacatgcggaacagggggagacggtatttccacttttaatatctcaacggcctcggcaattgttgcctcggcagctggtgcgaaaatcgctaagcatggcaatcgctctgtctcttctaaaagcggaagcgctgatgttttagaggagctagaggtttctattcaaaccactcccgaaaaggtcaaaagcagcattgaaacaaacaacatgggatttctttttgcgccgctttaccattcgtctatgaaacatgtagcaggtactagaaaagagctaggtttcagaacggtatttaatctgcttgggccgctcagcaatcctttacaggcgaagcgtcaggtgattggggtctattctgttgaaaaagctggactgatggcaagcgcactggagacgtttcagccgaagcacgttatgtttgtatcaagccgtgacggtttagatgagctttcaattacagcaccgaccgacgtgattgaattaaaggacggagagcgccgggagtataccgtttcacccgaagatttcggtttcacaaatggcagacttgaagatttacaggtgcagtctccgaaagagagcgcttatctcattcagaatatttttgaaaataaaagcagcagttccgctttatctattacggcttttaatgcgggtgctgcgatttacacggcgggaattaccgcctcactgaaggaaggaacggagctggcgttagagacgattacaagcggaggcgctgccgcgcagcttgaacgactaaagcagaaagaggaagagatctatgcttgaaaaaatcatcaaacaaaagaaagaagaagtgaaaacactggttctgccggtagagcagcctttcgagaaacgttcatttaaggaggcgctggcaagcccgaatcggtttatcgggttgattgccgaagtgaagaaagcatcgccgtcaaaagggcttattaaagaggattttgtacctgtgcagattgcaaaagactatgaggctgcgaaggcagatgcgatttccgttttaacagacaccccgttttttcaaggggaaaacagctatttatcagacgtaaagcgtgctgtttcgattcctgtacttagaaaagattttattattgattctcttcaagtagaggaatcaagaagaatcggagcggatgccatattgttaatcggcgaggtgcttgatcccttacaccttcatgaattatatcttgaagcaggtgaaaaggggatggacgtgttagtggaggttcatgatgcatcaacgctagaacaaatattgaaagtgttcacacccgacattctcggcgtaaataatcgaaacctaaaaacgtttgaaacatctgtaaagcagacagaacaaatcgcatctctcgttccgaaagaatccttgcttgtcagcgaaagcggaatcggttctttagaacatttaacatttgtcaatgaacatggggcgcgagctgtacttatcggtgaatcattgatgagacaaacttctcagcgtaaagcaatccatgctttgtttagggagtgaggttgtgaagaaaccggcattaaaatattgcggtattcggtcactaaaggatttgcagcttgcggcggaatcacaggctgattacctaggatttatttttgctgaaagcaaacgaaaagtatctccggaagatgtgaaaaaatggctgaaccaagttcgtgtcgaaaaacaggttgcaggtgtttttgttaatgaatcaatagagacgatgtcacgtattgccaagagcttgaagctcgacgtcattcagcttcacggtgatgaaaaaccggcggatgctgctgctcttcgcaagctgacaggctgtgaaatatggaaggcgcttcaccatcaagataacacaactcaagaaatagcccgctttaaagataatgttgacggctttgtgattgattcatctgtaaaagggtctagaggcggaactggtgttgcattttcttgggaatgtgtgccggaatatcagcaggcggctattggtaaacgctgctttatcgctggcggcgtgaatccggatagcatcacacgcctattgaaatggcagccagaaggaattgaccttgccagcggaattgaaaaaaacggacaaaaagatcagaatctgatgaggcttttagaagaaaggatgaaccgatatgtatccatatccgaatgaaataggcagatacggtgattttggcggaaagtttgttccggaaacactcatgcagccgttagatgaaatacaaacagcatttaaacaaatcaaggatgatcccgcttttcgtgaagagtattataagctgttaaaggactattccggacgcccgactgcattaacatacgctgatcgagtcactgaatacttaggcggcgcgaaaatctatttgaaacgagaagatttaaaccatacaggttctcataaaatcaataatgcgctaggtcaagcgctgcttgctaaaaaaatgggcaaaacgaaaatcattgctgaaaccggtgccggccagcatggtgttgccgctgcaacagttgcagccaaattcggcttttcctgtactgtgtttatgggtgaagaggatgttgcccgccagtctctgaacgttttccgcatgaagcttcttggagcggaggtagtgcctgtaacaagcggaaacggaacattgaaggatgccacaaatgaggcgatccggtactgggttcagcattgtgaggatcacttttatatgattggatcagttgtcggcccgcatccttatccgcaagtggtccgtgaatttcaaaaaatgatcggagaggaagcgaaggatcagttgaaacgtattgaaggcactatgcctgataaagtagtggcatgtgtaggcggaggaagcaatgcgatgggtatgtttcaggcatttttaaatgaagatgttgaactgatcggcgctgaagcagcaggaaaaggaattgatacacctcttcatgccgccactatttcgaaaggaaccgtaggggttattcacggttcattgacttatctcattcaggatgagttcgggcaaattattgagccctactctatttcagccggtctcgactatcctggaatcggtccggagcatgcatatttgcataaaagcggccgtgtcacttatgacagtataaccgatgaagaagcggtggatgcattaaagcttttgtcagaaaaagaggggattttgccggcaatcgaatctgcccatgcgttagcgaaagcattcaaactcgccaaaggaatggatcgcggtcaactcattctcgtctgtttatcaggccggggagacaaggatgtcaacacattaatgaatgtattggaagaagaggtgaaagcccatgtttaaattggatcttcaaccatcagaaaaattgtttatcccgtttattacggcgggcgatccagttcctgaggtttcgattgaactggcgaagtcactccaaaaagcaggcgccacagcattggagcttggtgttgcatactctgacccgcttgcagacggtccggtgatccagcgggcttcaaagcgggcgcttgatcaaggaatgaatatcgtaaaggcaatcgaattaggcggagaaatgaaaaaaaacggagtgaatattccgattatcctctttacgtattataatcctgtgttacaattgaacaaagaatactttttcgctttactgcgggaaaatcatattgacggtctgcttgttccggatctgccattagaagaaagcaacagccttcaagaggaatgtaaaagccatgaggtgacgtatatttctttagttgcgccgacaagcgaaagccgtttgaaaaccattattgaacaagccgaggggttcgtctactgtgtatcttctctgggtgtgaccggtgtccgcaatgagttcaattcatccgtgtacccgttcattcgtactgtgaagaatctcagcactgttccggttgctgtagggttcggtatatcaaaccgtgaacaggtcataaagatgaatgaaattagtgacggtgtcgtagtgggaagtgcgctcgtcagaaaaatagaagaattaaaggaccggctcatcagcgctgaaacgagaaatcaggcgctgcaggagtttgaggattatgcaatggcgtttagcggcttgtacagtttaaaatgaggtgactgatttgcgtatcaaagaacatttaaaacagctgaagccttatcagcctggaaagccgattgaagcagtgaaatcagaatatggcttggataaagttgtgaagcttgcttcaaacgagaatccttacggctgttcagaggctgcaaaagaggcgcttcatcatgagattcaacagctagccctttacccggacgggtatagcgccgctttgcggacaaggctcagtaagcacctcaatgtcagcgaaacatcacttattttcggcaacggttctgatgaaatcatacagatcatctgccgggcatttttaaacgataaaacaaacacggttactgctgcccccacttttccgcaatataaacataatgcggttattgaaggtgctgaagtacgtgaaattgcacttcgtcccgacggctcacatgatttagacgccatgttagaagccatcgacgaacagacacaagtcgtttggatatgcagcccgaataatccgactggcacttatacatctgaaggagaattactcgcatttctggagcgcgttccttctcgtgtccttgtcgttcttgacgaagcatattatgaatatgtaacagcagaggattacccggaaaccgtgccgctcttaagcaagtattccaatttgatgattttgcgcacattttcaaaggcatacggtctggcagcgctcagagtcggatacggaattgctgacgagaacctgattcgccagattgagccggcgagagagccgtttaataccagccgtctgggccaggctgcggcgattgcagcacttgatgatcaagcgtttattgcttcctgtgtcgagcaaaataatgcaggccttcagcagtattatgattttgcgaaaactcatggtttaaagtgctacccttcacagacaaattttgtgttaattgactttaaacgtcctgctgatgaactgtttcaggctctgctggaaaaaggctatatcgtccggtcaggaaacgcattaggtttcccgacatcactccggattacgatcggaacaaaagagcaaaatgaagaaatacttgccattttagctgaaattttataagaggtgatcaaatatcacctctttagtctataaaccaggtgatgacgtatgaatcaaatgaaagatacaatattgctcgccggtctcggattgataggcggttcgattgccctagccatcaaaaaaaatcatcccggcaaacggattatcggaatcgacatctctgatgaacaggcggtagcggcattaaaattaggcgtgatagacgatcgtgctgattcgtttattagcggtgtgaaagaggcagctacagtaatcattgcgacacctgttgaacaaacactggttatgcttgaagagctggctcattcaggaattgaacatgagcttttgattacggatgtaggaagcacaaagcaaaaagtggttgattacgctgatcaagtgctgcctagccgctatcaatttgtcggagggcatccgatggcgggttcacataaatcaggagtggccgctgcgaaggagttcctgtttgaaaatgcattttatattttaacgccaggccagaaaacggacaaacaagctgtggaacagttaaaaaacctgctgaaggggacgaatgcccattttgtggaaatgtcgccagaggagcatgatggcgttacaagcgtaatcagtcattttccgcatattgtagcagctagccttgttcaccaaacccatcattcggaaaacctgtatccgcttgttaagcgttttgctgccggcgggttcagagatattacaaggattgcatcaagcagcccggcaatgtggcgggatattttattacataataaagataaaatcttagaccgttttgatgagtggattcgtgaaattgacaagatccgtacatatgtagaacaagaagatgcggaaaatctatttcgttattttaaaacagccaaggattatcgcgacgggctgccgcttcggcagaagggagcgatacctgcattttatgatttatatgtggatgtacccgatcatccgggtgtaatatccgagataacagcgatcttagctgcggagcgcatcagtatcacgaatatccgcattatcgaaacacgagaggatattaacgggattttaaggatcagttttcagtctgatgacgaccgcaaaagggcagaacaatgcattgaagcccgggcggaatatgaaactttttatgctgattgaggtggaaaaaatgaaacgagataaggtgcagaccttacatggagaaatacatattcccggtgataaatccatttctcaccgctctgttatgtttggcgcgctagcggcaggcacaacaacagttaaaaactttctgccgggagcagattgtctgagcacgatcgattgctttagaaaaatgggtgttcacattgagcaaagcagcagcgatgtcgtgattcacggaaaaggaatcgatgccctgaaagagccagaaagccttttagatgtcggaaattcaggtacaacgattcgcctgatgctcggaatattggcgggccgtcctttttacagcgcggtagccggagatgagagcattgcgaaacgcccaatgaagcgtgtgactgagcctttgaaaaaaatgggggctaaaatcgacggcagagccggcggagagtttacaccgctgtcagtgagcggcgcttcattaaaaggaattgattatgtatcacctgttgcaagcgcgcaaattaaatctgctgttttgctggccggattacaggctgagggcacaacaactgtaacagagccccataaatctcgggaccacactgagcggatgctttctgcttttggcgttaagctttctgaagatcaaacgagtgtttccattgctggtggccagaaactgacagctgctgatatttttgttcctggagacatttcttcagccgcgtttttccttgctgctggcgcgatggttccaaacagcagaattgtattgaaaaacgtaggtttaaatccgactcggacaggtattattgatgtccttcaaaacatgggggcaaaacttgaaatcaaaccatctgctgatagcggtgcagagccttatggagatttgattatagaaacgtcatctctaaaggcagttgaaatcggaggagatatcattccgcgtttaattgatgagatccctatcatcgcgcttcttgcgactcaggcggaaggaaccaccgttattaaggacgcggcagagctaaaagtgaaagaaacaaaccgtattgatactgttgtttctgagcttcgcaagctgggtgctgaaattgaaccgacagcagatggaatgaaggtttatggcaaacaaacgttgaaaggcggcgctgcagtgtccagccacggagatcatcgaatcggaatgatgcttggtattgcttcctgtataacggaggagccgattgaaatcgagcacacggatgccattcacgtttcttatccaaccttcttcgagcatttaaataagctttcgaaaaaatcctgaagttttacttcaggattttttatgcagatcataattcgaggcgaaaaaacatagcttgtcttatagaacggatagaaaaacgaaaaggggggatgtgctttacttacaagccggcaggtcaaagagctgctttactgtacagagggcgatcttccttttttcattttctatctcaagatcttttggtaaactaataagactcaataattcccttccgtacagaagcatcttatttgccgggggcattcgtctgaattatgataagattaacccgaacaaataaagctttttttgtatggttgatgttgtataggaaaagaaaggaccggtccgatttgaatacattgattcaagaagccataaaattagttgaagcaggtgaaacagaaaaaggcctcaacacgctctcgaaggctgaaaaacagctgcatgatgaagataaagccattgcagcccagctttattacgagtggggcgatgtagaaaaagccatttcactgattagtgatctacatgatttatatccaaatgaaacagaactgacgaatttctacgctgaacttttaatagatattgacgaagaagaaaaagccctcgctgtgctggagactattccggaaacagatccatcatatccggaaagtttgctgcttatggcggatctttatcagatgcaggggttattcgaagtcagtgaacaaaagcttttccaggcaaagtccattctggacaatgaacctgttattgattttgcactgggagaactttactttgctcagggagcctatgcaaaagcggttcaatattttaaaacaacggctgaggagcagagtgagatcgggggcgttaatgtccatcaaagactggcagaatcgttaagtgcctcaggtgaatttgaggatgccattccatggtatgagaaagctgtcgatgagaatcctgatcctaatacgattttcggctatggttttacagccttacaggcggggcttgtgaaaacagctattaagcagctgtctgatttaaaggagcttgatccatcttatacttcactttatatgccgctctcgaaaagctatgaagctgaaggaatgtatgaagaggcattaaaaacggcaaaagaggggatcagatatgatgaatataacaaagaacttttcctttatgccgccaaaatggccttgaaaatcgggaagtcagaagaggggaagaagctgcttcaggaggcgcttgcgcttgatccgggctttgtcgaggcgcttcatacacttcttgccgtgtatcacaaagaagaggattatgatcagatcattgatcttattcaagaggttcgaagctacggtgaagaagatcctaaatacaattggtatcttgcaagcgcatatactgaattagagcaatacgaggaagcaaaacaatcctttgaggctgcctatcttcattaccgggaggatagagatttcttatatgaatacgcaagcttcctattagaagaaggtcttcaaaaagaagcgctgccgcttttgaaaaaggttcttgaaatggacggagccaatgaagagcttgaagaaacgattttgcgaatcgaggatgaattttctagataagcaggaatattaaccattcatgtggaacatataagtatatagattatacgaacgatagaggagggaattacatgcagacccctgtttctgtcaatgagaaaaaagattttatccgttggtttttaaaccattatcagttaaagcgccgagagtgcgtttggatcttgaactacttaatgagccatgattctctcatggagaaggttcattttgtggagcaggctgaattttgcccgagaggcattataatgtcaacacattgtgttgaagaagttccgttccggttctataaagagaatgtcatgactaccgacgcggaaaaatcttttcatgatattagattaaataaacagcaggatttgtttatccagcttaatttccgttcggcttacagctcacctgaatatgcggcggtgctggagtccaacccgcatattccgaaaaacctttttgagaataaaaaagatcagggattggcggaacagattttagagcacgctatttccacattccaaagagaaaaattattaaaagacattgacgacgcgttagatcgtcatgataaagaggcatttgaacaattatcgcgccaattaaatcagctcacataatatgaccagccttgcagtgaattgcaaggcttgttgccgtaaagggggagaacgatgaggtggagaatcactgatgccaaggactatttacaagctaaggattacattgataccgctgtcataccattaattaacataagggttaataaccattttaaaatggcggcggagaaaggcgagtttacgcagcttctctcagaagaacttgaaaggcagttaaagggacgggtatatttacttccgccttatacatatgttgatagaaatgaaataaccgttcaagggcttaaggatttgcgggaagagctgataacggaatttccgcatgttgtcctgctcacatctgacgaaagttggagagctgaggatgcgttaggcaaaatgattgttacatcgtctgttccattagagcatttaaatgactctttaaaaagaaaaatattggatgaacgcactgctgaaattttgaacgttttgttacagttatggagcactttataaaaacacttacatttccttataaacaatattttggctatattgaccttgctgagagattcatatattatgagggtgtctagagttattgcaatattttctattttagtcagtttgcaggggtgacttagaggggggagaagagatgggcggaaaacatgatatatccagacgtcaatttttgaattatacgctcacaggcgtaggaggttttatggcggctagtatgctcatgcctatggttcgcttcgcactcgacccggtattaaaatcgacagggaagcaggatatggttcaggttgtcagcgttgatgagttgacaaaagagccgcagcgctttgattttaaaattaatcaagtcgatgcctggtatgagtcagaagagtcaagatcagcctgggtcttcaaaaacggggatgaaattgtagcactttcgccaatttgtaagcatttagggtgtacggtgaactggaatagtgatcctaaaaacccgaataaattcttttgtccatgccattacggactctatgaaaaggacggcaccaatgtccctggcacgccgccgcttgcgcctcttgatcattatgagcaagaagtaaaagacggcttcctgtatcttggaaaagcaaagcctaagggggaagggtgacatgctgaacaaaatttatgactgggtagacgagcggcttgatattacaccgatgtggagggatattgccgatcacgaagtaccggaacatgtgaatcccgcccatcatttctctgcgtttgtgtattgctttgggggactgacgttttttgtaaccgttatccaagtattatctggaatgtttttaacgatgtattatgtgcctgatatcaaaaatgcctgggaatcggtatattatttgcaaaatgaagtggcattcggccagattgtcagggggatgcaccactggggtgcgagcctggtcattgtgatgatgtttttacatacgctgagggtctttttccaaggcgcgtataaaaaaccgcgcgagctgaactggattgtcggtgtgctgatcttttttgttatgctcggtcttggctttacaggctacttgcttccttgggatatgaaggctctgtttgcaacaaaagtcggactgcagatcgccgaagccacgcctttgatcggaacgcaagttaaaacgctccttgcagggcatccggatattgtaggcgcccaaacgctgactaggttttttgcgatccatgtattttttcttcctgccgcattgttcgggctgatggctgcacattttattatgatccggaagcaggggatttcaggaccgctttaaactcttgatctgcgaataaaagggaggggatgacatgcaccggggcaaagggatgaaatttgtaggcgactcaaggataccggctgaaaaaaagccgaatataccgaaggattattcggagtatccgggtaaaacagaggctttctggccaaatttcttgttaaaggaatggatggttggagctgtctttctcatcggttttctcgttttgacgattgtgcatcagccgcctttagagcggatggcggacccgactgatactggttatattccgctgccggattggtattttcttttcttataccagctgttgaagtatgaatacgccgccggaagctttacagtggtcggcgccatgattatgccaggtctcgcttttggggccctgcttttggctccattcctagacagagggacagaaagaaggccgtggaagcgtccggtcgctgtcggtatgatgcttctggccatttccgctgctgtatttttgacgtggcagtcagttgctactcatgactgggccaaggcagaagaacaggggaaaattacaaaagaagccgacattgacaccaatgcagaaggatataaggtttttaaggaacagggctgtatttcttgccatggggataaccttcagggaggagcggccgggccttcattggttgacagcgggctgaaaccggatgaaatcaaaaaaatcgctgtagaagggaaaggcaaaatgccggcgggtgtgttcaaaggaaatgataagcagctcgaagaacttgcaaaatttatttctgaaacaaccgcaaaataacgtattgtgaattgtcaaatggaaggatatacttttattatcaaaagctgacccggcgtcagcttttttatttggacatattatttttacagactgagagttgattcgatgtgaaatggtttcaatatgtattagggcagcggccgatgcttattcttgtcttagccattaattttctgggaacggtttacggctactattggtacttgccgcagcttttggagacaccggcacgtttcctgatttttgttccggacagtccgacagcaacgtttttctttctgtttgtgctgcttgcctttctcatgaaacggaatgctccgttctttgaggcgcttgcgctagttaccctcgtaaagtatggcctatgggcggtggctatgaattttcttgtgcttgcagtaactggtgacttgccgtgggagggctacatgctaattgcttcgcattttgcaatggcagttcaaggcgtattatacagtccgtattttcgtttttcattttggcatcttgcaattgctgcagtctggacactgcataacgatgtcattgactacttgtttgatatgatgccgcaatactctatgctttctgattatatgactgaaataggatacggaacattttggctaagtatcttttcaatcgcgcttgcttactttcttgtggtctcaaaaaagcaaacgaagcttgagctgatgtaaagacaatgttggtctatccttgtccctttcttcatattctgtaaggagagagagtgggagggacctgcatgaaacgaaagctgacgatctgtttgttgattgcacttattttttataatggaaatgccaaggctgcagagcggggaagcctcgaggaattgaatgatttatccgatacagtctttcaaatgacccgacaggcgaaatatgaagaggcgcttcaagtcttggagtattttgaaaaaacattaaaatccgctgagaaaaaacagcaagaccccatgctaacgggagcccaaattcgtcaaatcacattgggctataatgatatggttcggagtttaaagcaagctgatacatcagacacacaaaaactcagagcagccgcgcagttcagaatgctgatggatgcggttgacaatcggtctgacccgctttggggctcactggaaaaaccgattatggaagcttttactgaactgaagcgagatgtccaaaagaatggaagcacaagctttcatgaaaaatggaatgaatttatcagtttatatgacttgatttaccccagtcttacaatcgatgtatcagaggatcagcttgaaacagtcggaaaacatatagatgttattgagcaagaggaatttcagcaaatgacagagagcacgaagcttgaacggctttcccttcttcagcatgacctgaaaaatgtgtttgacagggtggaggaggatgatgccgatccgtctttactctgggtgatcattacaaccggcagtatcatcattactgctcttacctatgtcggttacagaaagtacaaggcggaaaaaaacaagctgaaaaaaagggactaccctaaataaggatgaggggcggcggtcagccgccttttttctattacatgtcagcgcggaagcggatttttattttcatcaagcgtaaatccttctccgagcacatcgtgaacatcgcttaccgctacaaaggcatggggatcaatggagttaatcacgcttttcagcatcaccaattcatttttcggcaccacacaataaagtacatctatatcctcttttgtgtaggaaccttgtcctttcaaaatggtgacgccccgttccatttcttcaagaatctttttctgaatcaggtcgtttttcgaagagatgatcgtagcgcctttagcagcgtatccgccttcctgaataaaatcgattaatcttgccgctacaaatacagctaccagcgtatacatcgcttctttataggagagataagtaagcaaagacaaaatgatgacgcaggcatcgaaagcaaacatcgttctgcccatcggaatcccaaaatacttattcactaaacgtgcgatgatatcaacaccgcctgtcgtaccgccgaacttaaaaataatacccagtccggctccgatgaatacgccggcaaataaagcggcgagcgctaagtcgtgctgaaggggcatatggatttcatatcgctgaaagatgctgaggaacaaagacaaggctacagtgccgacaagggtataaacaaacattgtcctgccgagcaaacgccagccaataaaaaaaatcggaatgttcaacaccaggttcgatatagaggggctgatgtggaaaagggcataaagcaaaagtgtaatacctgtaaaaccgccctcagccagattgttctgcatattgaaatgaaccaagccaaatgaaaaaattgccgctccgattaaaataaaaaatatgttttttaatctaatttctccaagcatcacacaaaaccccttttccttccattagatagcgtttatattatagtggatgaaaaagaaaacagcaaacgtgcttaaacatttgtcaaacgtatctgaattagctaacatgtaagaggatgataggaggtttcgttcagtgagtgataaaacaatgcaagacatacaggctgaagtagaccgttacatcggccaatttaaagaaggatatttcagcccgctggccatgatggcgaggctgactgaagaactgggcgagcttgccagagaagtgaatcaccgttatggagaaaaaccaaaaaaagcgactgaagatgataaaagcatggaagaggaaatgggcgatgtgctatttgtattggtttgtttagccaactctcttgatatctctttagaggaagcccacgaccgagtcatgcataaatttaatacaagagataaagatcgctggaccagaaaagaagaaggaaagtagaggagatcaagatgtcaaacgaaacaattaaagtagtcattgcgggaccgcgtggaagaatggggcaggaagctgttaaattggcagaacgaacaccacattttgaccttgtaggggccatagaccatacatacgatcagcaaaaattatctgatgtgatgcctgttgagtcagatgctttcatttacacagatatccatgcctgttttacagaaacacaaccggatgtcttgattgatttaacaacgcccgaaatcggaaaagtacatacaaaaattgcattagagcacggagtccgtccagttgtcggaacaaccggtttctcagaagctgatttaaaagagctcacatctttaacagaagaaaaagggatcggagccatcatcgcgccaaattttgcgctcggtgcgatactgatgatgaaattttcaaaaatggctgccaactattttgaggatgttgagattattgagcttcatcatgaccagaagcttgacgcaccaagcggaactgcgcttaaaacagcggaaatgatttcagaagtccgtaaagaaaagcagcaaggacatccggatgaaaaagaaattctcccaggagcaagaggagcggagcaaaacggtattcgcttgcacagcgtccgtcttccgggactgatcgcgcatcaggaggtcatgttcggcatggatggccaaacgcttcagatacgccatgattcttataaccgtgcttctttcatgtcaggcgttaaactgtcagtcgaacaagtcatgaagattgatcagcttgtgtatggtttagaaaatatcattgattagacggggggataaacaatgaaaattgctttgatcgcgcatgacaagaaaaaacaggatatggttcaatttacgactgcctatcgggatattttaaagaatcatgatctatacgcaaccggaaccacagggttgaaaattcatgaggcgacaggtcttcaaattgaacgttttcaatccggccctttagggggagaccagcaaatcggtgcactgatcgctgccaatgcactcgatcttgtcatttttttgcgcgacccgctgaccgcgcagccgcatgaaccggatgtctcggcattaatccgtttatgtgatgtgtattccattccgctcgccacaaatatgggtactgcggaaattcttgtgcgcacacttgatgaaggtgttttcgaattccgtgaccttcttcggggagaagagccgaatgtataatgctgacgttcttgcttttggcgcccacagtgatgatgtcgagatcggaatgggcggcacaatagcgaagtttgtcaaacaggaaaaaaaagtaatgatatgcgatttgacagaagcggaactctcttctaacggtacggtcagtttgcgtaaagaagaagcagctgaagcagcccgcatattaggcgcagataaaagaattcagctaacgcttccagaccgcggcctaataatgagtgatcaggcaattcggtcaattgtcactgtcatcagaatctgtcggccaaaagcggtttttatgccgtataaaaaggatcgccatccggatcacggcaatgcggctgcactggtggaagaagcgatcttttccgccggaatccataaatataaagacgaaaaaagccttccggcgcataaagtcagcaaggtttactattatatgataaatggttttcatcagccggattttgttattgatatctcggatacaatagaggcaaagaaacaaagcctcaacgcctacaaaagccagtttatcccgtcaaaggattccgtttctactcctctgacgaatgggtatattgaaatcgttgaagcgagagaaaagctttacggtaaagaagcgggcgtggagtatgccgaaggtttcttttccaaacggatgctgatgcttgatcatgatgtgcttgggggcgaacaatgagaaaactaaaaataggaatcacatgctatccgagcgttggaggctcaggtatcattgcgacagaactggggaagcagcttgctgaaaagggacatgaaatccatttcatcacatcaagcattccgtttagactgaatacatatcatcccaatattcattttcatgaagttgaggttaatcaatatgctgtttttaagtatcctccgtatgatttgacattggcaagcaaaatcgctgaggtggcggaacgggagaatttagacattatccatgctcactatgctctcccgcatgccgtttgcgcctatcttgcaaaacaaatgctgaaacgcaatatcggcattgttaccactttgcatggcacggatatcacggtgttaggttatgatccgtctctaaaagatctgatccgttttgctattgagtcatcagacagggtgacggccgtctcctcagcgcttgcggctgaaacatacgatttaattaaaccggagaaaaaaattgaaacgatttataactttatagacgagcgcgtgtatctgaagaaaaacacagcggcaattaaagagaaacatggaattttaccagatgaaaaagtcgtcatccatgtgtccaacttcagaaaagttaaacgcgtgcaggatgtcatccgtgtgttccgcaatatcgctggcaaaacgaaagcgaagctgcttttagtcggagacggtccggagaaatcgacagcctgcgagcttatcagaaaatatggcttggaagaccaagtcttaatgcttggaaatcaagaccgtgttgaagatctttattctattagcgatttgaagctgctgctatctgaaaaagaaagctttggccttgtcctgcttgaagcgatggcttgcggagtgccttgtattggaacaaacattggcggtatccctgaggttataaaaaacaatgtgagcggatttttggtggatgtcggtgatgttacggccgcaacagcccgcgcgatgagcattttagaagatgaacagctaagcaatcgttttacaaaggcggcaatagagatgcttgaaaatgaattttcttctaaaaaaattgtcagccagtatgaacagatttatgccgatttagcagaaccggagtgatcacatggaaaaagtttttatcaaagcacttcccgtgctccgcatcttaatcgaagcgggccatcaggcttattttgtcgggggcgcagttcgtgacagctatatgaaacgaacgatcggagatgtcgatatcgcgacagatgcggcacctgatcaagtagaacggctgtttcagcggactgttgatgtaggcaaagagcacgggaccattattgtgctctgggaggatgaaacctatgaagtcacgacattccggactgaatctgattatgttgatttcagaagaccgtcagaagtgcaatttatctcatcattagaagaggatctaaaacgcagagatttaacgatcaatgcgatggccatgacagcggacgggaaggtgcttgattattttggcggcaagaaagatattgatcagaaagtgattcgaaccgttggaaagcctgaggatagatttcaagaggatgcgcttcgtatgctgagagccgtacgctttatgagccagcttggctttacgctttcaccggaaacagaagaagccattgcgaaagaaaaatcactcctctcccatgtttcagtcgaacgaaaaactatagagtttgagaaattgctgcagggaagagcttctcgccaggcgcttcaaacactcattcaaacgagattgtatgaagagcttcctggtttttatcataaacgagaaaacctgatttcaacgagtgagtttccattcttctctttaacatcccgtgaggagctttgggctgctcttttaattaaccttggcatagttttgaaagacgcgccccttttcctgaaagcctggaagctcccgggaaaagtgatcaaggaagccattcacattgccgatacgtttggccagagccttgacgcaatgacaatgtacagagctgggaaaaaagcactgctctcagcggccaaaatatcgcagcttcggcaaaacgaaaaactggatgaaaagaaactgaaggacattcagtacgcttatcaaaacctgccgatcaaaagccttaaggatcttgatatcacgggtaaggacttgcttgcgcttcgaaaccggccggccggaaaatgggtgtcagaagaattacagtggatcgagcaggctgttgtgacagggaagctctccaatcaaaagaaacacatagaggagtggctgaagacatgcggtcaacattaagaaaagaccttattgaattattttctcaggccggcaatgaatttatttccggccaaaaaatcagtgatgctctcggctgttcaagaactgctgtgtggaagcatattgaagagcttcggaaagagggttatgaagtagaagccgttagaagaaaaggatatcggctcatcaaaaaacccggaaaactcagtgaaagcgaaattcgttttggattaaaaacggaagtgatgggccagcatcttatttaccatgacgttctttcaagcacgcaaaaaacggctcatgagctcgcgaataataacgcaccggaaggcacccttgtggtggctgacaaacaaacagccggaaggggccgaatgtctagggtatggcattctcaagaaggaaacggtgtttggatgagcctgattttgcggcctgacattccgctccaaaaaacaccgcagctgactctgcttgctgcagtagctgttgtgcagggaatagaagaggcagcaggcatccaaacggatattaaatggccaaatgatattttgattaacggaaaaaaacagtcggtatcctaacggaaatgcaggctgaagaagaccgcgtacgttcagtgatcattgggatcggcattaacgttaaccagcagcctaatgattttccagatgaattgaaggacatcgcgacaagcctcagccaagctgctggggaaaaaattgatcgggccggcgtcatccagcatattttactatgctttgagaaacggtaccgggattatatgacgcacggatttacgccgattaagcttttatgggaaagctatgcgctcggtattggcactaatatgagagccagaacgttaaacggaaccttttacggtaaggcgttaggtatagatgatgaaggcgttctgcttttagaaacgaacgaaggcattaaaaaaatctattctgccgatatcgaattgggctaatgtgttggtacaagcccgttgattttggtatacttccattgggcagtatcgcctgcgaactgcacctattattaaaatagatagacattgcagcagtctgccttgatccaaaaaaggactgggacagagggatgaaactcgccgaactttagaaagtgaagaatccttctcgttgtaacggaaggttttttggcttgcagaagaaaacggcagatcatctcctctaaacatgaggaggagaaaacatgaaaacaaaactggattttctaaaaatgaaggagtctgaagaaccgattgtcatgctgaccgcttatgattatccggcagctaaacttgctgaacaagcgggagttgacatgattttagtcggtgattcacttggaatggtcgtcctcggccttgattcaactgtcggtgtgacagttgcggacatgatccatcatacaaaagccgttaaaaggggtgcgccgaatacctttattgtgacagatatgccgtttatgtcttatcacctgtctaaggaagatacgctgaaaaatgcagcggctatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataagatgagacagattactgatatttcacagctgaaagaagccataaaacaataccattcagagggcaagtcaatcggatttgttccgacgatggggtttctgcatgaggggcatttaaccttagcagacaaagcaagacaagaaaacgacgccgttattatgagtatttttgtgaatcctgcacaattcggccctaatgaagattttgaagcatatccgcgcgatattgagcgggatgcagctcttgcagaaaacgccggagtcgatattctttttacgccagatgctcatgatatgtatcccggtgaaaagaatgtcacgattcatgtagaaagacgcacagacgtgttatgcgggcgctcaagagaaggacattttgacggggtcgcgatcgtactgacgaagcttttcaatctagtcaagccgactcgtgcctatttcggtttaaaagatgcgcagcaggtagctgttgttgatgggttaatcagcgacttcttcatggatattgaattggttcctgtcgatacggtcagagaggaagacggcttagccaaaagctctcgcaatgtatacttaacagctgaggaaagaaaagaagcgcctaagctgtatcgggcccttcaaacaagtgcggaacttgtccaagccggtgaaagagatcctgaagcggtgataaaagctgcaaaagatatcattgaaacgactagcggaaccatagactatgtagagctttattcctatccggaactcgagcctgtgaatgaaattgctggaaagatgattctcgctgttgcagttgctttttcaaaagcgcgtttaatagataatatcattattgatattcgagaaatggagagaatataatatgtatcgaacaatgatgagcggcaaacttcacagggcaactgttacggaagcaaacctgaactatgtgggaagcattacaattgatgaagatctcattgatgctgtgggaatgcttcctaatgaaaaagtacaaattgtgaataataataatggagcacgtcttgaaacgtatattattcctggtaaacggggaagcggcgtcatatgcttaaacggtgcagccgcacgccttgtgcaggaaggagataaggtcattattatttcctacaaaatgatgtctgatcaagaagcggcaagccatgagccgaaagtggctgttctgaatgatcaaaacaaaattgaacaaatgctggggaacgaaccagcccgtacaattttgtagaagaaaagccccctttatcgggggttttcttttaagattttgagagtaaaacggttttgccgctccatttccgtacaaaacgtgttacacttttgtcgtatgcaagaattgaggtgtccattttaatgaataagcaacggttcgttgttatagatgtagagacaacagggaattcgccgaagaaaggcgataaaatcatacaaatcgcagcggttgtaatcgaaaatggacaaattactgagcggttttcaaaatacattaatccaaataaatcaatccctgcttttattgagcagcttactggaatctctaatcaaatggtcgagaatgaacagccatttgaagcagttgctgaagaagtattccaattgcttgacggcgcttattttgtcgcccacaatatccattttgaccttggatttgtcaagtatgagctacataaggcgggctttcagctcccagattgtgaagtgcttgatactgtcgagctctcacgcattgtttttccgggatttgaagggtataagctgacggaattaagcgaggagcttcagctgcggcatgatcagccgcaccgggctgacagcgatgctgaagtgacagggcttatttttttggaaatccttgaaaagctgcggcagcttccttatccgacattaaagcagttaagaaggctttcgcagcatttcatcagtgatctgacgcatttgttggatatgttcattaatgaaaacagacataccgagataccgggctatacgcgcttttcttcgttttctgtcagagaacctgaagctatcgatgttcgtataaatgaggacgagaacttctcatttgagatcgaaagctgggaagcgggaaatgaaaaagcgctgtcagagttaatgcctgggtatgaaaaaagagacggccaaatgatgatgatgagagaggtggctgatgcgtttgccaatcgtgagcatgcgctgattgaagctcctccaggcatcggaaaaacgattggctatcttattccggctgcgctttttgccaagaaatcaaaaaagccggtcataatcagcacgtattcgacgcttttacagcagcagattctcacaaaggatttgccgattgtccaagatctgtttccatttccggtaacagcggcgattttaaaagggcaatcgcattatttatgcctgtataaatttgagcaggtgcttcatgaagaagatgataattatgatgccgtactgacaaaggcacagcttcttgtttggctgacagagacaaatacaggagatgtagcggaactgaatttgccttcaggcggaaaattgctgtgggacagattggcttatgacgatgactcctataaaagaagtcgcagtgagcatgtgatcggtttttacgagcgggccaaacagattgctatgcgttccgatttggtgatcaccaatcattctcttttgctgaccgatgaaggcagccataaaaaaaggcttcccgaaagcggcacatttattattgatgaagcacaccattttgaacgtgcggcaagcgaacatttagggaaaagagccacgtacatagaattgcatacgaaattgagcagaatcggcactctgaaggagcagggacttctaaaaaagatgagacagctattccagcgaaacagcctgccggttgattcatttttcgaattggaagagtggcttcagcacgttcaagcagaaagtgatgctttctttagctctgtacattcttttgtcaaacgaagaaaacctaaagaagacttaaaccgtctagtgtttaaggtgaacaaagaaagccaggataaaagctggtcgatcttaacagatggtgcggagaggctttgttccatgctgacacatttgcagcagctttttgaggcgcagtcatcccttatggaaaaacatttgaagggcatgaagagcaaaaccgtctttttagccgatgaataccaaagaagcatgaaaggcttgcagcattactgtcagacgttgcagaagctcttctttggctctgatgacgatgaagcggtttggattgaaatagatgcaaagggtgcgaaaaatgcagtggccatttacgcacagcctcttgaacctggtgaacttctggctgatcagtttttcgcgcgcaaaaatagtgtggtgctgacatctgcaactcttacagtcgaaggttcttttcaatttatgattgaacgactgggactgagtgactttttcccgcggacaatgagaattgagtcacccttttcttacgatgagcgtatgcaggtgatgattccaaaagaaatgaaatcaattcaggatacagggcaacctgaatttatacaggatacagcccgttatatcgaactgatggcaaaggaaaaacagcctaaaatccttgtgctgtttacatcccatgatatgctgaaaaaggttcaccaggagcttaagcataacatgagtgcttccggcattcagctcttggcacaagggattacaggcggaagtcccggcaaactgatgaagacttttaaaacatccaatcaggcgatcctgctcggaacaaatcatttttgggaaggcgttgatttccctggtgatgagctgacgacagtaatgatcgtgaggctcccattccggtcccctgatcacccgcttcatgctgcaaaatgtgagcttgcccgcaaaaaaggaaagaatccgtttcaaacagtgtcattaccggaagctgtgctgaccttcaggcaaggaatcggacgcttgctgcgttctgcgggagacaagggaacgattattatattggacagacggattaaaaccgctggttacggccggctgtttcttgatgccttgccgacaacctcagtatccgaaatgactgacagcgagcttgaagcttatgttgcaggggaaaaagaataaaagccgcataaagcggcttttgcggtgtgggagtaggatggtgttttatttaaaagcggatttcccgctctgtgatactagtatggcgtgtcctgaaatggagtatgactaacaatatttgttcaaactggaggatgaaaaaatggaaagtaaaatcgaaattctttcaacaattaatgtagagcattctgatgatctgtataaaattgtggacacattgaatcgtacactgaaaagagacaatctgatgttcggccttgcgctggatgaagaaaacaaaaaccaagccgtttttaccatttatcgtacgtaggtgagaagatgagaaaaaaagcattaatatttaccgtcatttttggtattatttttttagcagtacttcttgtctcggcaagcatttataaatcagccatggcacaaaaggaagaggggcacgaagcagcagctgctgaagctaaaaaagaaaccgatctcgcccatgttgatcaagtcgaaacatttgtcggaaaagaaaaatattatgttgtaaagggaacggataaaaaaggcactgcattatatgtctgggttcctgctgataaaaaagcaaaaattctctcaaaagaagcgaaagagggaatctctgaagacaaagcggcgaaaatcataaaggatgaagggctggtttcaaagcaaaaagaggttcatctggcaagagaaggaaacgtcctgctttgggaagtgacgtacttagacaaagaagggcaatacagtttaagttatgtggactttacaactggaaagattctcaaaaatatcacgccttaagacgaattagggggagttcaagttgaaactggcaaaaagagtatccgcattaacaccatcaaccacactggcaatcacagcgaaagcgaaagaactgaaagccgcaggccatgatgtcatcggcttaggagcaggcgagcctgacttcaatacaccgcagcatattattgatgccgctgtgcgttcgatgaacgagggccatacgaaatacacgccttccggtggtttggctgaactgaaaaacagcattgcagagaaatttaaacgcgaccagaatattgaatacaaaccgtctcaaattattgtctgcactggtgccaaacatgctctgtatacccttttccaagtgattttggatgaagaagatgaagttattattccaacgccttactgggtaagctacccggagcaggtgaaactcgctggcggaaagcctgtttatgtagaagggcttgaggaaaatcacttcaaaatttcgcctgagcagctgaaaaatgcaattacggaaaaacaaaagcaatcgttattaactctccaagcaacccgactggtgtcatgtatacggaagaagaactatctgcgctcggtgaagtgtgccttgaacatgatatcttgattgtgtcagatgaaatttatgaaaaacttacatacggcggaaagaaacatgtttccattgcacagctgtcagacagactgaaagagcaaacggtcattataaacggcgtatcgaagtcccacagcatgacaggctggagaatcggttatgcggcaggctctgaagacattattaaagcgatgacgaaccttgcaagccacagcacgtcaaacccgacatcaatcgcacaatacggagcgattgctgcttataacgggccttctgagccattggaagaaatgagagaagcatttgaacatagattaaatacgatctatgcaaagctcatagaaatcccagggttcagctgcgtgaagccggaaggtgctttttacttgttcccaaatgcaaaagaggcagctcaatcttgcggtttcaaagatgtagatgaatttgttaaagcgcttctcgaggaggaaaaagttgcgattgttccaggatccggatttggctctcctgagaatgtccgtctttcttatgcaacatcgttagatcttcttgaagaagccattgaaagaatcaagcgttttgtagaaaaacatagctaacagatcaaaaagcggctgacagaaaagccgctttttatctgcattgacccggttagttaagagcgggtataataaagtgatgataaaagagttcgcggggcaatgagcttccgaatgtctttcttgttttggagggaaatatgttgaaaacaacaatcaaccaagtgtacaagcacgtaggtgaggaagtaacgatcggagcttgggtcgctaataagcgttcaagcgggaaaattgcgtttttacagcttcgggacggtaccggttttattcagggtgtcgtagtaaaagcggaagtggaagaaagcattttccaaacagctaaatcagtgacgcaggaaacgtcgctctatataaaagggattgtcaaagaggacgagcgttctccgcttggatatgaacttgctgtgacagatattgaagtcattcacgaagcgaccgattatccaattacaccaaaagaacacggaacggaatttttgatggatcacagacatttatggctgcgttcaaagcgccagcatgcgatcatgaaaatccgtaatgaaatcattcgcgcgacttacgaattctttaataacgaaggcttcgtaaaagtggatccgccgattttgactggaagcgcacctgaaggaacaacagaactctttgcgacaaagtactttgatgaagatgcatatctgtctcaaagcggacagctctacatggaagctgcggcaatggctttaggaaaagtattctctttcggaccgacattcagagcggaaaagtctaaaacaaagcgtcacttaatcgaattctggatgatcgaaccggaaatggcgtttgtagaatttgaagaaaaccttcaagtacaggaaaattacgtttctttcatcgtgcaatcagttcttaaaaattgcaaaattgaactaaacacattgggaagagacacgtcaaaacttgagcaaatcaaagccccgttcccaagaattacgtatgatgaagcgattgaatttctgaaagaaaaaggctttgacgatatcgagtggggagatgatttcggagcgcctcatgaaacagcgattgctgaacattatgacaaaccggtattcatcactcgctatccgacgtccttaaaaccgttctatatgcagccggcttctgaccgtgaggacgttgtgctttgcgctgacttgattgcgccggaaggctatggagaaatcatcggcgggtctgaacggattcacgatatggaacttttggaatcgcgtcttaaagaacatggactggattctgacgcttataaatggtatgctgaacttagaaaatatggatcagttcctcattccggcttcggccttggattagagcggacagtagcttggatcagcggagcgcctcacgttcgtgaaacgattccgttcccaagactgttaaaccgtctgtatccgtaatacattcaaatgaaacaaaaaagagtctcctgcaagggagactttttacagtaaaggggcaatcacaatcctttacagtaagaggtgtgacgatgaaaaaacagcaatttattgatatgcaggagcagggaacatcaaccatccccaatcttctgctcacgcattataaacagcttgggcttaatgaaacagaacttattctgctgttaaaaattaaaatgcatttagaaaaaggatcatattttcctacaccgaatcagctgcaggaaggtatgtcaatttctgttgaagaatgtacaaacagattgcggatgtttattcaaaaaggctttctgtttattgaagaatgcgaggatcaaaacggcatcaaatttgagaaatattctcttcagcctttatggggcaagctgtacgagtatattcagcttgcacagaatcaaacacaggaaagaaaagcagaaggggaacaaaaaagcctttataccatttttgaggaagagttcgcaagaccgttatcgcctttggagtgtgaaacgctggcgatctggcaggaccaggatcagcatgacgcacaactgatcaaacacgcgttaaaagaggctgtactatcaggaaaactcagtttccgctacattgaccggattttgtttgaatggaagaaaaatgggcttaaaactgtggagcaggcaaaaatacacagccaaaaattccggcgtgtacaagcaaagcagaatgaaccgcaaaaagagtataaaaggcaggttcctttttacaattggcttgaacaataaagtgaaaaggtgacaatcgtgttaaatctaaaacaaattgaattctgtttagacaagataggtgacatgtttcctcatgcggagtgtgaactggttcattccaatccttttgaattagtggtggctgttgctttatctgcgcaatgtacagatgcacttgtaaacagagtgaccaaaacattattccaaaaatataaacggccggaagactatttggctgttccgctggaagagcttcagcaggatattaaatcaatcggtttatatcgtaataaagcgaaaaatattcaaaagctgagtaaaatgattattgaagattacggcggagaagtgccgagagaccgcgatgagcttgtcaaactgccaggggtcgggagaaagaccgcaaacgtagtggtatccgttgcgtttggcgtgccggccatagccgtagatacccatgtggagagagtcagcaaacgattgggcatttgccggtggaaggactcggttctggaagttgaaaagacgctgatgcgcaaggttcccaaagaagattggtccgttacgcatcaccggcttattttcttcggcagatatcactgtaaagcccaatctccgcgctgtgcggagtgtccgctgctttctttgtgcagagaagggcagaagagggataaaaaaggactggtgaaacgatgacgcaagcaaaagaagtgttggcttcctatgagcaatacttgcgcagtcttggccagaagagttcctcggatatgaagaaaaccttgcagaccaatcccgtgtattttgatttctgcacggaattacaaggcgatttgccatgggaggacagcgggaaatacgttccgcttttatttgaagtgtgggatgacatcaaagcatcacttctcccagtctttcaaacacgaaaatcgagatgtgaccaaaacgaaatgttaaagggcattgtgtgtttgctggcttcgttacattggacagcaggtgagccggtgaaatcgctcgattggcaagaactgagggagaaatcatatcccgcaaagccgattaattgggctgaacgagtggaatttattcttcttaagccgacccaataccattgctttattcagcttgatgagctgattaccgaaatgaaaaagcatttttataaatatcatgcgatgaatcgataaaacctcctgttaaaacgggaggttttttattgtgtaccaaaaaagccatcaccccaaaggtgacggctttttgtttaatttgtttttcaatggatgatgagtttgtttgtgttttattagatgtgtctgttttatttttattcgtgtcagaacctgttgaatcattcttaccagagttcgaatcaccatccgacgtatcctggttgttactgttgtcgttatcattatcgtttgattggtcttggttattgttgtcggacggattggtgttcgtattgtcttgttttttgtcttgatcgtttgttgaatcatctgtctgatcttgatccgtctgaccgtcatctttttgagaatcatcagtttgtgtatcatcctgagtcttctcatcatcttgtttttcatcatccgtttgttgctggtcttttttatcttcatcgtcttcagcttttggcacctcataagatgtggaagctgtacttttgccatcatcactgacggctgttacttcgaatttgtatacagatcctggctgcacacccgaaataactgcctcttttgcagagctgttttgaatttccgagtagctgccgccgtcaacagattgcttaacagcaaaggtcgcatctccgtcgtaattccagcttaacgttaaagattgattgtctttatcgtatttcacgtttaaaccagacagtttagctgtttcctctttttcttctttctcatatgttttagaaacagtagaaggagctgtgcctttaacaaagtactctgtgagcttcttatcgcttggcgtatttggccctgccagttttgccggattagaacctttttctacggtggcttccactacgctgtcaggcttctcaaatgatccgcttccgtcatcgacatcggcgatgagctgggcgaagatgcgctttgcaactttttgctcttcagctgaaagtgatttctttccagcctcgttttctcccattcccgtccagacggcagctgtatattgcggtgtgtagccaacgaaccaagaatctcgggcgccaccgctagcgatattgtaccttttgacttcattatcatcaaagttagtcgttcctgtttttcctgcaacttctacaccaggtacttgtgcaagctgtccagtacctgtcttcacagctgttttcagcatatctgtaatcataaacgcagtataatcactcatggctgattttgattttggtgttaagtcaagcttcgtgccatcgttaaattcgatagattttacaaaatgcggttcattatacgttccgttatttccaaacgcgctgtatgcacctgccattgtcagaggagaaacaccatcgttcccaccgaaaccgccaatagaataggcctctgttacattatcttttgttaaaccaagcccgagtccatttgcaaagtctacagcagtatctttaccgactgcctggaatgcttttaaagcaggtatatttcttgattgggccagagcgtaacgcattgagataggccctagatatttgcggtcccaatcacgaatcggttttccgttagaatacgtataagctgagtcatcaatttgttcgtatgtggaccatttcttattttcaataactggtccgtagtccaaaatcggttttatggtcgaaccaggctgtgccttagtttgagtagcatagttaaagcctccgacaggctgattgcgtcccgcaccaatcgctcggacttctccgtttttggtatcgagaagcgtcacaccgccctgcatgccttcagtaaatccgacggtgtctccgtccattaattcatctagtttatcttgtgcttttgtatctaatgtcgtatagatctttaatccgtcagcagatggatcgacatcagatttttcatcaatttccttcataacctcttcaacaaatgcgctgtatttgtttgtacttgctttttcatattccttctgtgacacgacgccttcgtctttcactgccacttttttcgctttgttatattgagaatcagaaataaatccttgctttttcatcagactgagtacgatgttccgtcgtttttccgctttatccgggtttttgaccgggttgtacgctgttgggctctgcggcattcctgcaagcgtcgcagcctgttcgacagtcaatttgcttaaatcagtaacgccgaaaaattcttccgccgcttttccgattccgtatgctctaggagaaaaataaatccggtttaaatacatttctaaaatttcatctttagagtaattgcgctccagctgaatcgaaagccatacttcctgcaccttccgtttcaacgtcttctgatgtgaaagaagggagtttttgacgacctgctgggtgatcgtacttccgccttcagccccgaagccgtctttaaagttggcaactaatgcaccgccgatacggacagggtcaatcccgtggtgctcataaaaacgagcgtcttctgtcgcgataaaggcttcttttacaacatcgggaatttcatctatcgagacgtaggtccgtttttcggcgccgacttcggcgatctcttttccatttttatcataaatcgttgatgaataaggcgtcttcaatttgctttcatcaagggacggcgcatcagaaaccatgacggcaaatgtaacagcaccgccgactacgcctaaaacaaacagaatgagtaaagtgaaaagggtctttttaaacaatccgcccttttttcgtttcttgccttttttcggtgaaggactcgatttgctgttcgcttttcgtcgagcttcacggctgttaaattgatctgacataacatctcaacctttcgttaatcaacctttcgcaccagatgatggcgaaaaataaagctgttcaataatactaatataatcaattctgggtgcgtatccaagagaaatcggataagctgtttcttccaactcatcttttcgaattgattttctgccgtttttttcttttctgtcccagaaataaaacagcttatcggcttccaaaaaataaacctggtcgaaagcggatataataacaaaacaaataccgtcttgagcctttacctgcttcatatgctcgatttgatggtcatgaaaattctgcagggggaaagaggtcttgtttttcgtttctttcgcctcaaaatcaatataccgccctttgtaaatcccattgtagtctgttgtcgatgattgtttaaagtaagcttctttaatcactgcggcacttctttttggataatggacatttacaatttgaacaggtgtcggctttttgtgtataacggcaatttggtttgtcagataatacttattcgtttcgtttaagtcatcttcgagggtcattccgcgattactgtaagacggggcccttttctgactgttttgggatgaaaccgaatgtttcggctgaaatgtttttccattaggataccgaatcactttctcatcctccttattaaactaatcatgacggaagtgaatgaacgtgcaagaacaacaggccatcagaaagcttctgagccggattgagcggcagacaaaaatgaaaaacgcggataacatttcaagaacaaatgcttataaagcattttacgaccgtcatccggaaatcaaatggtcgcttttggcttctttcgtttctcgtaatgccggctggtcaatgactgacttaaaaggcagtctgtttcagcttggactccgtgagagacagcaaaaatggttctttttagcctatgaaagagcgaactggcttattttttcggatgcctatccgcagcttcttttataccactggtcaaaaagagttgggaaaccgctgtttcatctgctgcatgtgtttggcgtctcacaatttatgtcggaagaatggacccgtttttggcatgagcgaaatacggagcggctaatgtatgccctcattataaatgaacaaaacactatccaaacacctattatacaaaatccttcgtttaaaaagaatgtttttgacacgattcctttttatttaagtgactggtttcattttaacaccgttatttttccttcctcaaatgggtttttttacggcatttcagtgaaacgcttttcaaaggcggaggaaaggataaggctgggaaagcagctgtctcaattgctgttcaagccagaattgttctcctctttttatcactttttgcacacagtgccgcacacaggttcccgttttgatatggaaaagatgatcgggattacaaaaagaacatctcctatgctaaggacatgctaccctgagttaatccactcattagacggaacgaaaacagattggtttcatggaaagataaagaaaacgttctttaggcgcgaggaattgccgaagcagattgaattgacagactggtatttacataaaaagcgccagcttcatgcgctttttgcggtggagcagtggctgaaaaaataaagaagcaaggaaattccttgcttcttacgtagaagggcggttcgggccgcctaattttttatctaaagaatcgattgcctttgattcagtctttttttgctggccggcttttttcggtcttgttttcatacggcacctcctcacaagtatcgtttgcattaatgaggaggatcatacaatttttgcgggtgtttttgtcgaaaacttcagcttttcgtggaatacctgtttgtttggcgatttgcttctagttttgtcatgaggaaggaaagagccttgagagcaaagaatgttaaccgggagagacaaggaaagggaggtacacgaatgtccggttatgtatgcaagacagatattctccgtatgctttctgatatagaagatgaattaacgcgagctgagcaaagcctgaatcattctgtaaatgcattagaggctgagatgcgggaaacggagaacgatcgcctaagtgtgctcgaagaagaaatcatagatcttcatatttgtataaatgagctgtatcaatcgcctgaacacaggtatgcgtttgagaaggtataccgcatcggctgaatttgtgagtgaaatttggtacgataggcattgaggtgaaagatattgctatcacaaactttgctggaaatgaccgagcaaatgattgaagttgctgaaaaaggcgctgatcggtatcaggaaggaaaaaacagtaatcattcttatgatttttttgagacgataaagcctgcagttgaagagaatgatgaactggctgctcgctgggcagagggtgctcttgaattgataaaagtccgccggccaaaatatgtgcataaagagcaaattgaggccgtaaaggataatttcctggaattggtccttcaatcttatgttcatcatattcataaaaaacgattcaaggacatcactgagtcagtcctttatacattgcacgcagtaaaggatgaaattgcaagagaagacagccggtaaaaggctgtcttcttttcgtttttatagggggccggacgttaattcatctcatatgccgggctttctgctccatttgcttcgagaaccttcatactgttacgaaactcagttatgctgagatgtccttgaatatagaggaacttggcaaagtccatcagtttattcatacagtctgtttcatatttcttcatttctgcaaaacgtttgcttaagtatgatacgttcattatggtgcatcccctctcatctgtattgaaaatatggtaccataatgattcgacttttttctgtttttaaaaaatttaaactttcgacacaatttgacaaatgctaatcatcacttgtgacacaaacaatagaagtcattcatacatatatagaagagaaatatgttgtgtttaggggggaatcgcaatgaacgggagctctcgaagctatcctcggcaaatgggctattattatcctcagcatatgcaaggatattatcagcaggctgcacccggttatttagagcaacaactgcctcagcagcattatggacagcaggattattatcagccttatgctccgatccagcctatgcctatgcagccgcctgtattttctaacccttatcctatcccaaggcctaatcaacagcagccttcacaatttcaaagcattatgtcgcagttcaaaaaagccaatgggcaatttgattttaataaaatgatggatacgacaggtcaagtaatgagtgcaatgaatcaggtcggatctttaataaagggatttaccagcttttttaaatgatagaagcatgaatgaatcgttcattcatgcttattttttggaaagaaaagtgtcattgtctgctcgttccaagacgtttccatatcttcttggcgaacttcataaggcagctgaaccgttcttgtcatgcttgtaaaggtagcctcattttggtgtttctgtttttcttggagtgttacatggagatacctcgatttaacatcaacgacgatctcgccatctcgaaacgtcgccggaatggtaatatcgatatacagcccagtatctctttctctgacatgtatggtcgtctgcacatcctttaaactcgagttgattaggttctgaaatccgtttataaggttgccgaacgctgaggattgaaaaagagtgtcgattgcctccgttatgatttcttctttcttttgcagttcgttctttttgtcatcatggaattccaatatcgccaccgccttttttaaccagattatgcgtctatgccagatgttgttataaattgaagcaaaattgaaagtgtggttaaatagtggtgaatgaagggataacggttgaagtgaatgagaagggagaaaatacattgctgaaaaaattattcggaatgggcaaaattcaggaaaaggtgacagaagaggttatttattctccggcagacggtacagtaatggacctgtcagatgtaccggaccctgttttttcacagaaaatgatgggagaaggaatagcggtggaaccttctagcggtgaaatcgtttctcccgctgaaggtgaagtcattcagattttccacaccaaacacgccgttggcattcggactcgctcgggaattgagctgttaattcatgtcgggctggagacagtcaatatgaacggagaaggatttactgcccacattaaagaaggggataaagtgaaggtcggtgacccgctgattacatgtgatttggaattaataaaagaaaaagcgagcagcacagtcatcccaatcgttataatgaatggtgaggctgtaggatcaatggtatcggcaggcgaaaaggctgctcgtaaaggcgaatcaaagctctttacaataaaagcgaaataagcagggcgtatgccttgctttttttattcaactgtataaaatttgcacctagccatgcaaacaaatattcggtaaactgtacttgacaaagaggtgtaaagaatgaaaaagaaatcactgactgaactcatttctgatttaaaaggaaatgaaaacgttgtgaattggcatgaaattgagcctcgggaagcaaaaacaaggcctatgcccgaaagtatagacgagagaatcaaagcggccctttcgaaaaggggcattgatgaactatatactcaccaatattccgcttttcaatatgtgcaaaaaggagagagcatcgttaccgtaacgccaacagcatcaggaaaaacgttatgctacaacctcccagtcctgcagtccatcgcccaagatgaaacaaaccgggcgttatatttatttccgactaaagcgctggcacaagaccaaaagagcgagctaaatgaaattattgatgaaatgggcattgatattaaaagctttacatatgacggggatacgtctccggcaatcagacaaaaggtgagaaaagcaggtcatattgtcattacaaaccccgatatgctgcattctgccattctaccgcatcatacgaaatgggtcagtttgtttgaaaaccttaagtatatcgtcatcgatgagcttcatacgtatcgaggtgtgttcggcagccatgtggcaaatgtgatccggcggctgaagcggatctgccggttttatggaagtgatccagtttttatttgtacttccgcaacgattgccaacccaaaggaattgggagagcagctgacaggcaaaccgatgcggctggtcgatgacaacggcgcaccgagcggacgcaagcattttgtgttttacaatccgccaattgtgaacaaaccgctgaatattagaaggagcgcaaccgcagaagtgaatgaactggcgaaagagttccttaaaaacaaagtgcagaccattgtttttgccagaagcagagttcgggtggaaattattttaagccatattcaggagcttgtgaaaaaagagattggaacaaaatcaatcagaggctatcggggaggctatctgccgaaagagcgaagagaaatcgaaagaggactgagagaaggcgacattttaggagtggtcagtacgaatgccttagagcttggtgttgatatcggccagctgcaagtgtgtgtaatgacggggtatcccggaagtgttgcaagtgcttggcagcaggcgggacgagccggcagaagacacggtgaatctttgattatcatggtagccaattcaacaccgattgaccaatatattgtgcggcatcctgaatatttctttaatcgttcgccggaatctgcaagaatcaatccggagaatttgattattttagtagaccacttaaagtgtgcggcttatgagcttccttttagagctgatgaagaatttggagccatggaagtcagtgatattcttgagtatcttcaggaagaggctgttcttcaccgcaacggcgaacggtaccattgggcaagtgagtcgttccctgcgtcaaacatcagtttgcgttccgcctcccaggaaaatgtcgttatagttgatcagtcggatattgcaaatgtaaggattatcggtgaaatggaccgttttagtgcgatgacgcttttgcatgatgaagcgatttatttgcatgaaggcgttcagtatcaagttgagaagctcgattgggaccataaaaaggcgtatgtcagaaaagtcgatgtcgaatattatacggatgcaaacctggcagttcagctgaaggtattagaaatcgataaaacgaaagaaaaaagccgtacgtcattgcactacggagacgtcactgtcaatgccctgccgaccatttttaaaaaaataaaaatgaccacttttgaaaatattgggtctggacctattcatttgccggaagaagaactgcatacaagtgcagcttggctcgaaatcaaaacagcggatgaagacatcggggaaaagacactggaacagctgcttcttggcatctcgaatgtgctgcagcatattgtccctgtgtatatcatgtgtgatcgaaatgatgttcatgttgtttctcaaattaaagcagcccataccggattgccaaccatatttttatatgatcattatccgggcggtatcggtttggcggaggaagtctttaaacgtttttcagacattaatgaagcggcgaaacaactgattacacattgtccttgtcatgacggctgtccgtcttgtataggtacggaaatagaagggataaaagcaaaggaaagaattttgcagctgttggatcaaatgtcgtaaggagggaggccggatatgtcattaaaagggaaactccaacggatgaaaaagcacatggcgctcgacgaaggagaacaaaaaatagaagcaggcaaacaagaaaaccactttgatgacatcccgtttttagaagagtgggaggcttttggcatgaagcctttcatcttcgaagatgaatattgcctcatcagagaagtagaatatccgctttctcaccgccatgggttatacagcttttctgagcttgaggaagtgatcacactgtggaatcaaagcggcctgtcgcatacattgtcagcaaaagggtataacaaaaacaacctctttttctttgatacagaaacaaccggtcttgggggtggagctgggaataccatttttttgcttgggcatgcgagagtatatgaagaccgagtgacagtcaaacagcatcttttgcccaaaccggggaacgaagtcgccttgtaccaaagctttttaagcgaggttgacattacatcacttgtgacctacaacggcaaagcctttgattggccgcaggtgaaaacaaggcacaccttgatccgtgacagacttccgaagcttccggagtttggccactttgatcttttgcatggagctagacgcctgtggaaacacaaaatggaccgtgtatctcttggcacggttgaaaaagaggagctcggcatccgcaggctagaagacacaccgggctacttggcgccaatgctttactttcattttatcaaggcgcaagagccggatcttttaaaaggtgtcctgcatcataatgaaatggatgtgttatcactcatttcattgtacatccatatgtctaaaaaaatcctttcagaatcacatgcgccaaaagaacacagtgaagcctatgctatggcgaaatggtttatggctcataaagaaacggaccaagcgatcaagcagttggaaaggcttatagaaaaatcgtttgaggaccaggacagtgcacggctggatttatcgctcctgtacaaaaaacaaaaccgcttggaagaagcagtgccgctttgggaaaagctgtcccgctcgcaaaaccagaagtgcagatacgctgctgtaatagagctcgcgaaatattttgagcataagaaaaaagaattcggaaaagcattgcaagtagcagagcaatcgcttagcgatgcggcatgcttatcagagaaagaaactgaaaaactgcatgtgagaattgcccggctaaagaggaaatattcctcttaaatattccccgggaaagcgcaaaagacgacttgtttcgccatgaattttttttgctgaattcacattgattttgttgtagaatagcggcgaatcctgtaaaatgacgttagttatttttaaagggagagttggtatgtataagggtgttttttacttgttctttgttgtggtatttttgattgcttttgtgttttcaaactttaaagacagcttaattgcacacttttaaaataggtctttgcatcagaacatgtaccccttatttttcataacttagtattgtaataaagtttatggaaaggggattttatcatgcatcactgcagaccgcatatgatggcgccaattgtccatcctactcattgctgtgaacaccatacgttttcgaagactatcgtgccgcacattcacccacagcatacaacaaacgtaaaccaccagcattttcagcacgttcactactttccacacactttctcaaatgttgacccggctacgcatcagcattttcaagcaggaaaaccttgctgcgactactagtatggaaaacgtgcagcttgatggtgtaaacaatgcagcacaacaaatggggcccacgggagccccattttttaaagcaggtgaaatgatgaaagtattggcaataacgggctataaaccgtttgaactggggatatttaagcaggatgacaaggcgctgtattacataaaaaaagccattaaaaaccggctgattgcttttttggatgaaggattagaatggattttaatttcgggccagcttggagttgagctgtgggcggcagaagctgcatatgatttgcaggaggaataccctgacttaaaggtagctgtcatcacaccattttacgagcaggaaaagaactggaaagaaccgaataaagaacagtatgaagcagttctggctcaggcagactatgaagcaagcctgactcaccgtccttatgaaagcccgcttcaattcaaacaaaaaaatcagttcttcattgataagtccgacgggcttctgcttttatatgacccggaaaaggaaggctcccctaagtatatgcttgggacagcggaaaaaaggcgcgaacaggatggctatcccatctactttattacaatggatgacttgagagtgacagtggaggaagacagctactaacaatgagagagaaatttgacaaccgtacagatttctgaaaaaatatatgtgatgattcacgatacgaggtgaaaaagatgcttgctgataaagtaaagctttctgcgaaagaaattttggaaaaagaatttaaaacaggcgttagaggctacaagcaagaagacgttgacaaatttttagatatgattattaaggattatgaaaccttccatcaagaaattgaagaactgcagcaggaaaatctgcagctgaaaaaacagcttgaagaagccagcaaaaaacagcctgtgcaatctaacacaacaaactttgatattttaaaacggctgtctaacttagaaaaacacgtttttggcagcaagctttatgattgatcacgcttgaaaaaaatggcgcttgtaaattgtaatcagttgttatataataattcatgttcttaacgttcgggtaatcgctgcagatcttgaatctgtagaggaaagtccatgctcgcacggtgctgagatgcccgtagtgttcgtgcctagcgaagtcataagctagggcagtctttagaggctgacggcaggaaaaaagcctacgtcttcggatatggctgagtatccttgaaagtgccacagtgacgaagtctcactagaaatggtgagagtggaacgcggtaaacccctcgagcgagaaacccaaattttggtaggggaaccttcttaacggaattcaacggagagaaggacagaatgctttctgtagatagatgattgccgcctgagtacgaggtgatgagccgtttgcagtacgatggaacaaaacatggcttacagaacgttagaccacttacatttaaaatgatgaaaacaagctctcccgtataaggagagcttttatcttgaaaagagaaaagttttaaaagacagggtgatacgatgaagaagtatacactaattgcaacggcgccgatgggcattgaagctgttgtcgcaaaggaagtacgagatttaggatacgaatgcaaggttgataacgggaaagttatttttgaaggtgatgcacttgccatctgccgtgcgaacctttggcttagaacagccgaccgcataaaggttcaggttgcttcttttaaagcgaaaacatttgatgaactgtttgaaaaaacgaaagcgattaactggcgctcatttatacctgaaaacgggaaattccctgtcatcggaaaatcggtaaaatcaacacttgcaagcgttcctgactgtcagcggatcgtcaaaaaagcaattgtcgaaaagctcaagctgcagtccggcaaagccaatgattggattgaagaaacaggtgctgagtataaagtggaaatatctttattgaaagatcaggctttgattacactggactcatcagggacgggccttcacaaacgaggataccgtgtcgatcagggcggtgcgccgattaaagaaacacttgctgccgctttggtgcaattaaccaattggacgcctgaccgcccgtttgttgatcctttctgcggctccggaacaatcgcgatagaagcggcgctaatcggccaaaacatcgccccgggattcaaccgcgattttgtatcagaggattgggaatggatcggtaaagatctgtggaacaaagcgcggcttgaagtcgaagaaaaggcaaattatgatcagccgcttacaattttcgctagcgacatagaccaccgcatggttcaaatcgcaaaagaaaatgcagaggaagcaggattgggagatctaatccagttcaaacagatgcaggtcaaagactttaccacaaatctggaatttggcgtaattgtcggcaacccgccatatggagagcgtctcggcgagaaaaaagccgttgagcagatgtacaaagaaatggggcaggcgttcgagccgcttgatacttggtctgtgtatatgctgacatcaaatgaaaactttgaggaagcatatggcagaaaagcaacgaagaaacgaaaactctttaacgggtttattaaaacggattattatcaatactggtcaaaagtaagaccgcagcgcaagaaaacagaaaaacgcataaaaagaagacgctctgcatgcgtcttctttcatctttcagccctattctatcgttaccaacggtgagctttcgcgttgcttctcaatataatgttggtttgggacatttcagtgtgaccgtttacttgagactttgaacgtttaggccgcgtccaattgtgatgaaacagttcagaatgctgatctaatcggtttctataactcatgtcaacatcactccctgatagaatattgttgataagacggataatccggagacggaatatcaagtgtagtttgtgcatgtttcggtgataacatgcggtaaagcatgtatataaaatgaaaagttcgcatacaatgatgattatttccatcagaggtgatctcatgctgaacagcgaacattttaatcttattcaaagggcgcttgacgcaacagcaaacgagctgaaggagctcgggactgattcgtctccgtctgtgatttcgcatgcgcaaactgatttagaaaaagcggtagaacatatttattcaacagaccatccttttttatcgtcgcatgtgatcaatcgtaagtaaactgcaaaaaacttggcattgccaagttttttattgtattcatcagcggaaaatgatattattggtggtctgaatgtcgaatagttgggggttggaactaggtgacaacatcacgtttgcctttttctttaacgaaaacaaagaatttttatgaagaattgaacaattggattggtgacgtgttttacgatatccttcccgaaaaagggtttgatcttcgggacgagcaagtatttatggcttttcagctggagcgggcgtttaaagagaaaaaagtcatgttcgccgaagctggagtgggaacggggaaaacgctggtatatcttctttttgcaatcagctatgcaaggtatgtcggcaaacctgccatcatcgcttgtgcggatgaaacattaattgaacagctggtgaaaaaagagggcgatatttctaagctggctgagcatcttgatctgaaaattgatacaaggctgtcaaaatcacatgagcaatatttatgcttgaagaagcttgaaaaaacaatgcagcgttctgatgatgataaatggctggatctttatgagtcgttaccgtcatttgtccacgagtcccaggcgatgcagcgcttttatccgtatggcgaccgtaagcagtacgcaaatctatcgaatgaagagtggtctgacgtaagctacgactcgtttcaggactgtctgacttgtgatatgagacacagatgcggtctgacactttccagagattactaccgcaagtcaacggacttaatcatttgttcccatgatttttatatggagcatgtgtggacggaagaatcacgcaaacgagagggccagctgccgctcttgcctgatcatagtgcagttgtatttgatgaggggcacttgttagagtttgctgcgcaaaaagcgctaacctatagagtgaagcagtctactcttgaattgtttttagaacgattgctgcaaaatgacatcagagaagagtttgcagaattgattgaagatgcgcttctcgcaaacgacgaatttttctatgttctttctgaagaatcaaaggaagtagccggttcacaccgtttagaaataaaaaatgaccatcgtgtcaaaaaggcggcggacgagctttgccgtttacttgataaaatcggtgaggcacttgtatttgagtctgaaatgtatacgattgatcaatacgaactgtcagtagtggaagaatatgttgaacaaatggcgtattcattatctctatatcaaaaggatgcgatcagctggctggagaaaaaggaagcagaatcaacctttgtcgtgatgccgagaacggtagcagaagtacttggcgaaaaagtgttttctaagaaaattccttatatcttttcttctgctacgctgtcagaaggcggttcgtttgattatattgccgacagtcttgggattcatgattatttgtcattaactgttgattccccttatgattatgacgagcaaatgagtattaatctatacgcaaaaacagatatggacgctgaacaaaaaacggctgaaacgattgaaacaatcaaacgatacaaaggaagaacgctggtgcttttcccttcttttgaagaattaaacgagtttaaagagctgtcggcggcatgggagctgccgtatccaattttcttcgaaggtgatgaggaaatcagcagcttagtagagaaattccaagaggaagaagaaacagtactttgttcagttcacttatgggaaggactcgacattcccggtgacgcattgaagaatgttaccatttggtcattaccgttcccgccacacgatcctgtatttacagcgaagcgcaacggagcgaaaaaagatccgttcgaagaagttgatctgccatatatgttgttacgtgtacggcagggcatcgggcgcctgattcgctcgaatcaagacagcggctcgattcacatttacgctggcggagaaaatgaacgcatcattgatgaggtcaaaaaggtcttgcctgttgaaccgcacatgatgtaatggaaaaaagctgacgatcgttcgtcagcttttttatttgtcagcgggatagccagccgccatcaactgctaaaatatgtccatttacataatctgaagcacgtgatgccaaaaagactgcagtccccccgatatcatccgcttggccccagcggccggcaggaattctctttaaaatgtcctcatttcgcttttcgtcatcccgaataggctttgtattcgcagtagaaatatagcctggggcgattgcgttgacctgaatacctgacgctgcccactcatttgcaaatgattttgtcaaaccggcaacagcgtgtttgctcgcggtgtaagccggaacgaggatgccgccttgaaaagacaggagagaggcaatattaataatctttccatgacctcttttcagcatgtgcctgccagcaagctgtgtcagaataaacaggctgtttagattgacattcagtacgtgctgccagttctcttctggaaaatcttccgctttttcccgatgaataatgccggcattattgacaaggatgtcgatctgcctgttttcaaacagctcagctgcagaatcctttatcgcttccggcttgctcatgtccaatgtaaaagatgtaaatatccggccttcctgttccacaagctgctgtgtttcagacagactgcttgtatgtgatgtgccgataatatcagcgccagccccggctagggctttggctattccttgaccgatccctgttcccgggcctgtcaccagcgctgtttttccttttaatgaaaaggcgtcatgtagataacccatcttatttcagcccatccattggaatgagatccatgtccgtaaatgtgtaattttctccagccatcgcccacacaaagctatagtttgatgttcctgcgccagaatgaatagaccaagcgggagaaaggacagcctgctcatttccaacaacaagatggcgtgtttcgtccggctggcccatgaaatgaaatacctttgagtccttttcaagatccagataaagataagcctccatccgacggtcatgaacgtgtgctggcatggtattccagttgttgttttgatctaacatcgttattcccatcatcagctgacagcttttaatgccatcctgatgaatgactttgtacagacttctgacattagacgctgcatcatcaccaaggcggtccggtgtcagttcagatagggcggctttttgtgtcggatagcttttgtgggcgcaagcggagacgaagtaaaacttcgctttttccccgttcaggcttgaaaacgatacatcctgattgcccattccaatatagagaaaatcctttgtttgaagcacatattcatcatcgccgactctaacggcaccaggctggccgacattaataatcccgatttcacgccgttccaaaaagaagtctgtttttagaaaatcacctgcatcaagcttcagttcactttgccctggagccgctccgccgatgacaacccggtcttcatgtgagtaatacatcgtaagtttgttttctgtaaataaagaatccattaagaaatgactgcgaagctcctctgttgtaaagcgttttacttgttcaggatgtacagaataacgattttccattatatttcccccttggttaggatttcagcatcacttgaatgaaaatattttggtaacggtttcaaagaaaattttaggataaatagtgaaaagagtcaacgaaaaaataatgaattgacatattattaaaaaaactcttcccaaattttaaaattatggtattcttttgttgtaacggttttgaaatcggtttcaaatatatgagatacaggagcacttgaatgaaaaagaaaacaacaggccatacaaccatcaaagacgtagctgaatgtgcaggagtttcgaaatcgacagtttcccgctatattaacggaaaaattgacgcgatttctcctgaaaaagtgaaaaacattaaaaaggcaatcgcagaattgaattatcggccgagtaaaatggcacaaggtttgaaaataaaaaaagcaagttaatcggatttgttgtggctgacattacaaatcctttttcggtcgctgctttcaggggagtcgaagaggtttgtgatcaatatggatacagcattatggtgtgcaacacagataacagtcctgaaaaagagcgggaaatgctcttaaagctagaagcccattcggttgagggcttgattttaaacgcaacaggggaaaacaaggatgtactccgcgcttttgctgaacagcaaattccaacaatcttaattgaccggaaactgccggatctgaaactggataccgtaacgactgacaacagatggatcacaaaagagattcttcagaaggtgtacagcaaagggtatactgatgtcgcgctgtttaccgaaccgatttcctctatcagccctcgtgcagaaagagcagctgtgtatcaggaaatggcttcggttcaaaatgtgaacgggcttgtcagattgcatgaaattgacgtaaaggacaaggagcagcttaaggcggagcttcgttcttttcacaaggaaatgccggagcaaaaaaaagcgattctggctttgaatggcttgattatgctgaaaatcatcagctgtatggaagagcttggcctgcgcatccctcaagatatagggattgcaggattcgatgatacggagtggtacaaactgatcggtccaggcattacaacgatcgcccagccgtcacatgatatgggcaggacggcgatggaacgtgtattaaaaaggattgaaggtgacaaaggagcgcctcaaaccattgaattagaggcaaaagtcatcatgagaaagtcactttaatcctaggtgccctcaactaagaggaggttgggaagagatgaagcttgatgcggtgacattcggggaatcaatggccatgttttatgcaaatgagtatggaggccttcatgaagtatccactttttctaaagggcttgccggagcagaaagcaatgtcgcctgcggccttgccagactcggatttcgaatgggatggatgagcaaggtcggcaatgatcagctcggaacgtttattttacaagagcttaaaaaagagggagtggatgtgtcccgcgtgatccgctcgcaggacgaaaatcccaccgggctgctgctgaagtcaaaagtgaaagaaggcgacccgcaagttacctactataggaaaaactcagctgcaagcacattaactacagctgaatatccgagagattattttcaatgcgcaggccatttgcatgtgacaggtattccgcctgctttatcagccgagatgaaagacttcacgtatcatgtcatgaacgacatgagaaacgcagggaagaccatttcattcgaccctaatgtaagaccttcgctttggcctgatcaagcaacaatggtacacacaatcaatgatctggctgggcttgcagactggtttttcccgggtatcgcagagggagagctattgaccggagaaaaaacacctgaaggcattgccgactattatttgaaaaaaggtgccagctttgttgctattaaacttggaaaagaaggcgcttactttaaaacggggacaagtgaaggatttctagaaggctgccgggtcgaccgggtggttgatacggtcggcgccggagacggatttgcagtcggtgtaatcagcggtatcctagacggtttgtcgtacaaggatgcggtgcaaaggggaaatgcgattggcgctttgcaagtgcaggcaccgggggatatggacggtttgccgaccagggagaaattagcttcttttttatctgctcaaagaacggttcaccaaaagaaaggggattattaatatggagtccaaagtcgttgaaaaccgtctgaaagaagcaaagctgattgcagtcattcgttcaaaggataagcaggaggcctgtcagcagattgagagtttattagataaagggattcgtgcagttgaagtgacgtatacgacccccggggcatcagatattatcgaatccttccgtaatagggaagatattttaattggcgcgggtacggtcatcagcgcgcagcaagctggggaagctgctaaggctggcgcgcagtttattgtcagtccgggtttttcagctgatcttgctgaacatctatcttttgtaaagacacattatatccccggcgtcttgactccgagcgaaattatggaagcgctgacattcggttttacgacattaaagctgttcccaagcggtgtgtttggcattccgtttatgaaaaatttagcgggtcctttcccgcaggtgacctttattccgacaggcgggatacatccgtctgaagtgcctgattggcttagagccggagctggcgccgtcggagtcggcagccagttgggcagctgttcaaaagaggatttgcaggctgttttccaagtgtaagtggaattgttttttcataaccggaggatgggagaatccacaatatgaaaatcaaggcgacaattgaacgggtacctggcggaatgatgattattccgctatttcttggagcggcgctcaacacgtttgcgcctggaacagcggagttctttggagggtttacgggtgctttgattaccggaacgctgccgatactgggtgtttttatcttttgcgtaggagcaacgattgattttcgttcttcaggctatatcgcaagaaaaggaatcacgttattattggggaagatcggatttgcggcgctgctcggcgtgatcgcagcgcaatttatacctgacgatggcatacaatccggcttttttgcaggcctttctgttttagcaattgtcgcggtaatgaatgaaacgaacggcggactgtatttggcgctcatgaatcacatgggaagaaaagaggatgcgggcgctttcgcctttatcagtacagaatctggtccttttatgaccatggtgacgtttggtgtgacgggacttgccgcattcccatgggaaacgctggcagcgacagtcatcccgtttttacttggatgtatacttggaaatctggatcatgatctcagagacttattcagcaaggttgtgccggcgatcattccatttttcgccttttcgctcggcaataccttgaattttggaatgctgatccaatcagggctgctcggcatttttatcggagtttctgtcgtcattttatcgggcagttctttgtttttgcttgatcgttttattgcgcggggagatggtgtcgcgggagtggccgcttcttctacggcaggggcggctgtagccgtgccatatgcattagcggaagcgaatgcctcatttgcgccagttgctgagtcggcaactgcaattatcgcgacaagcgttattgtcacctcgctcttaaccccgctggcaacagtgtgggtagataaaaaaatcaagcagaaaaagcggagaacacctccgccaaaaaatcaaatgacgatcaactgaataaaaaggctgccacaaaacataccggcagccttttatacaaacaatttgactttcatacccccttccattagcctgtaatggaacggctagaatagggagggaatggatatggagatacatacatatgaaaaagaattttttgatcttttaaaaagaatctcacattacagcgaagcagttgcgttaatgcactgggactccagaacaggcgcgccgaaaaatggctcagaggatcgtgccgaaagtatcggccagctttcaacagatatattcaatatccaaacatcagatcgaatgaaggagcttatcgatgtcctgtatgaacgatttgatgacttgtcggaagatacgaaaaaagcagtggaactggcgaaaaaagagtatgaagagaataagaaaatccctgaggctgaatacaaagaatacgtgattctgtgttcaaaggcagaaacagcgtgggaggaagcgaaaggaaaatctgatttcagcttgttttctccttatttagaacagctgattgaattcaataaacgttttattacgtattggggatatcaagagcatccttatgatgcattgcttgatttgtttgagcccggcgtcacggtaaaggtgcttgatcagttgtttgctgagctgaaggaagcgattatccctcttgttaaacaggtgacagcttccggaaataaaccagatacaagctttattacaaaagcgttcccgaaagaaaagcaaaaagagctcagtctgtattttttacaggagcttggctacgattttgatggcggaagacttgatgaaaccgttcatccgtttgcaactacgctgaatcggggagacgttcgggtcacgacgagatatgatgaaaaagatttccggacggcgatctttgggaccattcatgagtgcgggcacgcgatttacgagcaaaatattgatgaagcactcagtggcacgaacttgtcagacggcgcatcgatgggaattcatgaatcgcaatcattattttacgagaattttatcggccgcaacaagcatttttggactccgtactataagaagattcaagaggcatcacctgtacagttcaaggacatctccctggatgattttgtccgggcaatcaatgaatcaaaaccttcatttatcagggtcgaagcggatgaattgacgtatcctcttcatatcatcatccgttatgaaattgaaaaagcgattttcagcaatgaagtgtctgtggaagatctgccgtcgctttggaatcaaaaataccaggattatttagggattacaccgcagaccgacgcagaggggattttacaggacgtccattgggcaggtggagatttcggctacttcccatcctatgcgctcggctacatgtatgcggctcagctgaaacaaaaaatgcttgaggatctccctgaatttgacgctctcttggaaagaggagagttccatccgataaagcaatggctgacggaaaaggtgcacattcacggaaaacggaaaaagccgttagacattattaaagatgcaacaggagaagagctgaatgttcgctatttaattgattatttatcaaacaaatattcaaatctctatctgttataatcaaaagcctggcggcgcggtcgtcagactcttttatatcgaatccccttgaaatacgaatgatatctaaaaaaacaaattaaagttcgggaatttttattttcagcctatgcaagagattagaatcttgatataatttattacaatataataggaacactcatataatcgcgtggatatggcacgcaagtttctaccgggcaccgtaaatgtccgactatgggtgagcaatggaaccgcacgtgtacggttttttgtgatatcagcattgcttgctctttatttgagcgggcaatgctttttttattctcataacggaggtagacaggatggaagcactgaaacggaaaatagaggaagaaggcgtcgtattatctgatcaggtattgaaagtggattcttttttgaatcaccaaattgatccgctgcttatgcagagaattggtgatgaatttgcgtctaggtttgcaaaagacggtattaccaaaattgtgacaatcgaatcatcaggtatcgctcccgctgtaatgacgggcttgaagctgggtgtgccagttgtcttcgcgagaaagcataaatcgttaacactcaccgacaacttgctgacagcgtctgtttattcctttacgaagcaaacagaaagccaaatcgcagtgtctgggacccacctgtcggatcaggatcatgtgctgattatcgatgattttttggcaaatggacaggcagcgcacgggcttgtgtcgattgtgaagcaagcgggagcttctattgcgggaatcggcattgttattgaaaagtcatttcagccgggaagagatgaacttgtaaaactgggctaccgagtggaatctttggcaagaattcagtctttagaagaaggaaaagtgtccttcgtacaggaggttcattcatgagaaatggattcggcaaaacgctgtctttagggattcagcatgttcttgccatgtatgccggcgccattgtcgttcctctgattgtcggaaaagcaatgggactgactgtcgagcagctgacttacttagtatcgattgatatttttatgtgcggtgtggctacacttctgcaagtgtggagcaaccgattttttgggatcgggcttccggtagtgcttggctgtacctttacagctgtatcgccgatgatagcgattggatctgaatatggggtttcaacagtttacggcagcattatcgcttcaggcattcttgtcattcttatttcatttttctttggaaagctcgtatcgttttttccgccggtcgtgacaggctctgttgttacgattatcggtattacactgatgccggttgccatgaataacatggccggcggagaaggaagtgcagatttcggagatctctccaatcttgcacttgcttttaccgtgttgagtatcattgtgcttctataccgttttacaaaaggctttatcaagtccgtctcgattttgatcggtattttgattggcaccttcatcgcatattttatgggaaaagttcaatttgataatgtttcggacgcggcagttgttcaaatgattcagccattttacttcggagcgccgtcttttcacgcagcgcctatcattacgatgtccatcgttgcaattgtcagccttgtggagtcaactggtgtttactttgctttaggtgacctgacaaaccgccgtttgacagagatagatttgtctaaaggctatcgagctgaaggactggctgtgcttctgggcggtatttttaacgcttttccttacacggcattctctcaaaatgtcgggcttgttcagctcacagggatcaaaaaaaatgccgtcattgtggtcacaggtgtgatcctaatggcatttgggctgtttccaaagatcgctgctttcacgactattattccatccgctgttttgggcggtgcaatggtggcgatgtttggaatggtgattgcttacggaattaaaatgctcagccgcattgattttgcgaaacaggaaaatctgctgattgttgcttgctcagtgggattggggctcggtgtgaccgttgtgccggatattttcaaacagcttccgagtgccttaacgctgcttacaacgaatggcattgtggcgggcagctttactgcagtcgtcttaaatattgtatataacgtttttctaaagctaaaaaatagaacaagaagctgacctcgctgaacaaaaacagcagtctaactccgccgcggcggagtttttttgcatataaaaaagattgttgcggcacaatgtatgcaaagaggtgatcgcatggcgtttattttatccattggaacaagtcttcctgcgtataatgtaaaccaagagaaagcggccgagttcgcccgctatatgtttcagcattcttttaaggatattgacaggctgttatcctcctttaaaaacgggcaaatccattcgagacagtttgttaagccgattgaatggtataaagaggggcacagctttgaagaaaaaaatcaaatatacatagaagaaacacttaaacacagcagagcggctgttcgtgagtgcctctctcatccggaattttttcaagaagccattccttatgagaaagtggaagctgtttttttcgtctccagtacaggtctttccacaccgagtatcgaggcgcggcttatgaatgaacttccgttttctccatatacgaagcggattccgatttgggggcttggctgtgcaggaggagccagcggacttgcgcgtgcagccgaatactgcaaagcgtatcctgaggcttttgtgcttgtcatttctgccgagctgtgcagcctgacattccagccggaagataaaacaaaaagcaatctgatcggcacctcgctttttggtgacggcattgccgcagctttattatgcggagagaaggcggaccgcagggtgtcaaagctgaagcttgcgccgaagataatggacgcccaatctgttttgatgaaacaatcagaagatgtcatgggctgggactttaccgatcaaggattcaaagtcattttctcacgagacattccgaccttggtggaaaaatggctcaaaacaaatgtacagatttttttggacaaacataagctgtcattccatgatatcagtgtttttttggcgcatccaggcggaaaaaaagtgatcgatgcatacatcaaaagtctcgggctgtcgtcagaaaagctttcatctgcgcaaagcattttgcaaaagcacggaaatatgtcttcagccacaatcttgtatgtgatcaaagaccatctgcagaacggacataaaaaggaagctgaacgaggactgattggcgcattagggccgggtttctcatcagagttgctattattcagctgggaaaagggggcctgactcatgttttggttgttgatcgccattctcattgttcaaagagcagcagaaatggcagtggccaggcaaaacgaacaaaaggtaaagaagcaaggagcaattgaatttggcgagagccactatccgtatatcattacgatgcatatcctttttttcctgtccttaattgccgaggtgctgctgatgaataaacagccgtccagctggtggctcggtatcgctgcagtgattttaagcgtacagatcgtacggtattgggcgctttgttccttaggagcatattggaatacgaaaatccttgttgttccaggtgtagagcttgtaaaaaaaggtccatataaatggatgaaacatccaaactatgccgttgttatcctcgaaattttgctgattccgctgctttatcaagcatacgtcaccatgtgtctgttttccattttcaatgccgtgttgttaagcgtcagaattcgcgcagaagacaaagcattacaggaatacagcgtaaaatagcgattgaaaatcattctcaaccatgttaaaatgggtttgaaaaagattctcaatcaggatggtgaagcaaatgacaatgctgtttttgcttggagcggtttgtacatatagtgtattaattggttttgtattaaaaggaatctctaataaatctgtttgatgaatctggaacttgtaaaagttgcagattttcttttatagaagctgccgtaatggcggcttttttctattctcctaaagaaatttggtttattcttgtgtaaaatgaaaagggaatgaattcagatctttcgaaaaaggttcacaattgaaacggcacaaaggggttcagacttatgacagatcaaaacagaaaagagcttttgcataaaaccggggaactttataagcaatttattgagaatcaagatgaacaaagggctgctaaactggctgcggtcatgaaaaaagcggctgatgaagaggtttatatcgcgtttaccgggcattattcagcggggaaatcgtcactgctgaactgcctgttaatggagaatattttgccgacaagcccgattccgacaagcgctaaccttgttgtgatcagaaacggggaaaagcgagttcggcttcatacaacagacggagcgtgtgctgagctggaagggacttaccagaaagacaaggtgcagcaatattgtaaagacggggaacagattgaaagcgtcgaaatttttgacaggtatactgagatcgattccggggttgcgtatattgatactccagggatagattcaacagatgatgcgcattttctatcggctgcttctattcttcaccaagcggatgcgctgttttacgtcgttcactataatcacgtgcacgctgaggaaaatgtaaagtttctcagatcaataaaagaaagcattccgaatgtgtattttatcgtcaatcaaattgaccgccatgatgagacggagacgaaatttggagactatcaagcgcaggtagaggagatgctttgcaatgaagggatttcaagggaagcgctctattttacatcagtaacagaaccggatcacccgttcaatcagatgggggccctgagagaagagttaagcagaatagaacagcaatcaaaaagcaatatgcaggctttaaccgaacaaaaagtccgtaatctgctaaaggaacatacggaaatgctgaagaaagacgaaacaggcgctccgagtttcgctgaacagcttaatatccatactggactggtccaatcgctgcgtgatcaattggatgaggccgaaaaacaaatgactgaggcagagaagaggatgcaggaagaaatcaatcgtattttaaaaaacgccaacctgacgccttttgaaatgcgtgaattggcggctgcatttttagaatcacaagagccttcctttaaaaccggctttttcttttctaaagcgaaaactgcacaggaaagagataaaaggcggaatgcttttttctctgatgtggcaaaacgaacagaggccgaagcggattggcatatgatagacacgcttcataaactcgccaaggtatttgatgtctataccgctgaaagtgaaaagctgattcaggcctatcgcacaccgcttgatataagcatcattgaacacgcggtcaagcatggtgcagccttttcctctgaatatgtattgcaatatacaaaagacttggcagagctcatccggaaagaggcgaaaagagaagccgcagacatcataaaggtgctctccgctatggtgaaagagcgtgtttccaaagatgtgcaaacaattaacgaccggctcgtccaagaatcagaaaaacttgtctttcttcaagaacaggcacgtttagagaataatgcccgagagaaaaccgatcgcctgtgggccatttgggaagaagagtccgcatgcccaatgcatatagacacagaatggtttaaatcgaagaaaacaagagtggcggctccagagcagaaacaaggccgaagccagctgacggcgcagccgatgccgaaatcagaaatcaaaatggaacaagaaatgccgcttcaagaccaaatcaaacgcttttacactttgtctgacattttaggcgaatgcagcatgttgttaaagcaaacttcagcgtttcgtgaaagggtgaaaaggcttgaggaacggaaatttacactcgctctttttggaggctttagctcggggaaatcatcatttgccaatgcgcttgtcggcgaaagagtgctgccatcctcaccaacgccaaccacagcgacaattaacaagatcacaaagccaatcaatggcaacttaaacaaaacagcgaatgtagtgtttaagacagaggatgacttaacggctgaaattttgcagctcaccggaataccaaaggagccggcaggccgttccttcacagagaagtgggaaaaggcagtcaaaaaaacaggctgcaggaagaacacgtgaaattgatcagcaatttcctgcttgcatacgagaagtatcagcagtatatacaggaacagaagaaattaacgattccgctctctgaattaaagccgtatgtagcagaggaaacaacggcctgtgctgtgaaagaggtaacggtctactatacatgcccgctcactgaaaaagggattacgatcgttgatacacccggcgcgagcagcatgaataaacggcatacagaactggcattccaatatatcaaagatgctgatgcatttttttatatgacttattatcagcactctttttcaaaaggagaccgttcatttttgcgaaagcttggacttgtgaaagaatcgctcagcatggataaaatgttttttattattaatgctgcagaccttgcaaaagataaaacagagctcgaaacagtgaccgattatgtcagcgcagagcttgtaaaagaaggggtttatgagccgcagctctttaccgtatcaagtaaggaggaactggtgggaaaaccggagtcattttataatcagttctcgaaagtaagaaaacacttagaccggtttatcgaagtggatgtaaaaaaagcgtcagcagcgcagctcagttcggaggcagacaaactatgcgaaactgtttttcagcttcaccaatcccagcatcagtcccgagaagagaaggaagcgcagaaacagtgccttatgctgtcatttgagcggacagcggccgatatcgagaaacggcggaactcaaaaaccatcattgaaaaagtaaaaaagatacaagagagcagctatatcacattgcacagcgattatcatattttgcaaatgatttattaaaatcggcatttcatcccgggctgcaaaacggggattggaaaaagaacgtcagtaaagcgatgacaacagccttacatgaatatctatttgaatatattcaggaaatcaaaacgcttgatgttcgcatgagcggtttcatcgaacggcatatcaatgaagaatggctggatcattttcaaaaaacattaaacgaggacggttatttttccgtttatgcgggtgatcagcattcgaacggcatacagttgaaggaagttgaaccggaaatagaagaacgtgcttttgagcaggaactaaaagagatcaaatcaccgaagcagttttttgagcagaaaggaaaagcgacctttatcgaagctgtacggatgaaacttacgaaaatcacagaggcatggataaaaaatgaagaagaaagcctgatatctcattacactgctcacctcagacgcttacaggaagatatgggtgaaaaagcaatcgcgcaaataacggatcaaaaagagacatatttaagaggatatgcggaaggggaacatgcgaaagagattgaaatggcgtatcaggcgtgcatctcctggaaaaattcagacaatacaataaaaatgtaaaattcagttggcttgtatttcaagtcatgatagactaaatagaaaaaagcgagatgaacgattaatgtcagaggtacataaagcaatttcagcacattcatcaaaacagcacgagcatatcaaagcatttatgcgtcttgaaaatatgcgtgaattggcgattgaagaagctgttgctaaatgcagaaacgatgagccttatactacagatgcaattaatgaaattaccgagcaaatgaatcagctcgctaaaaaaggcatcgtcccgacaagacggcttgtatcaaaagaaatggtcagagaatacgtaagccgcatgtaagctggatgatcctgtcgcgagtgaacctcctgccggaagcatatactatatgcatccgacgtaaggggggattcatgttgggcagaacaaagctcggaaacagaaatgcacaggcgaataacaacgccaaaaagaaaaacggatttcaaacccattttgactcttacgcaggacgcgaagctgaaaagctgatcgccagcaacaaaagacacaacgattgataaatattcaaacagtatctctaattaaagagatactgttttttatttttgggctgctttatgataaaatagaaggaatgaaagaaaagggagttatttgatgaataataataaactattgctggttgacggcatggctcttttattccgggccttttttgccacggccgtacatcgcaactttatgataaatgacagcggggtgccgacgaacggcgtcaacggctttttaaagcatttgattacagctgtggaaacattccagccgacacacgtcgtctgctgctgggacatggggagcaaaacgtaccgaaatgacttgttccaagattataaggccaaccgcagcgcgccgcctgtggagctgattccgcagtttgatttggcaaaggaagcagccgcagagcttggaatcatgaatattggctttgccggctatgaagcggatgactgtatcggtactcttgccgatttatttgcgaatgaagcggacattacggtggtaacaggggacagagatttacttcagctgttaacggataaagtaagcgttgctttgcttcaaaaaggaatcggaaattataaagtctatacaaaagagactttttatgaagaaacaggcgtaatgccgaaggctttgattgatattaaagcgcttatgggtgattccagtgataactatcccggagtcaaaggcattggagaaaaaacagcctacaaactgattcgtgaatacgaaacgattgaccgtttattggaaaatctttctcttcttccaaaaggacagcagggaaaaattcagcaaggtttaagcgatttggagatgtcgaggaagcttgcggaaatccattgctcagtgccgctggcctgcacactgaaagacgctttatttactttgcaaatggagcaggcggctgacatgcttcgccgccaccaaattaaaggaattgagcgtatgcttgaaaagctgaacgctagagagatcgtttagatcctctctagcgttttgtattgcttttttttgctctctcctcaagctctgttttagggtcattatgtgtattgccttccaggtcgccttgcggagtaacaccgccggtcagccggcctttatctttctttttcatgttagttcacctcgccattaggatgaaccaatgatcaagatttaattcttttcattcagccgaatcgcttcttttgccagaagatcggctttttggttttgcttgcccggtatccatttgatgaaaaaaagagggaatgccgcttttaatcggatgatctcttctacaaacggttgaaacgttatatttttaaccatttcaagctcagtggcgcgttccacaatatctgaatcggttcgaaaggaaactgattgatacccgcgcgttgcacatagcttcatcccttcaattaatgcaagaaattccgcttcctggtttgtatgcactccgattggaatagagaaagattctgcttttccctcatgtttgataaaaatgccgataccggaaggccctggattaccggcgcttgcgccgtctacatatatttctgtaggcattatgaactcctttcatcattaggtatcatttttttggctgcataggcataaggcaatgaaattaaagataccgcaaacttaatcaaatatgtagaaataaaaatatgaagccacacgtctgccggataaatgccgagaaaggcgactgcagtgaatatgaatgtatcaaacaactggctgactgctgtactgccgccgtttctgagccataaaagccgatcagaaggaaatatccttctaattgccgaatatacataaacatccagcgtttggctgaagataaaggcaagcagacttcctaacgcaactcgcggaaggaatccgaagatcgtttccagcgctgtttgtgatatgtcgctggaagccggttcgaaaagcagcacgccctgcatgacaaatgtcagcgtcaggagcgttgagaatccgagccataccgcttttctggcttcagctggtccgtatttttcattcagcacatctgtcgcaaaaaagattgtgccatacatcacattcccgagtgtcgctgttaagccaaacagttcgactgttttgacgacttggaggttggcgcagactgtcgcaaaaccgatccaaacaaacagtcccattttgccaaatcctttataaaataaaagaacaatgataaaatgaatgatcgcaaaaaagatccaaaacgaattattaaacaagatgaaaaagcttcctttccggggtaagattggtttgattatagcataagcccggcaactaatgaatggtaaggtgattgtaatgaagctcagaccgcatttgaaaatagaagcaaaaggaacgggatccgtctcattttttagcgaagactggctgacagcacagcaggcacgtacgttcgccagagaacttggccgttttccatacatgaaggagctagagttcgaagacgagaaaggcggcagctggacgctgaaggaattggaaaagctgacagaggagcttgctcaagagcctgatgacattactgtttattttgacggcagtttcgataaagagagcgaactggccggtctcgggatcgtcatctattattcattgggaggaacccggcatcgcttgagaaaaaataaaagcttccggctgaaaaccaataatgaagctgaatacgcagcgctttatgaagcaataagagaagtaagagagcttggggcaagcagaaattcaattacaatcaaaggggactcgcttgttgtgctgaatcagcttgacggcagctggccttgttatgatccatctcataatgaatggctggacaaaatagaagcactccttgaatcgctgaagcttactccaacctacgaaacaatacaacgaaaagacaatcaggaagctgacggcctcgctaaaaaaattctatcccatcaattcgtagaaagccacacgaaattagaccgtaacggagatgacgatattggataagaaaatgatctttaaagaactgacagaactgcacgatgaatattgcaaggactgttttattaagaagcagtttcgcaaagaatttggcaaaacttatgcgcattcattttgtatcaataaatgtacggttggtgaaaagttgaaacaatacggagatgtcttaaccaatcactaaaaataaaaaccgcagaagctgcggtttttattctttgaattcatccagctgatgctcgctgtcatctagcagctgctgttgctgctttacaaattcaggatcatcgagagctgccagctcttcagattgtgacagttctctagcatcctcaatggcttggtatgcagagtcgactaatgttttgctttggcctctcgtcgcggctcctgttgttttctgcgctgtttccaccgctagttccagctgccgcttatccgtaaagccggtctgatcctcattatgaaattctgaagtcacaaaaaacacctccgccattattttgcagagtttttttgaaatttatgtaccaaaatagaaaagaaaataaaaataagccgatataactattgaaccagaataaataggaccgttttactatttgaggtatcttgatagagaaggggaacgcagctatggatgataaagacttgaagttgatccttcacaaaacatttatagaaatatacagtgatttagaagaactggccgatatcgcgaaaaaaggaaaaccatcaatggaaaagtatgttgaagagattgaacagaggtgtaaacaaaacattttggcgattgaaatccagatgaaaatcaaataggagaggcgaatgcctctcctctatttgtcatctcatcatcatgtattgagtttagagttttacaacattagaagcttgaggtccacgattaccttcgacaatttcaaaagaaacttcttgtccttcttctaatgatttgtatccatctccttcgatagctgtgaagtgaacaaatacatcgtctccgccttcaacttcaatgaagccgaatcctttttcgttgttgaaccattttactttaccgttttgcatattgcttaattcctcctagtactgtagcacccatgtgctaaaaaaaattttgtcatcatctaactttgattcattgttaaatgatggttcaactatacaccatctgggagcacccgtcaagttgcgaaacggcttatttttcaaaagaagggcaagttccataaaaaaatgtaaccgcttttattgatggctgaatataaataaaaagagcacacgattttcgtatgctctcaagtacgccattacgatagcactttggctttttgtttggcggtcatcatttctgattccttcaggatatcctctaaaatcacttcagaggagtttgctaaatgaaggtccttaatgtttttcttcatgcgatgcaaggtatcttcatctgcaagaagggaagtgactgactcgagaatctcttcatgacggttcacaacgatggcagctccgcggtcttcaaagaagtttgcattttctttttcctggccaggcacgggtttgtacagaatgacaggcactccaatggctgtggcttctgtcaaagtaatgccgccgggcttggtaatcatgcaatctgtgatccgaaatagctcatcaatgcgctccacatagcccagaacttttaatttgtcaccattttccgcttcaagcgcactcaaagattcttttaaagccgtatttttcccgcacacgacaactacttgcacttggtcatccttgacaaggttttcgcacagctcttttacgttctttaatacaccgtgagcacctgccatgatcagaagcacttttttgtttggtgaaagattgtactttttatatatcgggccaacaggcatggattcttcaaattgcggcctgattggaattcctgtgatttttacattgcttggatgagtgccgatctccagcagtttttccttcacgtaatctgtcgccacataatatttatccacgttttcgtgaacccaaattttatgaagacaaaaatcagtcataacgttgaaggtaggaatgactcttccagttcggcgtctgtattccggcacgacgatcatcggaaatgtattaataataatatcgggctgatgttcatcgacaagttcgcccaatcttttattacccattttaaagtaaatattgaatttacgtttattatagattttgtcaactccgtaataaaacaaacgataaaactgtttcccgattgagaagctttttaaataaaggtattgagttacctctgaaacaatcggatttgactcttggtacaaattagaaactgttacatgctgaaagccgagccgtacacattgttcataaagtgttttggctacctgcacatgtccatttccgtaatttgcagtcaaaattaatactcttttattggtattcaagtaaattcacctcaatgtaatcaacaacaagcaagcttcatgcatcgtaaggagttattgtctatacataaacataacacaaatacataatcgaattattaatgcagtgaaaaagttaagctaattttaaatgatttggattccagtattttaaatttttgttatacgcagactgaatcagatgtattttatcatattttttgctcagcgtatcactaaaaaagaaaattagtcccattcataaggagtttcttggtaaacgtaataattcagccaattcataaacaataatgtggcatgcgctttccagcgattcactggctcgttgctgccttttgcaaaataatgtttaggggcctcgacagtagaaaggtttcgttccaaatctctttcatactcttgaagaagcgtatttgtatcatattcagggtgccctgtcaaaaagacttgtttttcgtctttagacacaattaagcaaaccccggcttcctttgatgcggtaagaatgtttaactcgggcactgcttgaagctgttccatatttatatctgtatgccgggaatgcggcacgtagtatagctcgtcaaaacctcttaccaatctttcgtgttttgaaagaacggtatgttcgaacacaccgaagatttttttcggcatttgaattttttccacaccgtaatggtaatacaaacctgcttgagcaccccagcaaatatgcaaggttgaagtgacatttgttttgctccactccatgatttccttgagctcttcccaatatgaaacctcttcaaacgccaaatgctcgatcggcgcaccggtgataatcatgccgtcaaacctcttgtgacggatattggaaaaagtcgtgtaaaattcgtcaaggtgttctctcgcagtatttttcggcgtgtgtgtgcttgggattaaaaatgtgaaatgaacctgtaaaggcgaatttccaagcaatctgagaagctgagtctctgtttggatttttttcggcatcaaatttaatataataattttttgcggccggatatcctgatgaaatgctctgctttcatccattacaaatatatgttcactttcaagcacctgttttgccggcaggtgtgttggtatattaataggcaacgtgccacctccattatttccccgtttaattttcttcattataggaattttcacgccaattttcaatctatctatacgtgttgagggggaaacaacagaaaactctttaaataaaacgcactgacacgccttttggtttcacagtaaaatgattttcaaagatgtaagagggaattgtaatgttttatagaatgataagataaaaaacgagccatatgaattgataatgaactgacgctcatatcgttaggtttcttatgagttcttaattgatgtttacattttgaattgcgatttaaaaaaggtaaaataatcagcaccaaggacataggagggacttacatgtctatttatcatatgaaggtacgtacaatcacagggaaagacatgacacttcagcctttcgcgggaaaggtactgatgatcgtgaatacagcaagtaagtgcggttttacttcccaattgaagcagctgcaggaattatatgatacatatcagcaggaggggctggagatcttagggttcccctgcaatcaattcatgaaccaagagcctggtgaagaggctgacatacaggaattttgtgaaacaaattacggtgttacatttcctatgttttcaaaagtggatgtaaacgggaaaaacgcccacccgctgtttgtgtatttgacagaacatgcgaaagggatgctgggaactaaggcgatcaagtggaatttcacgaaatttatagtggatagaaatggagaaatcgttggccgttattcaccaaatacaaatccgaaagagttggaagacgatatcgtgaagctattagagcaataaaaagagggtgtttttgtgaaggaattgaagcaggcagagcaaatcaggacatgggttcaatctatcctgactgacgaaagctctggacatgactggcatcatgtatcaagagtagcagatcttgcagcgtatattggagaaaaggaaaaagcggatttgttcattgttgaaacggcggctttggttcatgatttaattgatgtgaagctgcctgacacggtcaggctttctgtgagcgaagtatatgatcagctcgtttttttcggagtaggaaaagagaatgctgacagggtgattcatattataacaaggatgtcctttcgggacagggggaaattggcgaaggagccgctctcaattgaaggaaaagctgtacaggatgctgacagacttgatgcgattggtgctgtcggcattgcgagagctttcatgtttgcgggcgcaaaagggcatggcctttatggagatgagcaaagcgcctacgctcatttttttcataagctgctgcggctgaaagatataatgaatacagacactgcacgggaactggcagaagaaagacacaattttatgcttcaatttgtccgccaattagaaaaagacatacccgggattgatgccgaaacgtcgtaatagaaggcttggagcgactatgatagaataagtcacagatatgctataggaggacgatcatgaagataaaatcaattgaacctacaccaagcccgaatacaatgaaagtcatcttaacggaagagcttccggcgggcaaaagcaataactataaacctgagcaagcagaaggcgcaccgcttgttatagcggaaatccttaaaatagatggagttaaaggggtatatcacgtcgcagattttcttgctgttgaacggaatgcaagatacgactggaaagacattttaccgcaagtccgcactgcatttgggatggaaagtgctgaaagcgcagaagaaaatcgttctgatcaagaatcttttggagaggtaaaagtttttgtgcagatgttcagcggcattcctatgcaagttaaattaaccgatggagagcgggaagaacgcttcggcttacctgaacgctttcagcaggcgatcttaaaacttagatctgaagcttccaatgttgtgtttgagcgggcttggaaagaacaaggtgtcagattcggtgactttgatgaaatcggccatgatgtgacagaagagcttcaagcggcatacagtgatgaacggctgaaacgactgactgaagcagccgctcaaggaaagggcgaagcaaaacaagctgtacagcgcaaagcgtataaagtaacgcttgatatgctggatgatgaggactggaaaaagcgttatgcacacttggaacagatggatccgaaagaagaggatatcccggttttacagaaggcattggatgatccaaaggtgtccatcagaagacaggctgttgtgtacttaggaatgattgaaacacctgatgttcttcctctattgtataaagcacttgaggacaaagctgtatcagtcagaagaacggccggagactgcctgtctgatatcggcgatcctcaagccattcctgctatgatcaagtcattaagcgactccagcaagcttgttcgctggcgtgccgccatgttcctgtacgaagtcggcgatgaaagtgcaattgaagctttgcgcgctgccgaagatgaccccgaatttgaggtcagccttcaagtcaaaatggcgcttgaacgtattgagcatggagaagaagcaaaaggttctgtttggaaacaaatgacggaaagcagaaaaaaaggcgaataaagataaaaaaggtgcagatcatgcaccttttttatgtgaattcactttttataaaaattatttcgaatattgttgaaaaatatccgaaaactatttatagtaagtaacaatattaatagttggagggttcaaatcgaaagaaagctatataaatataaaaacacgaaagaacaaaacaaggtgagggcggcctgtatttatcttatttgcaaaaacagcccataaataaactgaaaattgtcaaaataaaatccaatcaaacaattgaaagaatttaggaggatcaccatggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagtgacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctagatagctggggacactttcttttattttaaggcgtgaacatttgaaatccggccctctctatagtatcctttacttcagatgaaggatactagagggggctttttttatgtcaatggcttatgaagaatacatgcgccagcttgtcgtaccgatgcgccgcgagctgactggagcaggttttgaagagttaacaacagcggaagaagtagaaaactttatggaaaaggcagagggcacaactcttgtagtcgttaactctgtatgcggctgcgcggcaggccttgcgcgtcctgcggctacacaggcagtcctccagaatgacaaaacacctgacaatacggtgactgtatttgcgggccaagataaagaagctactgcgaaaatgcgtgagtattttactggccaggagccttcttcaccatcaatggctcttttgaaaggcaaagaagtcgtacattttattccgcgtcatgaaattgaaggacacgatatggaagaaatcatgaaaaatctgactgctgccttcgatgcgcactgctaaatgcccgttctccgggcattttctttttgggagtacagaagatgataacaacaagctatagaccgtctgaacacaccataaaaactgcaaagcagctttctaaagagctaaatatgccatactgcggccggaataaacaaacggttgagcacctgctgaaatcagctgaacgtgatttgcttgtggtcggcaaagagcggtttgagctgtatacgaaacaaggtgccaaattcttttttcatccgaatacagcgatgttcagagccaaacgcttcttacagggggagaaagaacctatgcttcgggctgccggcttatctgaaggggatacgtttttagattgcacactcgggttggggtcagatgccattatcgcaagtatggcagtaggcgaaacgggttctgttgttgggattgaaaaaaaccatcttgtgtctgttttagtgaggacggggctgcattcatgggaaacgggtatagaagagcttcaagctgcgatgagaagaatccaggtgaagaatggtgattgctttgaacacatcaagcagctccctgacaactctgttgatgtggtttatttcgatccaatgtttcatgaacctgtagaaacctctgacggcatcgcgcctttacgtgatttggcagaggattccgttttgcacgaaggatgtatcaatgaagcggtacgagtcgccagaaaaagcgttgtgctaaaagaccactggaaaagcccgcggtttgaacagtttggttttaacgtcatgaaaagaaaaacagcactgttccattatggcgtcattcaaacaagcccgtgattcatatcacgggctttctgttaatcggtgacctccatgacgacaaagtataataatgttaagagtgaaactgtggcaaacagagcgtcaatcatgcggaaagcctcctttcatgaaatattgtaagcgtttttacacaaagtgcatagcaacgaatctcctaatttgcatatcagtttcatatagtacatgacttgcatgttttggatgtgctaaaataagagaaacatgacaataaaatagagaggaataagcagtcatgaaattgtggatgagaaagacccttgtggttttatttaccattgtaacgttcgggctcgtatctcctccggctgcccttatggcggacaagccttccggacagccgagcagtcttgagcagaatgattacaccgctttttatgatgagcatgacctgtacgatgatgagtcggatgacaggcgagatcctgaactgctttttcaatcgtacaaggaacagctccttgacagcgctgaggatcagtcctttttaaaattcggcagcagaatcgctcctgtcattgaggatgactatcggaaagagatcctgccaaaaatcgaaaatgtgattagtgattatttagcgacattgcaagatgatgaggcgtaccaagatgttgtgatctcaagcatgccttcagcgggcaaaacggaaaaaattttcaacgtttacaatcggacaactggagaagatcttctcagattccatgtgcgaagagaccacccgcctcatgacggctactggtttaattttcattatcatacagcagaagatggatttcaatcacatcatgagcttgggagcatttactgggaccgcaacacgcctcccaactggatgagtgcctaaaggagatgccattagacatgaaaaagtacacaatgaatgaaatggtcgatataacaaaggatatgctgaacaaacggggcgttatgatagaagatattgcacggattgttcaaaaacttcaggaaaaatacaatccaaatctgccgctcagtgtttgcatggagaatgtagaaaaagtcctgaacaaacgtgaaattattcatgctgttttgacaggccttgcactcgatcagcttgcagaacagaaacttctccccgaaccgctgcagcaccttgttgaaacggatgaaccgctttacggcatagatgaaattatcccgctttcaatcgttaatgtgtacgggtcgatcggtttgaccaatttcggttatttggataaagagaagattggaattattaaggaacttgatgaaagtccagacggtattcacacctttttggatgatattgtggcagctcttgctgcagcagcggcgagcagaattgcacatacgcatcaggatctgcaagatgaagaaaaagaacaggatgaaaagcctgtcgtcagctgactataaaaaaatcatttctgggttcagaaatgattttttattgtgttacactactagaagactacttttaaaggatgaaaaaaatgaaacagtataaggatttctgcagacatgttttagagcatggtgagaaaaagggagaccggactgggaccggaacaatcagcactttcggatatcaaatgagatttaatttacgggaaggctttccgatgctcaccactaaaaaactccactttaaatcaattgcgcatgaactgctgtggttcttaaaaggagatacgaatgtacgctatctgcaggaaaacggagtgcgaatctggaatgagtgggctgatgaaaacggtgaacttggacctgtatatggctcccaatggcgttcttggcggggagctgatggagaaaccattgatcaaatttcccgtcttattgaagatattaaaacaaatccgaactccagacgcttaatcgtcagcgcctggaatgttggtgaaattgataaaatggcgttgccgccgtgccattgcctgttccaattctatgtgtctgacggcaagctgtcctgtcagctgtatcagcgctctgccgatgttttcttaggtgtgccgtttaatattgcatcttatgccctcctaaccatgatcattgctcatgtgactgggcttgaaccgggcgagttcatccatacgtttggtgatgttcatatttaccaaaatcatattgaacaagtcaatttgcagctggaaagagatgttagaccgcttccgcagcttcgtttcgccagaaaggttgattctatttttaactttgcatttgaggactttatcatcgaggattatgatccgcatcctcatataaaaggggcggtcagcgtatgatttcattcatttttgcgatggatgccaacaggcttatcggcaaagacaatgatttgccgtggcatttgcccaatgatcttgcatactttaagaaaataacatcgggccattcaatcattatgggccggaaaacatttgaatcgatcggacgtccgcttccaaatcggaaaaatattgtcgttacctcagcgccggattcagaatttcagggatgcacggttgtcagttcattaaaggatgtactggacatttgttcaggccctgaagaatgctttgtgatcggaggggctcagctctatacggacctgttcccttatgcggacagactgtatatgacgaaaattcatcacgagtttgagggtgaccgtcactttcctgaatttgatgaatccaattggaagctggtttcttctgagcaggggaccaaagacgaaaaaaacccgtatgattacgaatttctaatgtatgaaaaaaagaattcttctaaagcgggaggattttaattggttcgctacagccttctagtggtttatattgtgtatatgctgttaaaaaatatgaaacaattatttaatcaaacaatgctcgatccccgtctgtcatacaaaaaacagatggctcttgtgtacgaacagccaaaggcgtttttagaaggctgtatcggcatctccggttcagttgtgacgatccatcagccagagccaataccacacggtcctgttttgtatgtgcatccccgtttgcgtttggctgaactggccttaattgctggatatattgaggaaccggccggctttatcgctaacccaaaagtgttccgcttgccttttatcgggcaatggctggatcggatggatgtgatttcagacggggattcagaaaaggtatatgaagatgtgacaaaacagctggaaaagggacaaagcctgattctttcactagatggttctattgatcctgtagaacttgcggcccgctatcatcttccgttggtgatggtggaaacgaaaggaacagataacatgcaaaatggctcgttttttaaacgcttaaaaccggcagacattgaattgtccttttcaaaagcttatatacctgccaatgaaaaacaattacgtgcataaaaaagcgcagtcgtgaagactgcgcttttctgttactgttacgaaaggaaaggcacctttacacaatagaagagcacgcagaaaaacatggcagcgctcccgcccaatacaaagctgtgccaaatggcgtgatggaaggggatctttttccaaatgtaaaagatggttccgacagagtataaaatgccgccgagaaaaaggaggctgaatcccgctccgctcagtgaagcatataaaggtttaactgcaataatcatcagccaccccatgactaaatacacgaaggttgacaataggataaaccgtttcacaaagaaaattttaaaaacgattccgcctagggcaagtgaccatacgataaccaacagggtaaagccgagtgtgcctttcagcggcccaagcaaaaaaggcgtgtaggttccggcgatgagtacgtaaattgcgctatgatcaataatctccaaaatgtccttcgttttttatgtgtgatgctgtgaagcagggtggagctcaaatataacagcagcatagagacaccgaatattgtaaagctgacaatgtcccatgcagacccgtaattagccgcaaatatgattagaaacactaatgctgggatggataagaggacaccgatgccgtgtgtaatcgcattggcgatctcttctttgattgtaaacaagtacattctcctttcgatcgctagatcatttgattttttaacgtctctataaagctcaagccctcaaaggtaatttttgtgcctgcgcgtccgcggcttttggtgacataatcttttttctccaaatagtcgagacggcttctgacctgctgaggagttaacgaggtttgggtatttttgctgtgttcagaaatgatccgtctgctggcaggttctcctttttcgttcaatacttttattgtttccaaaataaacaaaaactcagctttttccattaaagtaagcagtttcgcttttttcttcgacgtttttccgtctatcgtgcctctaatatacggcggcaggtcatatggctgaatcgttcccccgcttgatactgccgccatataatctgcagcgttttttaattccctgacattgccttcaaatgcatgcttctcaagcacgggaaaaacggagggatcgattaacaattgctgaccagaatttgagagaaaatgctgtgtcaaaagcggaatatcgctttttcgttccgataattcgggcagtgtgagcgttaaaatgttcagtctgtagaataagtcttgcctgaatgtatgttccacggatcggtctgcagaagcacagatcattcgcggtttctccgtgtctgaatcaagcgcttttaacagctgagcttgtacagaagcaggcatgcgccatacatcatcaagaaaaagggttcctcgtaccgctttttgaaaaacacctgtgtttccgttagggccaaaaagctcatgaataagggtttcttccgaatgggtgctgcaattgacgcttataaacggttcattgcttctcgaagattccaagtgtatggcatgtgcgaagtgatttttgcctgttccgatttttcctgttattaagacaggaagctccgataacgagaactgcttggcgattcgcttcgcttccagaaaagtttgatgttctccgattagatgttgaaatgtattgagttttggtgcactattcatcaattggctccttttggttctaattggtttcattatatcatgccttttggttgaaaacaccctttattttacgatcatcttttttcttggctctgcaggataatggttgaacagaagttaccacaagatgtggtggacatagtctgtatttttttaattattaaataaaataattgtcttattttttgaatattcatgttataatggcatattaaatagggatttaaaacaagaaaggaatctgtacatgaaaccgttgcttaaagaaaactctctcatccaagtgaaagacattttgaaggctcaccaaaacgtaaaggacgttgtcattcacacacctttgcagaggaatgacagactttctgagagatatgaatgcaatatctatttaaaacgcgaagacttgcaagttgtcagatcttttaagctcagaggggcttatcataaaatgaaacagctttccagcgagcagacagagaacggagttgtgtgtgcaagtgccggaaaccacgctcaaggtgtggcattttcgtgtaaacatcttggcattcacgggaaaatttttatgccgtctactacaccgagacaaaaagtatctcaagttgaactattcggaaaaggatttatcgatattattttgacaggc

SEQ ID NO: 53 - DNA, 163346 bp, Bacillus subtilis WAUSV36
tcctgatacaaaggtaattgctgttgagccggcgggagcggcatcctactttgaatcaaacaaagctgggcatgtcgtcacacttgataaaattgataagtttgtagatggggcggctgttaaaaaaattggcgaggaaaccttccggacgctggaaactgtcgttgatgacattctccttgtgcctgaaggaaaagtatgtacatccattcttgaattatataacgaatgtgcggttgttgctgaaccggctggagctctttctgtcgcagcgcttgatttgtacaaggatcaaattaaagggaaaaacgtggtgtgtgtggtaagcgggggcaataacgatatcggaagaatgcaggaaatgaaggagcgttccttgatttttgaaggccttcagcattattttatcgtcaattttccacaaagagcgggggcgctccgcgaatttcttgacgaagtcctcgggccgaatgatgacattacaaggtttgaatatacgaagaaaaataataaaagcaatggacctgctcttgtcggcatcgagctgcagaacaaagccgattatgggccgctgattgaacggatgaacaaaaaaccgtttcattatgtagaggtgaacaaggatgaggacttgttccatttgctaatctaatttttttacacaaccgcgcaaaatgacagacagcccggctggcatcatatataatagaagaaaaacaaaaaagaggattgatagcttgttactcaaaagcctagagttcaaacgcggtgacgggattcaggtgaaagtgacagaaatacctgtattaaaggaagatgagcactatttctttatgttacatcaccatttgcaattctacttaaaagaagtgttttcatcaaacagcagggcaaaagtgtattctttccgacattatatgaagcggcggatgaagtgggcagattatcaggctgtatttcatcaagaggtgttaaagcacaacgcgtaacatgccgttttttacctgcatgccctcctttgtaatcgttaatggggaggcatgcaggattttttttgctcagtatcgaatacaaacatgggacagtaaggacggttttagaaagcgtttttatgctggctggaaaggatggatgtcatgaaggttatcaaggggttaacggctgggctgatttttctgtttttgtgtgcatgcggaggacagcagattaaagatccgctcaattacgaggtggagccttttacatttcaaaaccaagacggcaagaacgtttctttagagagtttaaaaggagaagtatggctggcggattttatttttaccaattgtgaaactatatgtccgccaatgaccgctcatatgaccgatctgcaaaaaaaactgaaaagccgaaaatatagatgtccgcatcatatcatttagtgttgatccagaaaacgataagccgaaacagctgaagaaatttgccgcaaattatccattatcttttgataactgggattttctcacgggatacagccagagtgagattgaggagttcgcacttaagagctttaaagcgatcgtaaagaagccggagggagaggaccaagtgattcatcaatcttctttttatttggtaggtccggacggtaaggtgctgaaagattacaatggagtggagaatacaccgtacgatgatatcatttccgatgtgaagtcagccagtacactcaagtaagctaagagactaggcatttgcaaatcttctaaaacatgatacactttccactagtagaatgggaaggagcaacaagattgaagctgcgcattttttcaatcatggccagtttgattttgcttcttactgcgtgtacgagcatacgtacatcatctgagggaaaacaaaaagcccatgaaacgaaaacaaaagaacacattgtcatagcggctgtcggagattcgctgacagaaggagtcggagatcccgacggaaagggatatgtcggcaaggtggcggattctatccggtcagataaacaagtcaaaacggtcgacgtgaaaaattatgctgtaaaagggaaccgttcggatgatttattagaaaaactaaaagataaaaaggttcaaaaaggcataaaggacgcagattatgtcttttttacaattggcggtaatgatttgatgaaaatccttcgccaaaactttctgcaattaaccgttgaaccgtttcaggaagcggaaaaaccgtacgaaaagcgctttgaaaaaatcatttctgaaattcgcgagctgaatgatcacgctgagctgatttatgtcagcatgtacaatccgtttacgtttacattatcagaactaaatgaaataaatggtgtcgtcacggattggaaccatattgctgaaaaagagctgaaaaaagataaacatgcaaaaatcgtccatatcgaagatttgtttaatcaaaaaagtgacagcagccgaatttctgaggaagatgattttcatcctaatggtacgggttattctcttatcgcaaagcgcgtctatcaagccattaaaaaagaaggattaccgaaagagtagggtgacagcatgaataagtggaagcgactgttttttatattgcttgcaatcaattttatcctcgccgccgggtttgtggcacttgttttgcttccgggggaacaggctcaggtgaaagatgcatctgagagcgagtatggatttcaagtgacaagcacaaaagaatcattagctgcgtttgttaactcatatttaaacgacaaagcatcaaacaagcttgattataaagtagagattgatgatgatgttcatgtcgcagggaaaatcaaggcattttccacgtctattgatgcgtttatcgcttttgagccgaccgtgaaaaaaaacggtgatgtagagctgaatgtcacgaaattttcgttagggaaattgagtataccaattagctttgtgttaaattatatggacagcttttatgaattgccgtcatttgtccatgttcaccccggagataaaagcattgaagtgcgtttgtcagaaatgcctttaacgaatggaatgtatgtcaaagcggataagataaatttagaaaaagatgaaattgagttttcctattaccatcctaaacaatagaggtgactgaaaatgaaacggatttaccagtatttcagtttattatcctttacattttccctgtacttcggctggcttgcttatcatcatctggctgctgaagatatggatcaaatgtatttgaatgtttcctattgtgccttgttcctaagtgtgatggtgtttacattcggtatgcgagaccgaaaaaaaaccgataagtcatgaaaaaagagacatgaaacaacgtctcttttttcgtgtggtccgaagaaaatttgagaacacaaggagaaaagatgaaagcatacgattttacacaggggaacgtgctgaaacagcttgtactgttttcaatgcctattatgctcggaaacgcattgcaggtttcctttcaatttatagacagcttgtggatcggcaatttactgggggcaaaggcccttggggcagccgcggtatcaagcacgattgttttgaccgtgctgtcttttattttgggccttaacaatgcgacgttaaccattttatctcagcaaaaaggaaaagatgatataaaaggaatggcgtcgtatattaacgcttttgttgttttattaacaggcctaagcatcggattcggcgcggccggtttttttctctcagagcttttgctgcgtcttctaaaaacgccggagtcaatgataccgcttgctgagacgtatttacagattcaatttatcggcattttatttttgtttggttataactttatcagtactgtgcttcgtgcgctgggcgacagcaagacacctctccggtttattgcgtttgctgttgtactgaatacagtgcttgcgccgctctttatttctgtgttccgcatgggaatagcgggagcggcttattcaacgattttgtcacagggcattgcgtttttgtatgggttgttttatgtcatcaaacacaagcttgtgccattctcgattccgagaatgcccaagtgggaagagtccgcgctgattttgaaactcgggattccggcaggtctgcagatgatggtgattacaggcggtatgatggcgattatgagtgttgttaactcatacggggatcacgtggtatcaggctttggcgcggtgcagcggcttgatagcatcatcacgcttccagcaatggctgccggtacggccgtcaatagtatggcagggcaaaatattggaatcggaaacgaaaaaagagtgggaacaattgcaaggctaggtgtgatagctgttatttcctgcatgctggtgattgcggttatgatttgggtatttggtaaatacctcataaggttatttatcagtgagcctgatgcggtcgcatttggtgaacaatatttgaagtggatcgcgtttttctacccttttattggggttaattttgtgctgaacggaatcgtcagggccgcgggagcgatgctgcaggttctggtattaaatttgatctcgttttgggtgttgaggtatcctttcacagctctattttcagcttggcttggacaaaaaggaatcgggcttggaatcggaatgagttttttatttagcagctgcgcggcatttttgtattatagatatggccgctggaaagcaatgaagctgtttactgaaaaataagtgaagcactgcgaaaagcacatacctatatatcggtatgtgctttttttcaccgttttttatcaagtttgctgaagagctcgattaacgtggcaagttcagcatcagtgtagcagtcaaagcgtttaaagaaatattccgtttttttctcgttaaagtgctgaaggactttttcgcccgcttcagtgatatgaatgcggatgatgcgtctgtcttccttcgatctgattctcgtaatccattccttttctaccagcgcatcggtcacagccgtaatgtggcttgccgatacctctaaaataggcgcaaattcagtgacttttttaggcccttgttcactaaggattcgaagaatggtgaattcattccgcgacagctctttatctaaaatttcattgatttcattgcgtatttgtttaaagactttacggagtaaagtttccatatcgtacatcatctgtgttcttactttcaaatttgtgaacctccattacataagcatattgcttaaaacctatagattttattgaaaagcagaatcattttcattctatttttacatgctataatataataataccacgtattaacaaaggaggcaccagtatgtctgaaaaaaaagaaatcgccacatttgcaggaggctgtttttggtgtatggttaaaccttttgacgaacagccgggaattgaaaaagtggtgtccgggtatacaggcggccatactgaaaaccctacgtacgaagaggtgtgcagtgaaacgacgggacatcgtgaagccgttcaaatcacgtttcatcctgatgtattcccttatgaaaaactgcttgaattattttggcagcaaatcgatccgacagatgccggagggcaatttgctgatcgcggcagttcctatcgcgcagccattttttatcataatgataaacaaaaggagcttgcggaagcttccaagcaacgtctggcggaaagcggcatctttaaagatccgattgtaacggacattttaaaagctgaacctttctatgaagcggaaggctaccatcagcatttttataaaaagaatccagcacattatcagcgctaccggacaggttccggacgagcgggatttatcagcgagcattggggggctaaataaatggcgtacaataaagaagaaaaaataaagtcattaaatcgcatgcaatatgaagtaacgcaaaataacggcacggagccgccatttcaaaatgaatattgggatcataaggaagaagggttgtatgtagacattgtgtcaggcaagccattgtttacatccaaagataaatttgattcccaatgcggctggccaagctttacaaagccgattgaagaagaagtggaagaaaaactggacacgagccacggcatgattcgcacagaagtaagaagccgaactgctgattctcatcttggccacgtatttaatgacggaccggggccaaacggacttcgttactgcataaattcagcagcgctgcggtttgttccgaagcataagctaaaagaagaaggatacgaaagctatctgcatctctttaataaataaactgttaaaaacaggcctgcctaatggatagacaggcttgtttttatgcctttttctcttgatgcaattcttcaataatctgagcaattctttctttcgtaatgagcggggcttgatctgattgatacccaggcagattgactttgcgaaagtcaggatgtttttccggctctggaaggatcgcataaaggttgccccattcatacagtgattcaatttcatgtggagatgttaattcttcgtgaagcttttcacctggacgcttgcccacttctactgcagccggccgcgggagcccgtgctgcgatgcatattcttcaaacccatgaatcagttcttcaagtttcagtgattccattttgaaaataaaggtttctccgccttttgtaatagcagccgattgtaatgtcaatgtagctgcatcgtctattgacatgaaaaatctggtcatgtttttgtctgtgatggtcagaggttcaccctccatcatctgttcaaataatatggggatgaccgaacctctggaaccgagaacatttccaaagcggaccgaacaaaacaaggttcctttgttttggacgtggcggtttgcttgatgaaacagcttttcagataacagcttggtggcacccattgtgttcacaggagatacagctttatctgttttttaagatacttactacttttcttagtggaaactattagtggctgtgaggtcaaaaatgaaattaaaccttaggataggggttatttcaaattgagctggtataggcccttttcttttttgtgtcatgttaacaataacatcttttaagaccatccttaatagctcgttctttttctctgagcttgattcaatgtgatactggtcaattattttatttatgttgtttctcactgtattactgtctatttctgattgtgtatcttgtaatccattgagctcattctttgcattctggagctctttaaattcttcatctaatgcagcttttctcttcaaaaaaagttcatcactgtaaatgccactttcatatttatcgaagatgaagttctctttgttttttagctctttctctttttgtgaaaggtgttcagacatttgcttttttgttttcatgttactgttgtcgtcttcgtactttgaaagcatcgaattgatgtgttttgttaaagtactatcatttaagtcatttaaggaagagaggtaatccagaattgcattttcaacatcgttatatctcacatacgtacacttatttttcttacatgtgagcgatttaacgtgataaacgctttcagttccatctttgttttttcgtatgcgtttagattcgtatttagataaaggctcaccacattttgagcaagtacaaacaccggccagttcacttaattcaaattcatctttatttggcaaaaggggaactttgtttgcgatttttacttgtgattgttgaaattgttctttgtcaattataggagcatgcgcatcttgtactacaatttgttctttttcaggtctaattgttctctttccgtcttttgtttttctctaaccttatatttaacagttcctatataaacttcattttggagaattgctttgattgtgtattgattccaacgttttttccctgacggtgtagggatttgtaaatttgttagatgtgaagcaattgctgtatagctataatcttttccattcaacccatttagaaagatgttaaaaattaattgaactacttttgcttcatcctcaactggatctagtttagacgtctttttgtttaattggtatccataaggtgccagtccagatatccattttccctgtgctgcataagtgtatttagcgcctgtcatacgctccctagtcatttcaaattcttctctagccataaataactcaaaacgtatctggcgcatgtcaacagggtttctagggtcataaaccttatatggtgtaattatgatcaatcgtttgctttgaaggaggttaacaatttgtcctgcatcgctataactcccacgactaagtcttgttatttctttaacagcaattgcctgatatttgccttcctcaagatctttaagacattctttgaaaacaggtcgaccatcaatgctttctcctgatccaatctccatttttaattcataagggatctcaatggccgtaagtattttattcataagttctttttgttctgtgagtgtgtcttcacctgttcttttttctcgttccatgtcctgacgagaacgtctaagataccctaaaatatttgtgatgttgtaagaattaacaatgttttttaactccaaaaatttagcacctctttatttgtgtttaatgtcaaaacagaaacttaattaagaatattttatctgacattgaatacgaaaacaatacaataatttgaaagaattgaattgattgaaattttatgaaaaaccttcttgaacatgggttataattagttcatctaaattcattgtaaatactttataaatccaggagggctttatgaatattcgcttttcaatgttagtttgtgtatcttttattttcttcactggtgggtgtgctgaaagtagtgcgaattcaaatgatggttctaaaaataaaaatgagtctaaagaggaatcctccgaagaaggtgtaaaggaaaatgataataaactcgcggatactccaaatatggatgattgtattgaagtgtacggaaaagaagagtgtgaacagatcactgagtactataaaagtgaagaagggcaaaaggagttggatgcaagcgaaacagataaatattctgcaaagtctcaaacaagtactacacataaagatatctatgaaaaagtatcctggcttgttaaagaaatgttcggagtaccagaaagaacaattccagctgattatgaaaaaagtttggtagaaaaaagggatgatggtttatattacattcaatcttcttatgaaataaaaggaactggaaaccaagcggatacttactatgagtttgaaatgttgatggataataaatacaacttgatagacgcatattttcccggcagcacaggaagatattcacgccctatggtgtatgacaaacttaaaaacatggaaataccagaagtaaagaaagtatctccagaggaagagaaaagggaagagaaaaaacgtgaagaaacaatgaagagtatttatggggaagagcatataaaggacaataaataagtagcagtataaataagtgtacgttaagtagtttaaataaaattcacattttatttaaacctgaaagctgcttgaatacatcacaaatataaagtatcctgtatatgtatcatagttggtgtatcaaccactataggccagagagttccctcacatactctctggcttcttttattaaccttacattattatttatggaggatagtatggacaatcgaaaaatgcttcttagacagaagttgaaaataaacaaacaaaaaagcctccgagtaacattgatgtcaacactgcctcgtgatatggcaactactattgaggattgtagtctaatcacatctcctgaattagaaagaatcctagataaagttcagaaaaaatggaactttgagttacataaaaatgattttgcaattaaatacagtgagcatagaaaagaatacagttgggaatatgaagtgatcaatcatgtgcaacaaactaagcttcctgatgaacaagtttacttatatttagggatagaggatagcccaatttttctgattaacggtaactggataatagagaactttaattttctgtgggaacaaataaataacagcgatttatggattattgactttaattttaaatatggggttctagtgtctcgatatggcggatatttagatcatgatcctaacccaaatgaaattatttatgcagtcactgaatgggggatataaaattgatttatacaacagagagttgcaaagggctttgaatctgcatttttggtggatttgtaaagtgatttacttagtgaaggaaattaaagaatgaagaggcgagccgcattgtataaagcataagttaattcgtggattacgtggtatgataatctcaaagacgaagggggataagcatgtttaaagaagtagactattgcacttgtgaagtgtccaaagtttataccgaacaaaatgatatgggacattgggatgtatgtgatatctgcaagaaagtcattgaagatacttttgagtactttaattacaattcagatgattattatggatgaaatgatttgacaaaatttttgagtcaacgtgacactctgttttgctttacatcggctaatatgataataaggtaataaatagccaggcgtatttccgaaggggagagcgcttatttttataacgagttaagccctcccattgttaagcgaggatcaaaagagtgggaggccttctcagtgaaaaggctaaacaggtggacactaaaaataagcttgaaaaatttccttccaagctcaatgatttaactgtcaattttaaacctaaagaacccgatagttttaaaaagtgttactaaactcatttggtagaccaagctatttttttatatttttactatcattattaataaaccatttctcagcaaaatccactgcttctgtaagtgaaaaaaggcggcaattagcagaacccactttgccaactttcatattatgttctgcttcaaacgcttgaccgacttcttgaaatagttcttctctaaattcaagttctttatattctttccatactcttttaccttctactattataggtgcacccctgtttataattttttgataaggaattctgtactcagcaagatggaagcaggtactactatcaaaatcagcacctaataataatacatatgattcccgtatataaagtttccccagaggtgattgttcacccagtccgaattctaaaggatgttgattaaggattttgtttttatgttttccccaagctacaaaggagtagtttgggtgattacttcttttaacttctggataagacctgaataactctactatttgccccatccctctagtagtgggggtatagttagaattataggctggcatactttctctaataatatcccaccactcctctggtacgggagggtttccccattcttttgggtcagataattccacggattgagaaggcatcacgatggtaccttcttcagtaacaacatctattaatgcttgaatcacagcaacagctccaccatttacccatcctatagaagataaagaggaatgtacaagtacggtcatccctttctttaatcctaaagctttcaaatcttctgttatagactgttttgttcttggaaaagttgtactttcaactatttttttcatttagttcatctcctatctataacctcttattagatactctgtaagtttgcaacaattaaattagcaagaccccttgatgaaaggtgttgtttttttattcatcttcttaaactaactgacccgttaatttaagtggaagttattacaatctctttatatttagtttaacataaataaccaagtaaacttagaaatccatttaaaactacataaaatataagaaactccgttatccataatattaaatcaacctttatctttaacttagccatataaaaaaagaaaagcccaaaaacgggctttttattttgtttgctctcttagtatagctactattttatcaagagaatgttcatcaatatttctaatggtacgcttgctactcattccaagcttacctttgatttttaaatggaggatacccaattgcatcgtggccattcccaagggatttggagcaatatcgaagtcaacttctttgatacttttaaattcaacaacttcagtatctgcacccccgaaaaaaccgcctttcatagtgacaaatagaagtttcttttcagtgataaccataaaaccaaatttagtaagctttggatctgcagaagtcatatgtaaaatcttttcctttttcccaacttccttttttaaagctttaattgcatactcataaaactttctttctgatttagggaattcttgaatgatggactcaagatcttttaaaagtattggataatctatgattccatacttagagtttaatttatgaaatttttgtcccatcacttatctcctttcatcgttcacaagcatagttgtcatgatccctgtccattttagattggtaagcagggtgggagctaggcactccattcggatatttctttcttaactctgtgcaatttttaaatgtttctgttcctccagttgtctctgaagaagcttctttttcagttgtagtcgaagtttcacttgatgcctttggagttgtaggctgtgttgctgccggtttagatgttgttgcttttttaactgcagtggttttctctttcacacagccattaaatcctcggtcagtcacatatccattcttgctccagattgaaagcttctctgattttgcttcttgctcgtctttcttaaattgatctatgtatttcgtatttggctcatatacatacgctactctggccaatccttcttttagcaatgtttcctgaacagatttgccatccacataaacataagctaatagtcttccgtatttatctctgcgatcacctttgtcaaattcaagctgcagcttaccactgttgaccaattctttatttcgttttgacgcatcctcaccatatggttgaacacaagaatttggtttctttgtttcaggtgtgtctatgagcaagtagcgtactgtgtctacatttccgttgtaggtaactttaattgtgtcaccatcaacagctctatctagagtaacatcgaccaattcctttttgtctttttccttagacttgtcagcagttttttctttagtagattccttttgttctgttttcttttccacatccgtagacgcttgtggtgtttctttttctgtgcttactttttcagaatcatttgagctgcaggctgccaacgataagctcaaagtgaatgctgcaaaacctaataatactttcttcaacttcatttccccttttagaatgtttgttctctatttatatcggtaaaccatcaataattataatcctgtatccaatttttgtgaattaaattattccttaaattttgtcttgtgatgaaataaaactggcgactgtcattgtaattagtttagctgcattttcattttcgatctgctctacaaaatgattcccgtcttacttttttatcgaataaaaaattgaaaaaataaaataatttggtaggttttttgttatattaaatatataaactctagatgatatgaaagggcgggtcaagaaatgaaatatgataatcttttagatgcaacatcccaatatggaccacaggatcttttattaggaagagatgggctaatatctactggatattgggcaaaaactcaagctaatattcttactggaacgggtttgcctgtgagcaatgatgagatgaaaacttatttgaacttaccgaaaaacgttgaaatacctcaagattttcagaaattatatgatgtttataacgaatataaaaagttgtgtgactggtggttggagaaattattaagctgtgttaataaaatggctaatgatatatacaatgttgggtctaccacttcggaattgataaacgaagcattacaaccaggtttaagggcaattacaactgcaagcaatgatcaagatagacaagatgctattcaagattttcatgaggtctgtcttatacttatgagagagctcgatgaaaatcaacaatctatgaaagatgttcaaaatctactaaattcctttcttcaaggaggtaacaacttcataggtgttacacaattgaacaattcttttgaagaagtaatgacttatttagattcacaatacaatgatgagagcgagatacatgatttattgaatatattcatgcaatttaaaaaattgttgggtgaaagtcttgaagagcatgagataaatgagaaagtaaaattcagctctgagttaggccctttaatcgggtatatagtatccgaaatgttagagtattctgatgttcaaatgtttaaacaacgaattgataattttcagaatttaaacggtgtagatgcacaagttgcattagttgtaaaagttttaagtctgtttcacggcatcaatatagacttgcataatgtaatataccaggcagaaaggtctctggagtttatagaacaaactgaaggaaactggcattctatagcaaatcaattttattcactcgcacaagggtttgagaatgaggatatcaataagctttctacggatcttgataatgctgcggccacttgggaagctgttgctaataaagcaaaagagtttgtaacaaattcataccaaggataaaaaatgggtaatctgaaaaagtgtaaaaagagggttaaaaataaccatcctccattgctttagtcagtatggaaaagtcagcaccatagttttcttcataaacccattcatagcctatttgaccccaatttgggaattgatcaggtcacaattttccgaaagtagcttcaacttctttgaatttcttttttactttacgataaccttgtgtaaacaatatttttgctctaagagcttcaaatgaataaccatggctaatattggctccttgtcttaatcaaacaattcaaggattccgtataggcgtttgtaatgggagaattgaaatagttgaatatctcttcttcccaattattcattgacttaatcaggtttttaaaataagtcattaactctttaggaacctttgaaagccagttttgaatcatatttgttaacattattacttttaccaatatgaatagaaagaaatccaaaaagagatgccgaaacatccctttgatttaaatatggggtgatttatttgactaactttgttcataagacggtaaatggcttgaaaagtcttttagatgaaaaaggagccattcaattgttttgttcagaaggtgatatcatggagttccttgttacattttcaccggacaaagcaaccctgaatgacattcaaagctttgaggctaaacaccagctttcccttccagaggattatcagaagttcatcacactacataacggtgcgaaaatttttgagattctttctgatggggagaatataggtggaggacttcagctatttagccttgaagagattgaagaggaactaaaatatgaggatttgtttgaaggtatcaatggtatcccaattggctacttattggaagaatgccatttaatgatcgataaagataaaattaatcaaggtgatcctaactatctctatatatttgaaagtggtttagaatataatccattaaatttaaactttgaaatatttttagaccggtatatattggctaatggggaacctttttgggattggcgctactataccgcagaaaattattatagaacaagatagtgtgatgtataagacagtcagttctggctgtctttttctgttattcaagcaaatgattgtggtaaaatttacatagagtaggcttgaaaggagaatgaaatgaaggtatttgaagctgattcattgctctctgaagcggataaaagaaccaaagagtataaggaactaaggtcgcaaatggtgaagctcaaaaaagcgtttaaagctgtagctgacctagacgacagcaagttttcaggtaagggtgcagacaacattaaagcattttatcatgaccatgtcggcgttacagatcaatggattgatcttatcgatatgaaaattgttttcttaagcagcatttctgcaaaacttgaagacgctaagatgtctgatgcatacatagaagaatccttcttagaacatgaacttgtaaatgcatacacaaaatcaaaatccattatgtctgaacagaaaaaagcaatgaaagacattttaaacgacatcaatgatattcttccacttgaaatattctcaacagaagacttcaaagacaaactttcctctgcagatgacaaacgtgaaaaaacaatcgataagataaacaagcttgatgaggatttaaaaacagagtacgctgagactgaacaaaatgaacaattcatccagcaagattttaaaaagctgcaggaatcaacaggcaaagggaagaacgccacaccgattcactatagcgccaaagcgtatagagaaagtgacatacataagaaaaaaggcgatattgagcagcattcagaagcttatttaaccgtgaagaaagaagaagcaaaggaacgtgaaatcaaggaattaaagaaaaaacttaatgacggtgtgtctgatcctgatgaatatttagagattgctaagaaagtagggtacgagaatctggagccagctcaagtacagcttgcagtgcaaattgaacaagcaaagcagctagaaggagcaggagaaatcacctgggacatcgtaaaaggtgtaggggtaggcttatatgacgttggcaaagacactgtaaccggcttatgggacttcatcaccgatccaggagaaacattgtcagcgcttggcaatgcagttattcatccagttaaaacatatgatgcaatatctgctgcaattgaagagtcatatcaaaaggatatggtgaatggagatgcctattcaaggtcaagatgggtaacgtatgcaattggctcagtggctgcagctgttatcggaacaaaaggtgcaggagccattaacaaagctgatgcagcaggcaaggtaataaataaagctagtcaagcagggaagaaaattaaggacgtcaagattccagatttgctgccttataaccctaagtacgatcttgctatggcaggggacgtgccatacaatgtagtggatggagaaaacttaaaaaatcagctaatgagttttgctaaagggtcagataaagaagtaaaacctttcgatgtcgttgattatagaccaagtaacagtcctttagagaatcatcacggtgtaatggacgtatgggctaaacacaatgttccgaattatgtgagtagagggagtaacacaccaacagtagctttaactaaggaacaacacaacgctaccaagaaagtatatagagaatggttgttcgaaaaaacagggaagaaagttggcggcaaagtaaactggaaagaagtatcccccagagaaatacaagaacttactgagaagatgtttgatgctgctaatgttcctaaagaagctagacagcaatattataacgcatttaatcaatacaactttagaaagtaggtgcggacttgagcattgacatgttaatcaagaagattgcttctacatcagactgtcggctgtttgaagctgatggtctcccagtaatagacgagaagcatcaactaccaaaagatattagtgaattttatgaacaatgtggtggagcagttttatatgaaaatgcggattatccaatatacatagtacgaccagctgagtttgaattagctaatcccattattgttggggagctctgtgaagaagacatttcatccgagtggtatattgtttgcacggatggaaaaggagaatacctaacaattgacttaaacgatcagcgaaaaggaaaatgctatgacagtttttttgatcgacatggaatagtcggcgaaacacaggtgatagcaagttcatttacagatttaatacagcgactgcttgaaaataagggtaaacattggtattggttaagggatgattatgtatcactaggcgatgcatatgatggcatagaaattgaataatctattaaacaaaagtattgcaattgttcattgctaaagatgtgcaatgcggagggtattaaaatgagcttcactaagatcgaacaaaagttgaaagagtttacgattgatgctggcagatatcctagcattaatacaaatgaacaactcaaagagcttgaaatgaacataggcaatcaattaccttcagattataaggactttttgaagaaatatggaggatgttatttagaaagtaaaaaacaacagatgagattgagtatgacgtttgctataaacctttagagaaagatccatggatgggcaagggcgatgatacacaattgttagaaggtttttatggtttagcgaatgatcataacagtcttcagaaagcaatcgatacatattctgatcgctttcctagaaatattattcctatcgcaagctctgcaggcgggaatgaaatatgcatggatatcgataatggaaagatattgttttgggatcatgaattaagtcatcccgacaaagactttttcttaattgccaattcgtttgaggagtttgtcttcagtttagttgatgaaccaattgaagctgataaagaagatgatggaattctgtatattgaattagatgatgacttactaagcagttaagaaatcgtatggaaataactggagggaaagttaaaatggcagttacttattggacaggggagaatcttacactgcgagcaattcaacctgaagatatcgttatatttgattcgttagatgatgaaattctgcgaaatatggactcgctacattttcctcgttcagctaataacatgagagaatgggtagaagaacaattagaaaaagatgaattccgttttattgcagttgaaagtgataataatatagtaggtatgattgaaacctttgactgtgataggaaaaatggtaccttcggttattatttggctgtattcgagccatataggggcaaaggatttgccaaagaaatgatcttgatggttcttcgctttttctttttggaacttgcttatcaaaaagtaaatacaactgtttattcttttaataatccatccatacgattacatgaaaaattaggtttcatgaaagagggacaactaagaaagatcattttcactaaaggtgcctattatgatggtatttgctttgggatgacaagagaagaatttgaactgaatcatggataatatcacttgtgcatcgataaagtactgggttccaataaaataatggttttattcaccaagcaatagtattgcaaataccatttttatatggttataattagggtaatgatacaattatataattattttttgcattttgtttaattaaatgcataaaataaaaagaccagggtgttggtagcaccctggctctgtacaaaagctgcccatcaaagggcttgctcgttgtcaaatctgcgtaggcctaacccttcaggtgtccaaactcaagggaaggtctattttttcttttggcttgacgttacaatcatcattatattgaagatcaacaagacggtatttaatatcaatccgccaaaattgatcattatcattaatgattcgtaaacagtcattttcccacccctttcataggggatgagcaagactcccttgagtgagcaaactttatgtacaggaaatattatactatacataaatgtccttgtcgttaaaaattcacaataaattgacaatatgaaaagaacttgcttaatgcaggttctttttttatttcaaatattaaacaattcccttcaaatgacgatatttaacatgtaaacttgtaccaaggaggatttaggaaatgaagaagagaattacatattcactgcttgctcttctagcagttgttgctttcgctttcactgattcatcaaaagcaaaagcggcagaagcattaccactctactatctacaaattacagggattacatcagacggaaacgattttgcttgggataacctcacttctagtcaaaccaaggcgccaaacgttttgaaggggaataaactatatgtgaaagctcgttttatgggttataccaagttaacagttatcacaggcaaagacggtaagaatctgttgtataacggtacagctaaaatgtttaaatctgatgctatccttggtcaaaataaggtggtaataggctgggataaatattttgagattcccatggacgcacttcaagataactctatacagattaaagcattgagctcaggcaccacttttgtttacagtcaaaaaattgattttgaaagagagtgaaccaggtgattagtacttctaattatgatgtaactaaagatccaaaattcttagctttttgtagcttagcaacagaagggtatggacagaacaatactcagcaatcttcaataggttttaacgagttttgcgaaaaacttgagaaaaatgcgatcgttaaacccgagaataaaaaaagcacgcttgatttgaataagtctttagaagactggaaattgagatttactgcaggcggaaacctttctacaatggattcgcaggtattagatgttatcaaaaaagcttataacttaggcatggttaataaagataatatgctattacgaaatgaagcaattaatgcttatagaaattctatttaaataatgaaaacaatgcccagcttaaataaagagctgggcattttacttattggggttatttgctttcaaatactctcgatgttctttctccaatttattaatatcatcttttaatatatagatcttatatttttcctttgcttctctagacagattatcttttaaatactcacggagctttgcttcacttttggtttgatccatgccaattgtaattgccggatctgtttgaccaatttgcacactgaatataccaaattcatcccgaatattatcaattacttccaaaggggactttttatttgcttcgattaaagtaatacctgacataatcaaagcaggaactaagaccaaaaatccgattagcctcttcttcattaaccattacactctccttcatggaaaagaatccctcctttattaatactacgcaaatcatcattgacctttatattttattaccaacatttacatcgaacttttgttctggtttatcttgaatgaagaacgtttgttctgttaatattagatcaataaaggagtggggcgatatgcttagagatcgaggaacaatcaaatggacatcaatgatgcttccagaacatttgacacagcttaaacaagatttgattgatgtatcaaaaattgaaaagccatccttagatgatcaacaaattgaagagatggatattctcgtctctgaggcacttgaatttaacaaagagttgcaatttaaactttttcacaatggattcgttgaaaatgtcaccggcagagtccattacataaattttgaacaacaaaagcttcacgtaaaagaccagaatgacaatacagtttatatcaacatgaataacatcataggagttacatacaatgattgattactcacaatttccacgtaagaatatactttgtgtcgatatgaaatccttttatgcttctgtatcggctgtaacaatggggcttaaccctttaacatgctatcttgctgttgtagggaatacggagagacagggaagtgtagtattagctgcatctcctgcacttaaaaaagattttggaatcaaaacaggatcgagactatttgagatacctgaagatccaaggatacacattgtaaatccacaaatgaagcttttcatcagagtttcaactgaaattacaaagctgttttacagatttgttcctgagaaatgtgtccatacgtattcaattgatgaatcttttttagatgcaggaaaagaagatcctgaagaaatggccaaagcaatccaaagcagcatgtggagagaatttggtttgatgtgcacagttggtattggagacaatatgctactcagtaagcttgcacttgacctggagagtaagaaaacaaagagtggcattgcacgttggagatatgaagatgtaccaaataaactctggaaggttcgccctttgtctaaaatgtgggggataggagggaggatggaaagaaacctaaatcggatgggaatatcgactataggtcagttagccaaatttcctttagagctgcttgaaaagaagttcggaataatgggaaaccagttgtactaccatgctcacggaattgatttatcagaaataggtgctccgttgatgcaaggtcagattagtttcggtaagagtcagattttactgagggattacacaaggagtgaagagattaaggcggttcttctggagatttgtgaagaagtcgcaagaagggcacgtacacataataaagttggtcgaacaatcagtctgggaattgggtacagtaaggatgagcttggtggtggttttcatcgttccaaaacaattgatcttcctacaagtatcacgatggatatttatagatgctgcttgatgctttttaataagttttactcgggtaagactgtgagaagtgtctcagtcacgttatcgaatattgaggatgatgttaatcagcagctgagtttatttgaagtggataatgaaaagagaaggaaactcggttttgtaatggatgggattagaagtaaatacggctctaaagcgattctgagagcagtttcttatacaccagcaggaactgcacttcaacgagctggattaacaggtgggcataagagttaagataaatttaaacttatataacacatcgcttaaagttttttgttttaaaaacttaaaaacatggtaaaattatataaaaacataagaaagagtgattatatggaatatgtagttatgataatcattttattagcacttttctttatttttactgttttcctaaatacacgttatagttttgatgaaaaatgcttagtcttaaaatttggtttatctaaaacagaaattccaattaatcaaatagttagtattaaagagtcagacaagtatggagttgcagataatatcgattataaaattggtatgccatatgctcaaccagatagaattgttattgaaactacaaataagcgttttctagtttttttaaatggagctcaacaatttattcaaaagtataaaagggttagtgtttgaacataaaaaagtaccttcttacaatagaaggtacttttttgtatctataattattaaaaatttacctaaatttttatcattattaattcaaaataaatccataatagtcaattttatttagtgtattacaaccaattctgtttattgataggtaataaagtttttttctatgatttatgaacaagtttccttataattttcaaaaaaataaaaaatatggttgaatttagatttatcttcctttatattaaaaaatgtaatccggattgcaaacaaatggggaggttttacaaatggaaaagctatttaaagaagttaaactagaggaactcgaaaaccaaaaaggtagtggattaggaaaagctcagtgtgctgcgttgtggctacaatgtgctagtggcggtacaattggttgtggtggcggagctgttgcttgtcaaaactatcgtcaattctgcagataaaacatttgtagagggaatattttaaatattccctcatatttaaagcggggattgaaattgaataagaaaaagaaatatgttcatactaaacagtttaatagtcatgattgtggactagcttgtatctcgtcaattttaaagtttcataaccttaactatggaattgatttcttactagacctaattggggataaggaaggctatagtttaagagacttaattgttatttttaagaagatggggataaaaactaggccacttgaattgcaagaaaataagacattcgaagccctaaaacaaataaagctcccttgtatagctttgttagaaggggaggaatatggacattacataacaatatacgaaattagaaataactatttacttgttagtgatcctgataaagacaaaataactaaaataaaaaaagaggattttgaaagtaaattcacaaactttatattagaaattgacaaagagtcaattcctgaaaaagaaaaagatcaaaaaaaacattcttacttttttaaggacatactttttagaaataaattgatcgtttttgtgattttattgacttccttgttcgttgtgggtcttgctgtagctgggtcgttttatataaagtttctagttgacctaattatcccaagaagcttaagagaatctttaatcacaatcactttaatattcataagtatggtcttaataaggtgcatcttcgattttgtaagatcatatttgataataaaattgtcttacaaagttgataaagagatgtcaaatgtttattttaataaagtaacaaaattacctattaatttttttgaaaacagagaagatggagaggtaatttctcgattcaatgatggtatatatattaaagacttttttagtgctaactttgttactgcaataattgatataattttaatactgggattaggagttattttatatagaacaaataacattcttttcttaacaattattctcccgattttgctactttcatgtctagcgattttgttttttgatcatcttaaaaagaaaaatcaaaaactgatggaggataaggctaaatctacctctcttttaattaattttctaaagaatatgacaactgtttattctttaaataaaacctcgtttttttagaaaaatttcatcttacatatgataaacaattaaattcaacctttagtgtagcaaaggcagttattagcaatgaaatactaaaaggattaattcaaaactcttttacaataattatcctatgggttgggacaagacaagttctaaatgattcaatgagtttgggtacactgctatttataaacacattagcagcctttttgctaagttcactagatcgtatattgagtatgcaatcagatcttcagcaggcacatgttgcttccataagattttttgacgtagtaaactatccagttcagcaagatagcaatgagaatttaactgaacttgattttattcagaatatcaaaacagttaatcttaatattggggcagacccaatgcgttatatagttgaagatattaatttaatattagacagaaaggataaagtccttattattggagaaagtggtactggaaaaagtacgtttgcaaaaagtttgtctaaattgtataaagtacccgataagtcaatttatttaaatggattagatattaatcgatacgatcatttatcaataagaaaaaggattgtatatattgacgaaaatccttttctttttaagggaaccattaaagagaatctttgcatgggagagatttttgatcagaacgaaattgaaaacgcgtgtataatgtcccaatgccatgaattcatttgtaacttggacaagcagtacagttataaattgtctgaaaacggttccaatctatctacaggacaaaaacaacggttagcattagcaagagcaattttacatcaaccacaagtattaattttagatgagtcattatctaacattgatccggataacacaaaattgatttatgaaaccttacacaggatggattgtttaattattcttataactcataatgacccaagtaacttcaaatacaataaaaaattagtattcagaaacaataggattatagagtcgagctactcggaaaataaggagtattctatatgaaaaagtggattgttttatttcttgttttaatagcagcagccattagtattttcgtttatgtttctacaggtagcgaaaaacctttttataatgatataaatttaactcaatatcaaaaagaagtagactctaaaaaacctaaatttatttatgtttatgagacaagttgtcctccttgtcaagaaataaaacctgagttaaatgaagtaattaaaaaagaaaagttaaaagtacaggctttaaatattgaagaaaaggaaaattataacactgaatttttagataaatataatttgaataaaactccaacgattctctattacaaagatggcaaagaaaaagatcggttagagggctatagaagtgcaagccaaatagaaaagttctttgataaaaatggtgatagataatgaaactgagtgatatttatttggaattaaagaaaggctatgccgattctttattgtattcagatttgtcattgttggttaatataatggaatatgaaaaagatattgatgtgatgtcaattcaatctttggttgcaggttatgaaaaatcagatactcctacaataacatgcggtattatagtttataacgaaagcaagagaattaaaaagtgtttaaatagtgttaaagatgattttaacgagattattgttctagattcatactccactgatgataccgttgatattattaaatgtgattttcctgatgttgaaattaaatatgaaaagtggaagaatgatttttcctatgctagaaataaaattatagagtatgctacttccgaatggatttattttattgatgcagataatttatactctaaagaaaacaaagggaaaatagctaaagtagctagagttttagagtttttttctattgattgtgtagttagtccatatatagaagaatatactggacatctatattctgatacacgaagaatgtttcggctcaatggtaaagttaaatttcatgggaaagtgcatgaagaacctatgaattataatcatagtctaccttttaatttcattgtgaaccttaaggtttaccataatggatataatccttcagagaataatataaaatcaaaaacacgaaggaatataaatctcacagaagaaatgttaagattggagcccgaaaacccaaaatggttattctttttcggcagagaactacatttacttgataaagatgaagaagcaattgattatctgaaaaaatcaataaacaactataaaaaatttaatgatcaaagacattttatagatgctttagtgctattatgtactttattattgcagagaaataattatgttgacttaactttatatttggatatattggaaactgaatatccaagatgtgttgatgttgattactttagatctgcaattttgttagtagatatgcaaaataaacttacttctttaagcaatatgattgatgaagctcttacagacgagagatacagtgctataaatacaacaaaagatcactttaaaagaattttaataagccttaatattcaactcgaaaattgggaaagagtaaaagaaatatcaggggaaattaaaaatgataatatgaaaaaagaaattaaacaatatcttgccaactcactccacaatattgaacacgtcctgaaaggaattgaagtatgaatacaagatatgtaaaatcattttttttattactgttttttctctctttctttggcacaatggctagtttattctacagtgagatcatgcatttcaaaccatgtgttctatgttggtatcaaagaatatttctatatcctatacctattatcttactaataggcttattaaaaaaagatcttaattcgatattttatgttgttttcctttcatcaattggattgattattgcgttttatcattatattatccaacttacacaaagcaaaagtgtcgtatgtgaaattggaaccaacagctgcgcaaaaattgaagtagagtatctaggctttattacattacccttaatgagttcagtatgttttgcattgatatttggtataggactgaaattaattatcaaaagcaagaaattaaaacaaaatcaacatgtatataattgaataagaagtaacccgccttgtaagagggagggttacacaggtaatccgaaaaaagctatttaaacaagttctctttttttagaacttgtttttgttttttccttttgcagttatgtaattgtttttgaaccatgctgcggtagtagtactggttgtgaagacgatagtgaaaattgtatataaacaatcatataaatgatttatgtcctcttcgttaatgatgaatgctgctttacccagcatcaccattatttgattgagtaaagctattgcgagcaaaagagtcctaacaattgtgcctttatcaatattctcaaacattgaattcctcctacttaaaattttgttcgattttatctagcttttcaattacaacatcgtacttttcactgaatttacccagtacttcgttttgagaatcgatttgattataaagtttcgactctctttccttactagttttcattacgtagaaaagtagccaacaaaataaaacagcaaatggcccctgggtacttaaatattgtgttatatccatttccataaaatgttcaccaccttagtaccatagaaaaggatatttactgaaacatattgatcaataaacatcctccgagaaaattgaatataattagattgttgatccaaactgtcccgagatatatccacgtttacctttataaataacttcccagtagccattggaattgtttttacctttaactgaaccagaaattgaaatagtgcttccaagcttaactgtgccaatatttttagaactatttcgatcaggcttgtccattacgattgcagcgcttgatacaccgacaattttgatttttcctacggatttaatagatgaggaacttgaagaagttgatgttgtttttggggcagaggaagaggttttaactgatcctgtaacatcaacatatttgtcagaagcagtgatgtaatatgtagtgccttttgagttcttaactttgtattgataggcagatccaactttaactttctctacaactgtaggaaatccgatgcctttatttactgtgccgacaacatctttatcttcccaagatggttttgaatagaagcgaagtccgtcaacttttgattttagtgaaccacttactgctgatgaagaggaaggggaggaggttgttggtttagttggagaagcttttgaaacagatttgcctgacatttttgcctttactcgatttttaaagtctacaaatttttggctgttagatacccatggtgcagggcaattcttatgggtgatgtcataatgacgaacaatatcatcaataggatctaaaccaaacttattacataattcaacgaacacatcctcagttctttcaactgtatctgaatggaatgaaccgtctttttcaaggcacatttcaactccaatagaaagaaagttagcgttaggtttcagcgcagcaactcctcgataaggatttccggcactatctctttgctgaatatcatttgcatggtaagctacttcatttaatggaatgatacaaattgcttcagccttatctacgaaaatgtgagctgatgcataaacttgtgcattactgaagtatcttcgatgattgtctgcacctgcacccggattggctgtatagtgtaggacgcattttttcacaccctgtaatttcaaacctggtctagtatacttattgactggaatgtagctattagtgaaaactgacataaaaacatctccttaatttctaattaaaaagagcctcgaattcaccattttcatagcgatttcgaaactcgttgaattgaatctcattattgttggatgttccataaatttcatggaaaagattgtggattttcttagttagagggattccgagtccataatttaaatgaagtcttacacattcatttttaatttgctcaagctcattgacagtaaagtcgccaattttagagttcaaaacttaaattgctcagtgcttctttaacaatctcgctaaaattctttttatagtggtgcacatgaaggtcttttgtagagtttgttattgcacatttaaatgaatatttctctaatgagggcttcgtccaaacttcataaacagcttctcttaaagttttatttaacgaagaaataccgcctttccatctagagctattttcgcctgtgaaaagaagtaaataacactttctgcagtttgctaaacctcttaccatgttatgaagtggagcgtattgaactcctaagtctatatgttccttgcatagaaaagggagattttctttattgtgatggtatgtatcgaataaagggataaacccacgatcagaaaaagctgcttgtgcacattcaacagtgtattttttagcacctttacattgaaaacactcttcacctttaaagaagttgctgggaaggtgctcccatatatgtccttcagggcacttagcttttagtttagaatgacagtttttataggtgcttaaaatctcatagcctttaagggcatatctacttttcacagtacttatgttaagcctttttttaagggagccttcaattatcctgcattctggacaacgagtaccttttttaaagtgttcgtagtttacttgccatgtgtgattatgtcgacatctgactttcacctttgttttcgaatttaccatgtctccagaaatgtgaatgtagttattctgagctaataaatcaataaatttcttttgagtttcttcacgtttttttaaatgataatctgatatctttcttgccatctatccacctaataattaaatttgagcacaaaaaagagagaaggggactaaacccaatctctctttatctcacgtatgctcttgttatctctgtttttcaagtatgtattttgaataaaatctatattttatctagaacgtaaccaccacctttattgttcctttattcttaatccaagttcaagctaggtatattacctacgttacccgacactcgtcttctgtctatatctgatggagttctaatgaaagctgttccttcaacatcactataaactgagtttccagttacaattaaatcgtttgttccagtgtcttcttgaataaagtaaaggtgataatcagagtggcattgcttgaaaacattatcagagaaaacagcttctcttacagatccccaaattgcgcgatcaatattattagtgataatgtttcctgaacaaattgcattttgagagtttttgtaccggacgaaggtttttaaggattttgcgaggttattcttagtgaagatatttgcagcattacccacccaaagggcagtaccgctaaatgtgatctcagagtcaattagtttaataatttctccttcagcaacgttgatgcactcgttggctatattggaaatatacattccttcaatcgttatagacttgccgatcccgtgaatactcactcctcggtctgtagcattaaccaagctgcagtctttcattttaaatgattttatatttccacctgcgatcaatcggcagctactcttatttacactgctattgccatcaatttcaatgccttctatataattgtgatctgtgattcgcaacaattcatcaagtgagtgatttggatttcgaaggagtttagtgtaggatcgtctttcaccaacaattgagacatttgaagggagttcaattttttcactagcgctagttgtattctgcttaccgattaaatatgtacctttcggaaaatgtagtttccctccacctttttcagataaatcactaagggcttttttaaacttagctgtattatcgattaagccatctggtgagaagcctaaatctaatacattccaagtaggcttggattcaataaactctacacgtctgtttagacttgttgccaaacctcttccttcttgaacttcaaaaaatctgctatctgtatcgtcatcaggatatgaaattgttaaggtatcgaccactgcacgttcaatgccatcactaatgttattaatatattttccttcaacagcagtttgagagcttccaccaccatctaaaagaaatgcattaatacagccttcagataaaaataaagatggcatatcataagctgtaataccactggatcgaagtgagcggccatctacagtaatgataactagtgtaccatcagatctttgcccaatggcttgtcgaggatgcttaacatttaaatctgcccatgtagtcatttgagccgttcttggcttagaatctttaactagccaaatgccaaaagcaaaagagtttcgtgcgcctttagaaattaggatgtcggcatcaacttctctgtttccgtaaaccttcatagttccatcatcaaaaaatacacaagcctcagcgcctgtgtatccagcagcgtcataatctttgtagagaactccgtctttaatttgaagccccatgacttcaccatttgatcgccaaccactagcgtttattgcaacaacagatctttttcgttttgccatacttaaaactgtttcacgatttgttgtaccaaaataagaagatgtgggatcaatggatttttcaaagtcatatgcaaacgttttttgcaccatactttttttagcttcggttgttttaggagtaacctttgtaacatagtactcaataccaagtgtggcatcctgtttaaaagaacttgttactgtaaaatatctgtcatcagttaataccttgtttaaaatttctgttgttttcgtttctacttcattaaacttctgagtaatcttaggagcggtgtattcttctccttctgaagctagtagttcaacaggcatcggaacatatttatctaaattttgatcatatctataaaaaccagccataactttcctccaataaaaaagatcccggaggggatcttagtcagttttgtaccatacttgtcctgaatctggtgctgtatctgaaacaacaactcgttttttctcaggtgaaaaagaggcatccttataccagatataatttgcattaaatggttctgttgcgcttaggagtatattaaaaccttcatatacttcggaagttccaatatctacccactcaaatccatcccatcgataaacgatttttgtttctttaacagtcaccgtccaaccaatctgtggggttgggtaataggtgaaaatatctgaataggtatagacagatggtttataaatttttcttgtgttttctacaacttcttcataatttgatgtagcctgtctacaccaggctgtcacttcttggcatcgttttgtaactcgttcacattcagctatacgttcattcattcgaattattgtatcttcagcttcatcgataagtccttgaagagtttcaataaccatattcccttgtcgttttatccaaattcgagaggcagggaagaaggaagctccttcaccactataattaaaggttagcgattttccttcatttgaagcattaaaaaagacaactcccataaggtaatcaaccttaaaatagttgtcgtcaagttctccatcttcaatctctcgccattccttgttgtccccagtaacttcaacacgaaattctctgttcggaatctcagttaggagtgctcttccattaaatattgtcaatgtttcattgtaagttagataggggtcttcaacagaacctattctctttttacttaatattggatcattatataatttagcaaaatcagccagtttagttcacctccgttaattttgttggtaggcttcccagatatatttaacgtttaatttatttcctctgcagttactatctgagcctgtgacaaatagattgtttcccaaagcaccgtatcctaaatctcctccaataagggaaagtccagttgaagtaacttgataggcatagccccccaattggctttcaattactagttgactgtcttcaggtgaaatcggagttattttgactaaatcaggagtaaaggtaagggggatttgcttactgagagtgccgtctcctgtataaataccttttgcaaacttgggaggaatggggatgttttcagctaatgcataatcagatgctgctcgtccacctagcatctctgcattaccgtctattgaaccactaatgatccctgattcattacgcactggtatagagtttggagaagtcgttgttgaagctgtaaaaccattcaaggagtctgctgaacctgcagatgagacaacccattcttctccgttaaatagttcttgtttattgttctttggattgatccagattgtccctttttccggatcttctggcttagcttccgtggagattgtatagaggccattaactcttccactaagacttcctttaacttcaaccgaattagaggggaggtaggggttctctgaaggaaattggggttgaataatgtcggaaagtatacgtccgctgctatcaatagacgcttcaacagtccggtaggcttgaattccaaacgtataatacttatttgaaacctggcctgtaagggttgcgattctcttatcatagctaaccgatagatactgttcagatgacatctttgatccaaatatataggtgtctgaagatgtatctgagtaacagtggacaaggaatccgtcaatattgtacttatcctctttagaatttgggaactgccattcaatggagatatcaaccgatccattatcgttgacaacatgtgttattgcagttccgttattaagaatagttgggtttgccacaggagatgagatacgatcattacgtgcattgtaattaacaagaagtgtatcataatcaatttttttcttattatactctgtggatgctttcttagttgtatacaaagtattagcaaattcctgttccaatgacctggctcttttcccgtttgagagtgtaacctgtatactctgttgatcaaaatcgaaagtcatccctgaaagggttgctttgacatcggttctgaaattcttattaactaccctgattatatctccgagatatattctatcccaaaatgccttttcgctattaacattaaataggtttacgatgttcgttctgatatcaacagggggagcgtttctattgctcagttcctctaaccctttttcgtaaagctctgtctcatcaaaaatattatcattagtccaatcatcttcaaaaataaaataagacagttgtttcttaagctcctcaccaagaaacttgtccatcgataaacggtcttttagtttttctatttcctgagaaatgtttgtgatttgcgagtttattctggatatttcagcttttttggcggtaacttctaatagttttgcatctctttgtttaataagatcttttgtgtcgtcaccggcttttttcgctacggttatcttatctaaaatttgctgtagctcaatgttttcaagagtgaagagtttattttcttgagtcgttttttgggtttctaaatcccttttttggtttaaaaggaggtggaaagaagagccttctttattgacaagttcattataatccaaaatcgcatgacataaatcatcatccatgtaatcactgtgtgttattacatttctgtttttatcacgtttaaaaggatatagaaaataagaaaaatcgtccaagtaactctgtccagtagggtttaccgaattaatcacaattccgtctttacctgtgatgtttaaacgtgttacgacttcatcaatatcaatggtatcttccatatcaatcataaatcgttcaggggagaattggacacctttgtacttggatactgtgtctttcttataaaaagagacagtgttctttacagtgtcgaagactgggactgcctcaaaagtttcccatatcgtttttaaaaactcatatcttgttgaagtgacatcaaatgatcgtcttttttcattaaatgaaggatcaatataaccgatattgagtcttgtgcctttaagacaatcagtggccacttcctgtagattctttgaaactccttgatatgaccttattttgtttttatgaaggatgtacggtagtccttgacatctaacttgtattgtttgctcctcattttctgattttgttaaaccggttatcacaaaccattcaactctgtttaagaattctgccttgataagataccactcacgcattagttttgccacatggtttggcttcatcaaaaaattatacctggctttgagtggaatattaaaagatagatcatttaaatcagcaaagcttagattaagagatacatttgagaaatccgcaatattagcgattttctttttatttggttttgctaaagaaaggaggatttcgcctggtttaaacttatttaacaaaatacatcctcctataaatatttgtatcggtattttaatcgaatatagcactcaccatttattttaattctgtttttacctcttgttaaaatcacatactcttcatttacttggtcataacattcataacccgaaatacttgaagtgatcaattttttattggaatcaacattgataacttcatgatgttttattcccgtaaacttcagaggtgttctatataaagttaagttctcaacagttatgtcaccgtcgcctatcttcttaaattcaagagataacggaatgtccacatctcctatgttttcaatttcaatattcttaacacctgatgtgacatcaaaccaatgagttgttgtttcttgtccatatttataggggaataccttcattgtgagcttcacatatccatcgttagaacagttatgaactaaatctgtagcgtttattggcaaggcaaaataaattatgtctaaatttctactaaaggagagaggtttataatcatctacatttaaccaacgagcaactcttcgaacatttttttcatctagatgattttctatgtaaaaattcaatgggatctcatatggctcaagtttgacattgtctacatatggttctgaagatagcctagtgtatgtttcatttactgttctatttgcaataaacgactcctctaaaagtcctccttctgtatttacatttacggctcctaattcataagaagggatattattgaacataaagtattgactttctctaatcatgagtttccacctcaagttaagttaaataaagagtctgcttttgcagactcttacatgctaccatttagttttacaacttcgtttttaatgctttcaaacatcgatctcgctcccgattctcctcctattagcttatcaatgtggaaagtattcgttaaattaattgttttatctccagaagaagcaattgtttttgaggggatctcaatcttctttaaatttggaattaaactgtttgttaacattgattgattaacgttaggaactaatgaaggaatagaagtaattccttttttaataaggtctgctaattttactccttggccccattttggggaatcgtccacagcggtttcacgaacagcttttaccgtatcaaggatgttggctgtgtcagttttatttaagatcagttctttgtcatgtaggaatgcaagtttaccagcacctaatcctgttccagtgtaccctccagaagcgaaagaggatacttttttacctgtcgtgttgcctttgacagcagtattcagtgcattagatgcttctttgagtttatcaatcaggttgtttgaaatactttttccaatggactccatattggtattaataaacttagaaaactcattaagctgcttagcgatatcggtgatttttccattcataatcttatcctcaagctttttaaaggctcgttcatcatttacaagattatcgtatttattgttgattgactcctcatctttttcgagctgatcttggagcgcttctttccgtttgttactttcgcgatcctttagaaaatcatcaaggtctaactgctctttttgaagctgttcagttagttctttgacttttgactttccgaattcagaatcatcaagagagtattgattaatttggtcagtcaacttttgaatactgtcttgtctttcttttaattctttttgaaatttagcctcgtcatcagtcttgtctatctcatcgatcaagtcttgagtcgctttctgatgcgcttctaactcaatatcacgcattttttcgtacatctctttgtagatggatacaacttcatcagccaatgatttatagatatccttgatcgacttcttggtgttataaagctcaaggttaaaatctttctgtttatctttccagttttcgatttcttcagtgatctgttcctggatgtcagggaaacctttcgcagctttcttttgttcttcaagctgcttaatgtatttcttcgcttccttttgttgttgttgaatgagctttatttgcttgctatagtatttaaccttgtcttcatcttcttcagtcattgaaattttgttatcgacatctttaattttcccttgggttttagaagatgacttttcaattgacttaagtgtctcatcaactttagattgaacaagttgtttctgtagctcacgaacctggtcttgaacagaaattaaatctagcttggcctgtttaagctcttcttgaagctgtgcacgttgagcggagttcaatgctttatttgttttaatttctttttgaatccaattaactttttgttgttggattttagcttgctctgccacagcttttttctgatcagaggtgtattttcggaattccttgctgtcagaagtgtatctgttagccattgactcatcttttgctatccgaacatcaaaatctccaattcttttatcaaactcatcgagtttagattgaactagttcatactgaagttcttgaatctgatcattgactgaactgatatctccttggagggagagaagatcagatttagcctgagctatcccttgttgtcgttctgcctcagcttgtgacgcatctgaaatagaagttccaataccttgcatgtacttttcaggatcgattgtttttccattttgttcgatctgtaaatgaaggtggttcccagtcgagttccctgtactaccaactttaccaatagtttgaccggctttaactgattgacctgcttttacagaaggagtgttaagcatgtgcatgtacttggcaactgttccatcatcctgtttaataacaacccagttacctgcagttttactgtagccagcaatttggactttaccactttgaagagatttaattgctgtacctgcttttgcagcaaaatcagttcctttgtgtggggaggagcggagaccagattcctgttgtccatatttggagcttaccctaaaagcgctattatttgtataatagctggcgattgaagaagtggcagatgagagcgatttgctatagttggccatgatcttcttgacgtaattctgtgtttctttaaaaggagggataccaccatatttaattacgttaccaggcccagcattatatgcagccaatgctttttcaacattaccgccaaacttttcaagttgttgggcgaggtactttgttccacccataacattttgataaggatcgtaagcgttatttactcctaagctttttgctgttgctggcatcagttgcattaatcccatggcacctacaccagatcgtgctttagcattaaaccctgattcttgctgaattacagctgcaataagggcagggtcaacattgtatttactagctgctgaatttatgtagcttgaatacttgcctgaatatgatccaccagttgaggagggggttccaccagaagaagttgtagaggttacaataccgtattgagtaatgttaccggatttaatttgatctttaagcagcttagcttgttcctgcataagctttttcttttgctgaagtgctttaatttctttcttgattgcatctcgatatttctgagagtatttaggataatcattgacctgcttgttgtacttgtcaatctcagcattaactttttctaatgcttccttgtatttatcaacaacatacatggaagtcttggtttcttcattggctttttcttgttgatctgtccaattctccaatgatgttccagcttcaacaagtgcctgtttattcatttcttgtgtactggtggcttcttcagatgcagaaatataagattctaaagctgatttaacgctttgcattgcttcaatttgactattggagtatccaccaggttgaagcattttctcttcaagctttttaagttctttttttgcatctgcaacattattaattgacttaacttctaggtctgacagttcggcctcagacatatcaagctttcgttcttttcgtagctttttcaggctgtcaatccgtaaggtatcagcgtttaaagttttgatagcgttgttaacttctgttttcatcaatttattgctgtaggtaaccatgtcgttataagcatcaagtttaacttttctttgtttgataacttcatcacggttaattttcacaacgccattttcgatgctaatagcctgggcaagttccttatctttttgaataagggtattagcttcatttgcagaaatacttttaccttcagccattttttccagaagatcattgagaggagctacttgatctttggtgttattaaaaatatccccatttaagacatcttgaacggaatcgaactgcatagcatctgacatttctttaatagctgccttaatatcatcaacactatttgcatccagagcttcttttagcttcttaccaaaatcttctgcctcgttacctgcttctgccagcgtctcacctaaatcaccaacttcagatttgacggaagataagctcttatctccatcttttatgttcttctgtgctttgtcgaagctcattttaaaaacatcaatagaagaatcggatttggagtatgtttccaagagactttgaagatctttttttgcgttatcgaaagctttttcatcgcctgaatctaaagctttttgcattttttcttgaagctttcctaaagaagaggagaatttttctaattcttcaggatctaaatcatcttttaagttaagtttgttgacaacatcactaatactcgtctttaaagtattactgatatcaattgaactataagcatttgcaattgaaaggacgctatctttaactttagcatttccactctcaatgtcagattgagctttgagcatactttgtttagctttatcagctgcaaccttatagtcatcgtcatctgcaatgagatcccatttaggtctacctttatcgttgtagtcagctatttgtttgtactgctttaattcatccttagactttttaatttccttagaagcgtcttcgaatgttttctttgcgctgtctcttgtttcttgtttctttaaagccaaatactctttagtattctcaatcgctttttcaagctctttatttgtcttaagaattgcatttccttgagaatcatagcctttaactaatgcagggaaagtttgtgctaattgctgagtgacttgaaggtattcttgctcttcatctgaagttaaagatcttgactctttaactttttgaagctctttatattgctgtattagtttatcagtggagtctttattggtcgtaattgcttcgacattggtttgctggctctgctcaaaatcatctttagcttttttagcttctgcaaaagaagaaattaatgattctagcgcccatcccaaagcagcaaatgcaccgccaactaaagttgaaacaagcaaccctcgaagagcagtttttagaactcttgaggcgactgctgcacgagtcataccagcttctagcccagcagtcgctaaagtttcttgccccattgcacgtgtgcccaaaattaggctgctggctaatgtgcgggtattcttactgagcaaaagggttgcagtgcttactgcagctaaaaggggaggtaggaacccaactgatttgattactcctgtagaagcgttaagcaaagaacctgcggcttgagtaaattcaattaatccgtcgctaataaaagcatcagaagctgcaatagcaaattcagtgaagttattttgaagcttatttaccctagcttgtagactatctgcatacttttgctgctcactccaagcacttcctgttgagttagccgcagttttagccgcattctgagcaatagagaagttgttcatcattgcattaaaacgggataattgataaataccagctactccaattgaagtattttgtttctgagcatcagaaagcgtatcccacttaccagcaacttcactaattaaatcacttgctgatttagcttcaccaccagctgttttaactgagataccaatctgttctaacgctttaattgagctttgattattcccaatccgcgcgaaaattgtctttaaggagttcccgacgatattccctgattcacgtgttgtactagcaattgcagttgtataaccaataagatcatttagctctaccccgaatgtagaagcagttgaaccagctttacggatagaattggccagatctagagttgtaacagcatagttattatcaacctcatttaatttatctgcaattgatattgaatcatttgctgcaatattaaagttgagcattgctgccgttagagtgttaactgtatcatcgggagttaaatcagagacattttgaagaacttgggcagttttcgttaacgtggagagctcactttcatcgaaacccattctcccaaaatcgcctgtcatttgaagaatatctgtgattttatttgaaagtgtatcacctaagtcaatagattcttggagaagttcattatatttataatccggctcattcataacacggcgaatatttgtcatgagagtatcaatttctattgcctgggataccatttctttaagtccagagatagctccgtagaataaagaaccggagattaaataggtggacatgcttttgaaggtttgggttagttctgctccaaaagaagaggcttgattagcagctgtttgagcgttggaggctaattctctaaattgcatattcaagctttgaatttgtgatctgatattattgcttccagtgcttacattaagactatttactgcattcaaataatcttgaacagcttgtctattactagagcccatagaactgccataccgtgtatttaggttttgaacatttacttgtgcctgtcgctgatataattcaatggttttctttaattcattgttcttcgcaactgccgcagatttatcatctaacatccttatcctattttgcagtgcttcaatttgttgagcggattgagctgtgtttatttttcggccaagagatgagatggtcgtatcagtaacaataccttgctgtctaagcttctctaaatcttgcttaagctgctcaattgctctcctttgttggtcataattagttgtagtttttgaggaggtcgaattagttttaggatcagttgtataaacaatatcatcgaacccgtggcggtttttctgcactacctttgttggctgtccttgcagatttctctgcacagtctttttttgaacctgtcctagtttctcagtggcctgtgttagcttgttaacctcttgagtttcttgctttaatgctgtattacgattgttgattatttttgtttcacgttgaagtatctcaccatttttcttatactgctgggtgagcttttcaactgatccgtcagcattcttaattactgttgaggtttctttaactgtttgattataggattttaggtttttctgatatgtgtcgatagcagaggagaattcttgcagagcttttaaggttgtagaatcaatgtttgtattgagcttgagggagttgagtttcttttccagggatttaatttgctgatttaactgttcgacagttttggatgaggtatcagcttgcggggttagtataattttgaggttttgactcaagtaagaatcacttcctttcagtaggggagaggacaaagaaaaaagccactcagttattgagcgactttgtttgctttcttaataattacatccataacaccatgccaatattctgcattcgtaagtgcttgttgaatgacattgctatcttttttatacccctgaatattatacccttcaacttcttgtgtggggagaaaatcgatataatggataggcttaccgaggtcttcaacagtaatctttagcgtgacagatttgaccatttcattttgtattgaagaggcagacaaccctccaattgcagctccaattcctccagctaacaggccaccagctacgattcctgattttgatactttagaaattatttgattgtctaaagcaatttcggattctataacattggaaaaagggattgtgtattcttcaatatgttcatctttattaagctgatatattttcacaagggaatcagattccttaaatgcaattttagttttgtaagtattaaagaaattgtctggattaaaaccaccgtcgaagtgcttaagtgtttccgcattttcttttagtttatctatatttttttgggctttaattttatagggctcaagtgctaatagggctaaacctacaattattaagcaaattcccatgcctctccagccgtccattagcaaaaagaaaagacagaataaaaaatagccaccataagccataaacttatatcccattcaaccaccgccggtatcattttcctacattataccattgtttccagtcatggagaactgtataaatggaaagtgaaatcattagttcttttctgattttatctgaatgagcagttctttgagataatctgcagttgtagcattttctttatcttttataatattacgaagtgtccataagcaaattatgattgtgattaatacgtaaattaatgcattcaatcggtttccctcagtaatttttgatatattcacaccaaataatacttgaaatcctataaacgatgttcccaaaatcaaacttccaatcccccaagttttagatggatcatattgcgattttattccttccatccttgcaatggcagatgataattcagacgggcttaaagattttattatttggactttccttgcatgtgtatgataatcttgtccattaataggaaattcatgcttgataaactttattaattctttaggattcatttcagccagattgtgctttaatacttttttattgaacattttcatcacctctccatattatcgacaaatacgcaaaggattttaatggaaattaggtttctgagagtacgtttctctaattttcaaaatgaatgaatagtcctttttaagatttatacacagtcattctccaaggaaaaatgactcaatttttcgattttttatgtaaatcaaaaaagaatcatgttagagtaggtgtgctgaaataattcaaaaaattattttgcaatatgattaaagtaatattgccagagagttcgggttggacaaaattgtaagtatttaatacactggggctgcaatcaaatatgcacctggaatcaattgctaaacgggggagtttaaatgaacaacaagaaaaatatctttgatattgtaatgtacattattttcggtgtgttaagtctttttctagttgcaaaaactgattatggcactggagttttagtgtttgttgcaattttatacctcgctgtaattgcttataaaattaagcaagtatttagtaattcagattcttaaggtgtaacacaaggaggatttcaattgagaaagaaaagagttattacttgtgttatggctgcatcattgactttaggctcacttttacctgcaggttacgctactgcaaaggaggactctaagacaaccccttcttacgaagaactagctctacattacaaaatgaaaagtgaaaagatttcatcgaacgggaaattagttgaaattgagtatgtgagtggaaatgaaactcacaaagttcagatgaacggaaatgatcatactgtaaaagtcgatggcatagaacaaaaaggcttaaactttgagtatgatgaaaatgctgctaacagaacaaattatgaaaacaataatttgaaatcaaatgaattcacaacacaggctgcaaaacctaaaaagggataccattatgtggggactttatctgggcatacaaaagcagctaaaaatgcgttatcagttacaatgtcattagtcggtattgtccctggcttgggatgggggagtaaggctgccactattttattctcttattgggcaaaagaacaaatccctgatgcgtattataaatatgatttatacgaaaaaggagcaatgactgatagttggtatcagtatgctacagttcaattttttgaagataaagcccataaaaagaaaatgggcaaaccgtggactagtactcctgcaaaagtagatttacctaatagctaattttaaaatcactttgtctttatcgggggacaaagtgattctttgttttatacataagcaaaatccctcaaacgaggaatcttgattctgaataaaagagggattttatgctgaattgaatagaatttctctaatggttaacactaagctcaaattatcaattggaggagatatcgtgaaagtaatccatggaatcagagtatatgaaaaaggagaaaaagtcttttttgaaactgaaatgccatccattccagaatacatgtattctaaattcgggtggaaaattatcgaaatagatggtaagaactattgggccccgatggaggaggaagaatatatacatattgttgcaaaatatttagggatttcaccgagtgaagttgatttaaacttagttcattgtggaacgatgggggacaatggttgttttggagattgtaccggaaatagattttgtaaaaggtggagtactggagattcaacaggatgtatttgtggtgcttaaaactaaacaaatatttgatttttttcttcttcaaaatcccgtaaatcataatgtttgattgttgttgagacatcttcatgatgagctacatatttgcttatcaattcaattttgactttcttaacttctaggagataagtgatgcacgaagctttaaagaggtgggggtttatacgtcgaccaaggatgtctgataacacatcagagcaaaaataatcagcccaagactctgacatctgtttaggctctccgccatactgagtagtgaagaggtattcatgatcatagccacgtttttcatgccataagcgaagatactccagtgcttctgtgttaatcatgtactcaagaggttttccttcacctttaccttttccaaataccttatgactcatcacgtatgactgaccctctggaacagggtaatctaatatttctgtttttaactgtatgagttctgctcttcgcccgccaacattaaaggcagtagcaagccatgccatccccaaataattttcgtcctcttttagggcgtccatcatcagtttataatcatcatatgtaactttaactttttcataggtagtggttttaggaatagctggaagcccgcgggtgaaatttctgaatttctcataattatgatcatcttctgcaacaacattttcgatataattatttaacgatgatacaccggctttttttaaagcaatcccacttgaagacatcccacgattctttaagaaactttgatacctaatgaaatcacgctttgagatcttataaagttttttcccgttaagagaggtatgtacccaccaaaagaattggcgaagggaggagtaatactgctttcgtgttttatctctaaatgaatgagcatctaaaaactcttgaaccaagtttctgtgctcttcatctacttgctcccacattgattccgtgacctcggggagttttattgctcgagatctgagcatattcttttcaattggtttggtcattaattcaccaccattagtctgttttaataccatctgcttttaaatcttttttagcgctgcggttaatcgtccatctcttaaggtctcagaggtattcttcataaaaggacgagggttaccgtatccatatccatatgaatcagggtatgtatacccctgcccggtttcaataactgtagcaatgtcttttccatcatcttctctaatattgtccaatgacaccccgttgctttcgttggtggttataaaggcatctttaacttgtcctgtgcgttcataaagtaggggatcatatgcaccgtaaacatcttcaacaatatgctcttgtcctgtttttaccataatttgtttcacattagaggaagacttatgaattgattgaattgcagcttgttcaaccatagctttgatatctttaattgttttcgccactaacttcaccagaaccagtctctatttcttctaccttttctagaataagcttgttgatttcctggtggctcatagttaacaagtcttcagtgattttttctaaagcttttgttgcatccttaagcttcttcatactttcttttggaaaactgttaataatcatagggaagaattcggaatctacaagcttaaggtaccatttaactttatttttgatgtcattcggaatccccaaatctgaaaattctttgacaattgaaaagaatacccattgaacagtgttgattttactaaaatcaatacctttatcttcagctttttgttgatcagagatcatttcagttagcatttttgttaaccgagaaggagaaaagtatgggtagatgaatacatgtacatcatcggttaattggactttttctttcttgtcatacttattgacactttcctcaattaaacttaaattcaatttttttgatgccatttaatatcctccttaatatcctcattttgagcaaacaatgataacgtgtttattctgtagataaggtaactgaagtataggcttccccaacaatttcttgatattgttcaggagtaattaagttattgtctactccttctttgagttcttccttagttacatcatcgtaataataagcttctttaacctgatcaagagttgcccagtttttgtttagggctataacccaaaaattgctcatgctgttgtcccatctttcaagtttttaacttcattttgtaaatttaagattatgcgattttgttttaaaattaaaattctggcttcagctagtgattgtccaagtaattccacatcagaaggttcttcagggggcggtgagaggctgtctatatattcttgagaggctgtttctatccaaacttgttttgataaatcaaatcgtggaaggtaataggagggagagtcaggtaatggaacagaagtgcaattatcgggaaaaatataatctcccttttcatcgatttcagttacaactaggggttcaacgaacataaaattttcgtcatatttatagacttgtatcacgacttacctcctaattcaacggaacaactacatctatgtagtaacccgttattgcagcactgttgtcagctgataccccacttagctgaaggtcaccattagagtttacaaataatttacttctgccgaaagttccactcacttcaacagacttaacagcaccttgtgttggagaaaattcagttggaatagaagcaaatactacatctcggtttgttacaacgtgcccactaagctgcaaagtcccagctactttacgatattgaagtggccttgagcctgtctttgcgccatttttatatgtaacgcttaaccaaggcacgttatcaatttcactgctacttatcaatcgttcccaacttgaccatgctccgtttatcaatgattttctgtaagtcttattatcattagtcagaacaatagcttgaccataaagtttatcagcactacatgtccaaaatccccgcccgttacttggaggtgcttctaaggcagccttatcatatccgaaatatgttaaagtaggagaattcaaaagttcagaatgaaagtcgcttgttatagaaactagtggttgaccatcatcgcttgatattttagttaattgagcagaattccatttacttctttcagtgctagtgatatgacgctcattatcttttatgtgagcatcaaattctaattttgtcgcttgtttatcattcgtaaggtttcctaacccgacctgaattgcagttactttatgaggattgtttgtgttctgagaatgtgcgtcagtatactttttagaattgctttccgcggcattccaagtagttctctctgaagctgtaatatgaataattgtatcttgagcatgttgatcaaattcagttttagttgcttgtttttcattcaggacatttgctaaaccaacttggcttttagttactgaatggggattgagagtatcgtttagatgttcgtcaaattcctctttagttgcttggacattatttaaaacattgcccaaaccaacctgctctttggtgactaaatgaggattagacttatcatcagtatgtttcttgagctcattctgttgatattccataaacaaatttgttttttctgttaatgcttgttcatgctcaagcatatgtttttcagctctgtcattggatcctcttaatgaattgatctgaatattgttttgtttgagttgaccgacgtatttactgctgctcatcttaactcaccacaatccctttaacagttacatcaccagtaacagaaactacttcgaacataactttaaacaatccagcaatgtcgaagtcccaatactcattagtatttaaagtactgctcccaagttggaagtctgttttattggtgccactaagtgcagttttttcgccattttcatcaactgcataaaactttatttctcgtgaagttgaggaaccagagatcttaacagtaagttcccgaaaatgacccactacaaattcttcaccttcagatggggaagttgcggcttcgtgaaatgtaaatgaagttttgtctggaatcgtgattacgacattttcagtcgtttctgtcaacaactccacctccttaatttgaataaaaactgtcttttatctagaaaaacaagaggggaggacttattcaaaaagcccatcctcttgtagcttattccatataccttcccaagctggggtagaggaaggggatgactgaagcgaacttaaaggttcgtactcattgaagtcgccttcaaagcgttgcttgaaatcatcaacactgatataggatccatctgatagtaataggaatttttgttccaaaccatcaaattgtttgaacagaccacatacttcatcaaatgtcattattccatcccccaaacaacgatttttaacccagttagatcaactgtaccggctgctttaactgtcagatgtatttttggagcagtgaaagttaattgtttttgtaaagggtaattctgaacaaaaacaatgctgttgaatagaacagaattatcattacctgatgtagttgcagaataaaatgggatgtttttcggtacggaataaatacttgctaaaactttgctgtttgagctgtctgtttgagttgtgtacatagcaacaccgtaagttctgaaaacaccaagtgaatcgattagatcaactgtataagacttagttgcacctgtagctacggtatcagcatcagtaacaacaaattcagaataggatttttgaacttgggttttaattgctgcagtgtttttaaccaaaacagggacagaagccgtattagttatatttacatcaagtgcagtgttggccacattaacattaagaggctggtcattattgagaccaacctccaaggggacagtggaacgttcaattgatacagctgttatgggattacctgtcccatcatcttttgcagaggtgtatttatcaccgtcctggtttaaaaaagcaataataaacgcctccttaattattcagttgttccgccaagatctgagctttgagatgagccagttccttcatcactagtgacaacgccctttgtcccatcagctttacgttttacacgagcaaagttaccgatttttccgttattatcagcaagggctcgatagccgatttccggagtgtatgcatttcctgcttcaaacgacatatctgcttcaccagagaagtttactttagggagctgaatataaaggtcactgtagatttttgaagtcttaggatcgtattcaattgtgtgaatttcaaagtagtaattctcagagaatttttcaccgttaatttcaacagtctcggcttcaacttcaatttgataatgaactgctaaagcttcacccttggttgcaaaggtatcaggcacagtaactgttttagatgcagcgtcaacttcaatttgatctccatcttcgttagttaatgaaactttagacaatgggagatatgaaaggataaccgtaccagtatcactaactgttaagctttcatcttcccacacagaaattgtttcgttttcaatttttacaccttgctgcattgccatgaaatcaagatcaaagaaagcatttcggacattacccgatacttctttacttgaattaataacatacaggtctcggttaccccatccgccttttaaaaagtcttgttgaacttgttgggaaaactgagtcatttgtgtaacacctgaagcaataaccttattatcgctcagacgtttagctgtaatttttccaacttcatggattactgtttgttttgccaaattgtttcctcctaaataaaaataaaaagagactaaagttaattagcctccaaataattgctcgatatttttagcatctttagtgctcaggtgataagactcttccttgtaaagattaatgtgactactccaatcacttactttgacatcaggagagacggtagcaaaaagtgtggttgtgttataattcataacttcagccatcctgtagaacgacaaatatagttgatacatcgtcatttcagatatttcttcatacgtgtatccgttaaatgcagcaacacagcttactatatcctttaaatcactttgagaatcttgttgcttgagtgatttacttatatcatggaactcctgaagttcatcattgtcaacgaccttgtcttcagtgatacaatgcatgtctagtattagttttcggagacggggaaaattatgttttccaatcaacgatagggaatccttgtttatcaatacttttgaaaaaactttgaaataagcctcgtgaaaatcagggagtaccgaatgtacaatttcataaagatctctctttttcatttcaataataaatgggtcaagcgagccatcctcattaaaccttgaatattctttaataagacttttcttattcatcctcaacatgcttagttctttggtgtagagaggataatcttttaagcggatgaaatcaatctctcctatttcagtctggatcggttttcctaagaaaaagaaatcctttaactcattcatttacttgctccaaaagtaaagatcatcttgtagcccaaatatccgtcagggggattactaataagcaaacgtttataatctactgttacaccaaaaccagcaatatttttattgaaaaataattttgaaaccctgtcgatgattttcaaacttcgatactcagatatctcaaatgtattaatgtgtgtgtatacatcgatcatcaattcttgatttaacaacataaagctttggtttgtcggcttaggcaatgcattccctaaataaatacacatcctacataatggtgaatccgatagatcatctgttttaggtgctcgcttgaatatggtattgattatagcgggagagtcatttgtggagtcataataattttcgagtgattgaacatctggatgagaaggggagagaggatcagttttgtaatacaagagccgattcagttcaacatcatccataactaatctgaagacttttgtcatctgttcaacagtcatgctcatgtcttttcaccaactttctttttggcaaccaattttattgttccgtggtctccataaactttagaatagtctatatcatcgacttgataatcttcgccaaagaaggtgagggtaagtccgattttcaatttttcatgaacaagataaggaattgtaatgtttgcttgaccatcaggaagatttaccgccaattcagtgccatttattgaagttgtcctttcgaatatgcaggggacttcagttttttcgccaggtactttttcataaattggcttaccagtgatttcgttaattttgccagtatcgattagcttgtcttctgaagtaagaaaaaatgatgttccacatatttttatctcagcctttttgtaaatcttattactgagagggtgggaggtgatgagccatgtttcatcattaaacttaacaactccgccacgataaatgtcagcaatttcacctaatatatatcttgcagaaccatcgccactagagtacttagaagtgatcattactgttttttcgattccatcaattgtgactttttcagattcaaaccccttaaggccttgttggaaaataagcttaccatcatgaagaagtttattattaatgttaaccttgtggtaattactgtagtccttcattcgaatcaccgtctgttactaagttatccctaagtctgcttaattcaccacttactgttaaaatagtgtccctgatttctgtgagttcaggatcacttagcagctttttattaaggtatttctccaatttgaagaggactgaattgtttcttttacacagtttattgcaaacaacatctaagtcctcaagctttatttgtccatctttatgtgccgatttaactttaattgtactcatagataatccaccgcagcgttcaatatcaagcgctcaatttcgtctttctgatccattacactttgtttaagtgaattgagttgcgtaccaaagttcttgatccccacgtcattcgtgaagggctgccacgtattctcaaacaaggtctttttatttaacaaaaagatgtatctcaagaagtgtgcaagaataagaagatcatcctcagataattctcgattaacagtttcagttgaattatcagcttttaaattgtctctaagccggttattgaaatgaaggattgcatttcgaattgatttataaatgtcctcttcttgttgaggaacatcaaaatcggacgtctcgcagttgtttaaaaaggtttcccatatttgatcataagatgtcataaaaatccctcctcttagtcaaagagaagggaaggatcagcgactcccatccaatcagccaaaacttttaatttgcctgcagcaatgtcatcactaaattctgaagcaacgtcaataataaattgcttctcagaatccactgtgattttatcgagcttattttttagttgagcaatatttcccgatttaatcatcttttcaatttcttctttggtatgaatgttattttcataagcctccgactcaacaatagaatctttaatctctttggttgtctcgttatcttcaacaataactaattcacctttatcgaaacaaacgctgttcattgtgagccattcaacaacttcttttggaacttctttaatatcagccttcccatttttactaccagaccaagtgtattgtttatgtccaccatcgccggtatacccaacaaaataagacgtacttctgtatcgtgctaacttaattttttcagtcaaatttacatcctcctaaaaaatcctcatattttgatttagatagatactgcagcttgttcttcaataattccgattgcttctccaaaaagaaggttaacagaagcatcttgaacaattttcattttgattctttcatcttcgatatcttgttctgtcaattgacgcagtccgccatactcaacaacagaaaatggtttttgagaaacgccgccggcaaacatataacctttgttgacaggaagttcgactttactatttgtatcatctgtaaatgggttagtgaggttaacagcagttgttcttccgatagttgttggatttagagcagtaaggagctctccttttacttcttctgttaagaagttcttaaacgtagagtctgttccttgttggaatgcgaagtagtcaatgagaagagtgtcagcgacgaagattggttttccaccataacgttgaagcacggaagctactttgttgtattgttgaagagtaaggtttgagcctgtttgaacattttttgcagggattttaccagctgtaattgcgcttgcagttaattgatgaattttatcgaggtacaaacggactttagcatctgcgatatcattcaccaatttattgaagtaaacaattgaatctgttacgagatctaggggttcataatagaaacctgttgacatagttttcggaacagcaggaactgtttcttgtccttcaacacgaactaaatcaacaccagagcctgtagcagaccaaatgacttttgctttattcttttttggaattttaatttctttaatattgcctcgtttttcttgttggacattggccagaagggagaggagctgtgttacttttggtttcgcaatttcatcagcttgttcaacgacaaggttattaaattgatggagcatggaagggtcaggtgtagtaccgccatcaccaaacactttcttaatgtaagtttggatatcagctttgtctgtaccgtccattttgttatttaatacacggctaaacaagcctttgattttcacagtatctaatttcatttaaaatactccttttattgaaatttatttgttatgtattaggcctcgattacttcaaggcgaacaagtttttgtcccattgtgtaaacaaggtcatcttcattatttacaactaggaacttagcagaagaatcagcataatcctcatgaggtgaagtaggatcactaagaatatacttttgagtagcaatatcaaagtgagccacttgaccttgtttaacctcagtcactcctgtattaaatgaaaatgcagaaacatcaaaacgagtataagctggctcaaggataacaattcgagcatgttctcctacaccgttataaaaatctctcattgattcaccaaggtagcgtgcttcaggagatgcaattaaatatgctttttttgttttatctgatagtttcgaagctgtacggttcccctcagcatcaaaaccaagttcaacaagcataaagttatcaatgtctgaaccagtcacttttgcaccgtgagcaactgttttgatttttaaagaattcaagtttccagtagtatgattacctacttcagtaagggctttttgtaatcttgtagccatattttattcctccaagtttaaaatttattgtgaaaagcgtgattcaaaagagtcatcgttagggattaaattttcccgtttacttgaaaattctctaatggttgtatttgtttcagtaggaacactaactaaatcaactaacattgtgttaagttgtaatacagctttttctccttcttcatcttgtttaaccgaagcatggataaggttttgtacttcttctgtactgaatttttcctcagcatttaaagcttcaaatttcgctttatagaattcatttttctcacttagtttttgctctaataaagttttctcgtgtttttctttataaggcttcaattgttccacttcagaatttaattgcacaagcttttcactggcagtgttgaattgctgttcaattcctaccttatccttattgatttgatttacttgtttcgttaaatctttaatttgttcatctttctggttaagttgtgattgaataggctcaggaacaacttcctcccagttgcgcgtcatgaatacctcagttttactgtcaaaatcaattgaaacagtatcgcctgttcttgtgtaattgaacttaaagtatttgtcatagctattttcatctgaccagctatacacgtttacgatgaaatacgtatcatatacatctgcaataaatgaatctgattctttatcaagggttggatctaattggctatatagaagcgtccgaacgtcagagtgagacaattcaaacacttttctaaacttattcattttttcaccttcctcattattttgtcttgtagctgcttgagccactaatctttcaaatcgttgaagttcattaaagcttagaagtttggaagaatcataggcggggaggacaatgtcatgctctccacgtttctctgaatttaaaattgcatgaccttcgaaatagatgggggactgtaggtgttcgataccatcttgcacagtgtaatttgaataaaggatctcacaacttgtattaatgttgatgcctctaccataccattcaagtaaaagttcacatgcatctttaaatcgagagctccaaagtattgcatctgctgccaatacttcttttttgccatctggggtttcaatttcagttatgtatccctcggatgtaaagacaccgattggggcagtatctctttttacttcaagttctccgtgcttatctgtgtctagataagcttcatgagttcccaatgcatctgtagaagtatttaattcatcaacctcgtaatattttgcaacaatcggtttattaataattgttgaagcagcttcaagagcaacatccttagaaattactgtattattgtgagagacatcgaaatcaaaaatgacaaagctacatgacaactttgttgggtcatctgatgttttaatctcattcaattgaagttggcatagttttttcttttgcttctttgtcaaataatttcacctcccttcaaaagtgaagttttaaataggattgtcattaccgttggatgtagctgacttcactgtgttgtcgttgtttttattaccttcatttgggcggccaacttcattcccagtgaaggtatatgaagtttgataaggtctaattttttcttggagtttcagctcttcagtttcatatagagtttgttcaaggtaactttcccaagacactcctgccaaattgtcaactacgtgcttaatagaccagcccttatcgtttaatttaattaagatgtccattttttctttaagagtgagcggcttgtctttatcgtaattcatatagtaattgtctttttgggcagcaggcaaaacaaggttgaataacttttgataaacctcttgttcaatatcctccattaaaacgccaatacgcttataaaatgtatccaagtttaatgacgaagttgcgtagttaccgccatcaccatttaaaagagagccggataatccgtaagcagattgaatgtcgctattgatatgatcaaattttgctccatctaatccatctgctttaacatctggaaaattgatatcagcaaagtcagggattgatactacagtcactccatctttttggtttttttccaaagccgttttaacgccaccatgaattttttgtttaactgctttaggcagcttcatgtttgtgtattcgccattacctttatctgttccaatcgttagaactgcaacagcgttaataattttatttgcaatcgatctttcaacatctttaagtttctttttatggagaacgtcatatagacctggtgtaacccaagatgttcccaatccttgatttctttttagcgtccctgtgcgtagtggaaaagttctttcttgtggcaattccttaaaccgatatttctctcgatctttcatgaagttttcataatcgctttgtttaatataaggggagaggctttttaacaattcgtttctttgatcatctttatacttagtgaacagctccatgtcaactacacatacccagtctccgtttcttctaaaggaggggaatacatatttaatttcatcaaaaataaacggatacgggctcttagcatccccaagccatataccaacaagagtaccagctgtagctacctgttttaacagatccctagtaagtcttttgtgcttaaccttatgtaaggatttattcaaaagggaaatatgcttatctgaagacttaactttattaaaggagtcaattttatagttgagggtagggagggcttcaatcaattcaaacaattggtgaatctcagcagtcgaaatgtaaaaatactgagcaagatcttcaatttcttcttgaaattcatcggggttagaaaagtaattctttaattgttcggcctcaatttccgtaacaatgccattggaaaacatatttgagataaagccggaagcaaatgtagaagtataagttgaatagtcattcagcatttgcttatactcttcagactcaatgtcaactttatttaaggttaccatgtttcacctcatttcttttaaaaatagactaattcatcttcaacgtcatattcagtttgtttgtttaactgtctttctaatacagtagcaatatagttgccataagccactgagctatatctgtcttttcgtttactctttggctctttaagcttaacttgtccgttatcgctatattcagcttctaagttgatcatttcatttattagaagggtaatctgagcatagcttgaaaggaattttcctttaacttcaggagatagcccttcatagcctttaaatcttttcaggtattcttttccttcattttcgttgataggaattttgatttttcctcgtttgaatccatcttttagtaataccgcaatttcgctgttcaattgtgcattacctttaatgctataaattactttttcagcattttgataagtacaacgcgcagccattctttcatcgttaatacatgaaaatggctcatattcttttgcacgttctttatcatataaaggctggcataatgcatcatacacaccaagtccgatactttgagtatctaatacaatataatcgcaatcataatcttcgtatatttgtctaattcttgttgcttgagttcctgtgtgaccacctacgatgctctccatgtatacaatatgacgatcatatccattggagtttggaatcagtctgaatacagtgtaaacactggcatcattatccttaccggccattccagcgatatcattgcttaccagtctaatttctcctggtttcttgccttcatatttgaagttggaatccttgattagactgtaatagtcaggagggaagaggggagaagcaagcttgcggttcttttcaatgtcttcgaatttaaaataggctttttcagattcaccaaaccagagagcttccatttccatagaccaaccgataggatcaaagtcttcttcggccatttcatctctaacctgatctttatccaaaagaccttctttaattgcgatctgataagggagaccacacacaaaatattttgatcctttcatcatggcattgtagtaagttatgaatctgttaaatgaccaatgaaccttgtaccagcaggaagacaagtaaatttctttgtttcgttcttttaagtgagcgtattcttctttttcgagatatttaggagaacggggagctgtcaggaattttcgaagtactttactgatgatttcaaaatcaaccattctgaattcatctacaataaggaggtttgcacgcttggagcgggcgccatcatttgaggctacgattttaatccagctgccattatgaaactccactttagcatcatttgttgaggtttttaaatcttcaatttctcgccttaaattaggtgattctttgcgtaagtcatcaattttctctatgacttcacgagcttgtccctttgtgcccgatgcgataactattttagtacctgggaagagtatggcttgcacacagcagtatacagaggttagccaagttttaccctgcccacgactggccaggtacataaaataatggttatgtaccatcatgtaaattaaaatacattgaaacaatttaagtgtaatacccaagtattcttttacaaaacgatgtgggtttgctctatagaaagaagtccatgcgccgataccatccattaatctttcagattttgatttctttttaaagttgtttccctttttaaaaatattgattcctcgactgtgcttgttgcgatctgttgtaaaatttttatgtgaggtcattttctcgatcctcttcttctgcaacaggttcttcaacagtatgcttattcatttcttcccaatattcctctgaatattgatttttcaaaccaagcattcgagacagatgcccaaggaaaaataccttaatgtatttcccgattttatcaggatctttccatctaggctctggctcaggaataggtctctcattctcatattttttgatcagagtgccaaaagactcttgttcaactccacttgctccagtttcttgaacgggttttaaattacttgacccaagtaaatcttgaagagttttttgctgctgatcgactttttcaccattttcacgccgtttgcgtatatctagccgagtcaaacatatttcatttataagaagttccattcccttagagtcgcattcatacctattcgtgaagtcaatgtactcattctgaagccaaatataatcttcaacatcaagaccacgaccccagaattgcattaattcatctatgtcttccttagatatatcttctgtacttttagctagtaacaattgtgttgtatattcttgttcttcttcaaagtcaaactcactgtctgcccaagtttttgacttgtaatctttcattccgatatttttcatataagtacctaacacatttccagctgattttttcttggactctgattcattaacagcggaaacccacaagtcgtaaacaaaaggacggtcaatcattcttaagatgttttgaacattctttaagttatctttgtctttttggaattcattttggagacagctcttacatactgacagtttgcctgttgcagaattgaaaggagattccgatatataatattgattggcattttgttctttgccgcagcatgagcattttattttttcagcagacatatttcacctccataaagtttatgtaaacacattttacgaaacgcccagcaatagagcggaaggggagtaccgcaatcttcgctgggcgttctaaaaaggtgcttaactataggtcaaatcaccactgggagacatttcgatatcttgtgtttttaacttttcaatcaccatgtccattaaccctttaccaattccacatgtatcaatcaacagtttgtcagggcgtttttcttttaaaatctgaaccaataggtctgcttgatatccgaatgtctgagaagctattcttcttttaatattttcaaatttggagtctttaacattaacaagtaaaactgttgtacaatctgtccggggatcaacgattaacaacctatttccttttggagaatctacgcctattttataatcagcaatgttttcgttttcaacattgctacctaaagtgtaaaaattaacttttgattttgatgcaagtcccattagtttatgtaatttactaataacagtagatatctctttatcacatttgtatccagactgcttgagttgggcaagtgtttctaagtgcttattcagatatttaaagtcttcattcgtcattttcttcttcatcctcaatcgtttttttgtattactttaataaacctttttgcagtcaaccattaatgcgactccaatctaaataaaattaaagttttatcaaaaaaagattaatagtttaactttaggtttaaaaatccactattggatgttgacatctgataaaaaagtggattacactatttatgtattacgatatctaaaggggagatcacgttatggaaaacaaagttacattatcagatcttgtacgtaaaaatataccagtgattttaaagggttcaaaacaccctcttacagaaaaagagctgcttgaagaactagcaaaaaagatacctgaacttgttaagaatggtgaatatagaaatggagttcttcgaggtgtattaaataaattatctacacagccagttgatcgattaggaatttcacgtgagggtaatcgagttaagtattatttcattacagataaaaaaactgagcttcaaaatgttattagaaatctcatcagtgagattaaagaaaaggaattattgacagttgattacttgaatgattcgcctgaaacaattgactttataaaagatgtatctactcacgttaaagacttagagggatttacaagataaacctaattaaagaaggcctaataggagccttctttaatttaatatgtaatcgtattgaataatccgacctttaccggactcataaattgaaaggtttgctccagctttggcacctgtcattaagctgtcactgtattcatcggaacccattacagaagggagttgtataacttggatattatgagtggctgcttcacctacagtgagcatgtttccgtggtggaagtgggagatgtacatgtaatcgtagaattttcgtttcatctgtgagatgtcacgaatggcattctttttgtttttaatctggtgtccgtgacatgcgacaatttcaaattcaagtaatttaaaatccacaattccttcgtcgtataaaggaacttcaattcgctcattgtctttgagtacgtcatggatataagtagctataatacgctctacatcttctttaggcatttccgagcgatttgtattatgtaatcttagttcagtatgatttgcagaagggatatgtatgtacttaattttgacgtgcttagaaagttctaaaagccattcagctttgtacctagagtattttatcacttggtcaataaacccgtactgaagggcagttaattgcgatacgcgcaatgccataccttcaacactgtcagcaccatttaacacgaccagctcatctaaattttctttttgaatgtactcaacagtttcagaaagaatctgattcatacgctgcaaataaatctgttcgttgtattcattgttgttgcttttaaattgcttcccgaagtgttcatctccaaaccctagaacagcagctctttttctttcgttcttatttaatggatagaaggaagggggagggagagtacctactttctcaattgcttcagttacattttcatatagcagctctgttcggcctttgacgcgtgtgtttttatgtatttcatgctttacagcttgaagcttttttctctcttccatgatttcaacctttttcagttccaattcaaggagagaattatttgattcatctgacctttctcgttggtattcaactccttcaatgaagttgttgaaccattttctataagctgattcacctttagattcaccagtttccttgttgattaactctttgatttcttcccagtttagattataaatgtctttattagagcagattcttattttccattctttaaggttttcatctgagtgacgcttagtttgaacaggatcgatcattcagtcagtcatctccttactcaacgcctttaacaggaagttcattttcttcttttacagtaattgaaacattttttccattaaactctgaaagaatttctttgaaatcatatgtgtattcagcttctttagtttgttcagtaacttccattacgtccatatcaaaaaagcctttaacattaatttgatgtacttttttgcttgccatttaaattcctccaataattttctatttacgtacaataagctccttcggaagcccgatgatccgaagcatcggtaacgtccgagaaggggatataaaggagatgaaagataagtcggataggcgttggggaaacgcccgaaggagattattgataacttgcgtaccggaaggctcgtaaacacattccggctgatcagtaaaacgcaagcacaaaaaggccttctaacgatttagatgaccttgttctgattacattctaaccccgtttcacctacgtcattagctcacgttgggacgcaagccttcagatcgacagggattacgctgattacgggttcagcgactgaaacctttgcagttgacaaactataagtaagtcgaaatatcaaaagacgccaaaataacgtcttcaggaactccttgtacatcatggtacatgagcatataaaccggtaatcgctgtgcgaaaactgattctccttctgcacatggcagatgagctaattcatttaagaactgtgtaaaatctctgaattcacagtgaagccttgattagtagcggcaatggaaggaatcccaaagctggacgtatcgcggtatctttagtgtcccccacgcgggattaatcggctactctcgatcagacaatgaaatactaactctaaacctcgacacattatggtggcgaaacaccaataatgagaaggaaagacccattataagccttctcaatggcgttttcagtctctcttgtcaggttacacgccttattgagaaacaaagcgtctcaaactctcgccatttattttgcacagttttctctgacccgtgtaaggaggtatgtgcatgggaaaggtaagtttcttgaaggaaaagtagcgaatatgttactaagtgaaaggaaaaggcaagaccgaaaataatccttttctgtgaaatgacagcggtgatcaagcgcccaaaaccatatcacttattttacgagggtatgtaatttcaaagcctcgtttacccggaaaaattttgttgaccgcataataagcatcgaagcttacaagggcattatttaaagggaagggagacgcatctacattccctaagtgtaagccgaagcagtacaccgcaattaatattcagggatacatgtcacccatagtaagactgtgatgggattcaccctacataaaaaacttgagtagcaaaggtcttaccgacatgtttagcccgataatagccatttatctgtctcctgaagatacagacatccgagttaacctcgcaccctcataaatgactattatccgactaactgcaatgaccagccgcagttttgtgtcagaatgatacagaaaagaagggagtagatattgtttaatcgagaaaagctagttcacactggagaggaatctccactaatattcatttagattagtctttaccttcataaatgaacattagtcgagaactgatatcccaaatatcagtaatcaactaattattgacggcacccccatgccataaataaataactataattaattaacccggagttgaagatgaaaagcgaaaagaggggaggtcgacaatttcctccataacttccaactctgccacttttaggagcataagctctttgtgacaaagcgtgcaggtagcctttcctgtcgtcctcattaactgattatttagctttgactgcgtctttaagtgcttttgctggcttaaatgcaggtgcttttgtagccggaatatcaatttcctctcctgtctggggatttctccctttacgagctgcgcgttcacgaacttcaaatgttccgaaaccaggaatacttactttttctccactttttaatgcctctgaaatagtgtcaaagactttttcgacactgggagctccttcttttttagataccccttgtttttctgccactttagcgattagttctgttttattcataatcaatttcctcctaagtattattaaatttattctaaatgaacaataaagattgtcttttatatagacgggggaaacgtactagcccttttatgtggaaattagctttctgtctcccttatgacgattatctccaaaagtgctctcaacccagtagcaccaagggataaagacacttttttgttgaagtttttttcggtaaaatcgctgtacaccttgggggagtaaggctcaaggcactttctaacggtggttaattctctttttgttatattttttgtatttgtcacgttcttttttctttccacaagactgacagtacttcgctttgttagatgttggcttaaaagcttttccacaaatacagcatcctttaaaggtctttaaattatgcttaatgttctccagtacaatatcgccaaagcactcccacagtgtcgatttgtatttacttttttcttatatagatgttttaccaatacatctgtaataaatccgtcatcattatgtatttccaatagtttttgtttgataatcttatagacataaagtttttgtcctggtttagcttcttcatcattcataagccattttttatttcgatcaagacgtttatattcatttattacggcttcattaagtttaatctctttgtttttgagtaagaagcggtaatcaaattttcctgcaactgcagcaaagttgattcggtcagaagggataatggagtctaacttatttactgtactttcattaatcgattctacgctatgttcttctttatcctttgcattgatgaagaagtggggcactttattttttatgtaatctttgattttctcatcaacgtgatcagggcgggtgggcatgaataaggtttttgcaaaatcgatagtaaagttattctccatgcataaccatttgatcacgtccaggtttatattgtcactgttccatatcttagtgatgttgttactgtactccccgatattgattccataagcaagagttagtgcttcatagatgtttctgctattaatctcttgtttctgggctacagacatttcataatacaaaggaacgatgtccgccatattacgcttggcaatattgacgattagctcatcagaaataattaaggccttatccccgtcattgtcaaactgcagcagcttggatatcggatcatgaatgctggtataaacacctggggtaatgaaccacttttcatattcctcatttttcttgttccacctaacaccatgctctctgaataggtgaggggagcggaggatatcaatatacccttcatcatataaagaacaatggacatcgcttcctgaaagtagtccttttggactctcaattccaagaaacaatctttcacaaaaagcatataggtcaggacataaatatgtataccgggcgtcactgacaagtaattttcctgatttggcgtccttaatcatactcttcttcttattcttaatgatttctttggtgtgatcatcatttagcagctcaggatatattagtagagcttcttgaaggcttgtcttatgtttatttttctcggtagcccctaaaactttcatcattgtttctttatcagtgcctaattgagtaatctcactaacagtctttgagctgatttgtttcaattcctcatctgtgatatccgtgagtgtttgtagcatctggtaagtcagttttccctcaacagatggatcttcttcatttaatttagctcctaaacatccatactttttaaatttatagcgataatcatcccaagaatcatagtacttccacatcttaaactggcttttcgtaaaaattatttggatatcatctttaataatgtcccattctttaccgtagacgtctttaactataaatgaactgtgtttttcagcaaactttctaaagtcaaatggaacaagtagacccttaacccaaggtaatctgaccataaagcttttctgactcaaactagggagcatcattccacaaccatctgtatgttctataggaatatccataatcttacgtgtgatttcatatgtatcccggtcaatataatcaactaggctggaaacatttgtttctaagtcatttacgacaattgctttatcaatatcaatttcccatgaactgctggcgctattcgataaggccatgtagctattccatttgtttatgctgcttccaccttgagcattgatatgctccacactaagaccacaagttaaagcattttgatacttatctaaggtgctttgtttgataaaacaagatttttttgttcttatttgaccggcactgctagtgaaataaacgtatttctcattgttatgtatgaatcctttatcaataatgtcccttaaaatttgaaagtgataagtttggacaaccatgatctcttcagagagagagttttctttgattcccagcgttcgagttaagactgaatcaaataatgaaatcacattattatctttcagagaatctgttctaagtgttcttatttgattatgatcgttaaaggcgttataaagcttttcttttaaggaaataatcctttgcgttatgtacttcttatgttttttatcaacatgttcaagttttctgagatgatctctgtacctatatgattttaaaatcttgttatgtaatttgttttcttgatcattataaaaagcagaagtgtcaatactgtaaatatgtacttgtttatttaggccgtctttttttcctttcaataaattctccccttattacttttatgcatattttttgatttaataatcgctttttagatacttatgtacaagatttttatatgtatagctctttttatcgattgttccaaatagtttatagtcctcataaagagtgttttcttcttgtgaagcagttccttcaataatagcagtctctaaaaatccaattaaattactaaacatgtacgttactttctctgaatccttttgcattatctcacctcctcacttatggatttattatatacatattatttgtatttgtctattgttttttcgctagtgtgttaatagctccaggttaagaggtgaattctgaagcatttagagaaggggggattatcgtaatctaaaaacatgcttatcgtaaaaaatattaaagagtttaaaaagccagtaaacataaggagatttgctgtatcgaatggtgattaggggataaacgatcgtaaaacataagtgagagtaggggaaagtggttgctttatctaaatattgaagaaatcgagtaaatttgaagaggggaaaatgttgatatttaaggcttttacgatagcgattacgatgtgaaaaagggtgattttgaggtggaattaggaaaatgaaaatttggatagggtgtggaaatggaagtgctatgggtacatctgttcccttaattttaccattagatgtaaatatacccccatatattggtattgtaatgcgtgtataaggaacattatacgtgcatttaatgacttgggcaggtctgcaccaatgctatcataattccaggtcaaacacaagaattaatttttaaaaaataaattgtttttcaatttaaaaatgaataaccattcattaaaaataatcgtatttataacgaatccgagggaatcgaagacataatttattcttatccacttacattactatatcatatcttcatatataacccttgtatttactgaccatctcagccttgaaaggtagtcagcaacttgtctttaactaaggttctctttttcaaatcaacatctccttctgtaaacagtttgtttctacactgttaacaattaaagaaacctttagtttctcccgatatattttatgaaactttttgcttctttttgtttacgaaactatttgcttatataataattgtcaaagtgaggaacctactatgtttggagaacgtttaaaaaaatgccgtacctccaaaggatatagccagcaacggatggcggatttcttaggaattacgagacagggatatgggaaatatgaaattggtaaggctgaacctgatttaaaaacccttactaaattaagcaatatattaggagtatctactgactttcttctaaaaggcacacatgcacaatttgatctcgatgagatattaaatgatccagagactttaattgctggatataatggaatgatctcggaagagcaagctaaagagttactgtattatcttttaaaaaaagagttcgaagaacattagtagctattcttaattcttctggtaaaacatttgtttaataaaaagaaaacaaactgtttaacaccattaagttaaatgaaagaaaagaaaaataactggagtaaaaaggggaaatgaaattgtttaaaaaattggggattttactattaatcacttcactgatattgctcgcagcttgcaaaaatagtgaagagtcttcttcatcatcagaagacacaaacaatgcaactgataccaacacatcagaaagccaagacatctcagttaatggtcctgaaaaagttggggatgtttatgaaattgatggtggtacagctaaagtaatggccatcagcaataaagaaaccactgtgaaaactggcccgatccaatttactgtaaaaaaagtaattgccgctgttgccaacgaacaactaccttttattgatgttcaaattgaatcagaaaatacatctgatgaagtagttcgtttcagaccaagtctagcacaattagcaacaagcactggggtacaaatcgatgagccatcattgttggaaagtgacaggcttctcgacgagtacgtaggaaaagtaaatgatagtggatccatcatatatgtttttgataacgaagaggatataaaagatttagaatcaattcggctgagaatctcttctccatttaatgaggacttaaagaatttaggggacaagctagacttaaaaattaacttagagcattaaaaacaagccctattttggggcttttctttagaaaataaagtcgaacataagtttttattttgttggtaggaggctttaccttgtatcatatttcacttcttgaggaaagaagacgaaaaatttacaccggatcccatcatacattccacctaatcacactcatacattaacacgctctcagagccaatataacacctctctaagcatccttaatcaattcccaatccaattgtattcttgttcattcaaacagcacacaaggcatcttaataccatccatcaacacacaaataacttaccacaaatataaaaaatatgtatataaaaatcatgaattatgttataatagagtcataggaaaggaggtgtacatagtgcttgagaaaatgggtatcgtagttgctttcctcatatctttaacggttcttacaatcaacagtctaacaatagttgagaaggtaagaaacctaaagaatgggacaagcaaaaagaaaaagcgtatacgcaagcggctccgaccaaagagacaacgccaacgtatacgccgatgagagctaagctaaaggggaatgaacttctcctttagttcctacccatattataacatgatcaagcacattgcaaacatgaaacgattctcattatggtttacccatatcacattcattggcttattcttaatgtttcaactcatcaaagattacttcagcagcgaaggacaggcgctaatcaacacaatttttgttgtcacatgtatcattgccatattgttatggatcatctattgtgtattccttaaactaagaaacaagtcacactaatcatataggcctcatggtataattaaatcattgaggtgagatgattggagaaaaaattcctggatgctattcagcagctaacaaaggaattggaaatgctcaagaaagatattgactccatcaaagaagcaactgtcagaattgataaagaccttttagagtacagagaagagataagcaaagtaaaacaagatgattcagtattaatcatgcagcaacacaaggataattaaatatgcgttataaataagggagcggtaaggcaattatcgttccttatttttcgatacaaaattaaaatataaggaggatatatggaaagagttaaagttatcgattctattatgggatctggtaaaacaacttacattattaagatgatgaatgaggcaccaaagaatgagcattttatctttatcacaccatatcttgatgaggtaacaagaataaagaggtcatgtacgaatagaaagttttacgaaccaaaaatacatagtgaggaaggggaaacgctctataaactggattcattacataaacatttagcagataacaatgacattgtaacaactcatgctttattcagtatggctaatgaaacaactaaagaattgatttactcaggcaattatactcttatcctggatgaaactatggaagtggttaagaaattaaatatatccaaggatgatctggatatgctgttccaaaatgaatggattaagaacaataatggcacaatcatttggaatgatgaacaagaaagaaatcttaatagggaatataaaggagagttccaaacacttaaacatttggccaagagtaaaaacttaattttgcataatgagtctgtattgttttggcagtttcctgcagacatctttgcccaatttaaacaggtctataatcttacatatttgtttgatgctcagattcagaaatattattatgacattaacggaatagaatatgaactttatgcagtagtcaaagacaatgacagttataaattaatgcagcacagtaggcaatttgataaagcaaagaaggatgtcctaagacataaaattaaaatatatgaaggtgacttgaataaaattggtgatgattattatgcattatcaaaaaactggtttgaaaaacgttcagtgttacataaacggcttaagaataatattctgaattactaccagaatatacttaaatcaaagtctaagggtaatctttggacaacttttaaatcacataaaagtaaactaagtgggaaaggttatacgaaaggctttttagcctgtaacatcaaagcaacgaacgaatacagtcacaaaagatctttggtttattcaataaacagattcgttaatcctgcaattgatgattattttagatccaagggaataatcataaacgaggacaattttgctttatctgagatgattcaatggatttggagatcagctataagaaatggacaggatattaatatatatgtcccatcatcacgaatgagaaagctgttaatggattggttagagaaccagagataagaatagcgtatgaaaaaaaagcaataaatcgtttttgaaacccttggtacataagggttttataggggtctctcgtagaagaaaagaagtaaataaattaaataataaaataagagaatgggggtgctgctaattgttcaaaacggttcgttcctcacctgaacaatttttgctcacaccacccccaaaccccctcatgagcaattaatattaacgctatatcaaatacaaaaaatatgtatttaattattgattattatagattatcaagttataatataaataacaaatacaaataatatgtataaaaacaggaggtagttaaaatgaatgcgcaactttttaatctggagtctagacttgatgaattggaaaatgaaattaatacacaatactgtgagttagatactaatcttgatgctcttaaatccaatcgtattgagctggaatcacagcttgaaaaatttgagtctagtcttacaaatagattacaaggaagcatttcaaataactgccgaaatgacctgcttaatctgggatacacgcattcacaagttgattgcatgtctgacgaagaagtttacgctgcactcgataaaattgatgaagaaattcataatactgatcaagattattctacgggatttgaagatcttgaaaaacaaatcattgagatgaagagggactatttcattgatcgaaaagaaagagggtcagggaatttcgatgaggcatgggaaggagaaatccttgatttagaatttgagtacacggttctttgtttagaaaaggggttagaaccactcaattatattattacctgggaaggataggaattagctttaacaagtgattataccgttttaaatgagtcacaatagttcaaagcagcgattcttttcttgaataaagaatgtttagcttcagatatatatcaaaataaaatgcatattttaaatagaatatggatagtgaaagctgtacagaacaaaattggagatggtcatgattgatcttcaagaagacaggttcattaaataatcgcatagaattagggacagagaattaaaagaaaagaagcaggtttggaactctatggggaatgacctccttagtgaaggaattgcaaaagtaatgaagaacttaaataatagactttaaaatttgagaaaataattaggtgataaatttggaaaatatagctcttgaatcctcctttttagagtacgatattaatgaaccgattaaaatctataccggccactttacaattgaagttgctgatgatttttttgaaatcttgggagaagttaaaattgcatttttaccaaaagctagactaatatttgaaggagccatttcaggcaatcttagcaagcttttcgaatttgaaaaggcaatgaaaagtaataatatgatgattaatgtacctggatttatgaaatctgaagttcttatttcaggtataacagacggaagtaaagggaacaaagtatcagggatactaaaacgatctattttaacctcagctgaaactaaagtgaatagaatggaattcacggtggttaacttcgtgaatgatttaggtagaaggattgtgcatggaaggtttaaattttcagggagaacaaaattaaaatataaagattgggaaataattttggataagcgatatgactattcaaacaaaaaaatctttgatagattaaaaaattcgggtggatacttaataacacatgtgggatatttaaaaagagtggatgataaattatttgatactaaagaagtagaaccacttatttcagggctttattggttattatccttttcagcaggtagacatgttgctatccctacattggaaggataccacaacgaggaggtaatatggagtaaataccaagttccattaatagatggctggactaataatattacttggtttccaaaacaaaaatctccatccttagaacatttatttccaaaggtgattgagaagcaagaagatcctttttggaataaagttttatgggaagtgttgagttggtactcccaagcacattcatcaagtatagtagaaaacaaggtggtatctgttcaggttgcattggaaactttggcgtgggtgtatcttattgtagacagaaaatccaatattagtaaatcgaaatataagtatatgaatgcagcagagaaatttagagaaatattatctagattttcaattgacttatcaataccaaaactctttattgacattaaggataattatgacgatggcccacacctttttactgtatttaggaataagatagtccatcctacaagggaacttgattttgacaatccgatagataagctccatgtactttatcttggtgtttggtatcttgaattactaacacttggaatattgggatatgaaggaagttatgtaaaccgtttaaaggtacctataatagaaggagtatatgaatttgtcccttggaaaacaagagacaattaaaaatgtctttataaggatttacagtcagttggcgataaaaatttctcagagttgccatacaaaaaacatttgcttttgactaagtatctatgttgtaagaagttaaaaaggtttaaacggttttcgatttagatcacgaataagaacgataaaacgaacttagatttatgcattattgaccaagtcttatcttggtcttttttatgtatcagttgattactataaggtatcaataaaagacaaatgaaaagagtggaattatgattagatcaaatttaaagtccataatagacgaaagaaagatcagtatccggaagctatctagagatattgatcatgagtatccaactgtcagaaagctttataatgacgaaatggagcggtatccaagagatctgttagataaagtctgtacatacctaaacatcgagctgcaggaattgctgatattcgaaaaaagccataaccatatcgatcactcaggatgaaaatggtatactaaagttacaagcataggaaggaattacaagttttccaggtctacataaaatcgtacttatatggaaaaggtgaaaaattaataaggagaacataaatggatttgtatagaaaagctaaaaggctaaaaaaagaattatcgaaacatgaggaaattaatgattctttgaaagagcttgcatttgatatttttaaagagttaacagtaaaacctgaatttatagacaaaaacaccaatgatgttattggggaggaaaaaattaacaccagcaccttttcaaataaagaaaggttagacattttaattgaatggactattgaaatagatccaatattaagttttattattgataaatgcgatattccaatagaaagaacgggtggggatgatttagatgcttttatggagaatgtttatacagaatatatagaagaattgcataagctaccaaatagaaaatcattcgattcatcaaaaatcacaaagatagaatcttttgcgcaacaaattactaaaacaattgaactttacttagatggttatgtgcatttagcatatgctgaatttgataaaggaatgaatatcttttctgaagaggttaacattgaagagctgctcttatataacattgatagtattcgtattccttgtaaattctttagaatgagaaccagtaacacagaggttttttctaaagatgatatgtttcatataccatttgagaagagaggaataatacgcacaaatcgttttagtataccaggatttccatgtctttaccttggaagttcatcacttgtttgttgggaagaactaggaaggcctgacttaaatactacctacacttcggtttttcaccttgaggatgaagatataaaaattctggatttaagtgtttcacctacggaactggcagataatctaaagaaattttttgaaataacatttagaagaaaaatatataaatttaatgcatactttatgacatggattttaatatctgcatgcctaattagagtaaaaaaacaaaaagacatttttaaaccagaatatatcattcctcaatttttgcttgaatgggttaaacagacagagtcttcggaatactggggaatctgttatttgtcttctaagattaacagacaaacaattgaaaattacaagctatataagaattatgctattcctgttaggcaaagaaaagacagtggacattgttcgttattgggcgagacattccaaatatctgaccccgtagcttgggaaacgttccaaagtcataaggactcaccagaatcgcttcctatcaaaaatccattatttccagaaaccgaagggactcatcatgattaccataaaacagagttggggagactagaggcctttttaattagatatagatcagttgttaaagaccaactgtaactgaaatctaaaaactacgattttaaagggaaatgtgaaacaagcggaggtgctgatttgagcctcaatcaaaaagcgttaaacagttatgtttatactctggcgttttcaagtttgtcatttggtctaatttttggtctgtatctgtttgtttactctggatttatggcaatagcattagtcacaattgccatcattgcattttacgctttaatcacttacttggtgtttgctgcccctttgcaagtgtggctaagaagaaggcgcagaaaattcagtttgatcaattttttaatttatattgcagtggccttttcagctgtgtttttgttctggtttgttgattatccgccaaatgctcttaccatgttcagaagctttgagtattacattatgagtattgtagctgcgtttatttattggttttgggattcgatattcctacgaaattaacatattaaattatgaatttcacaccgtttacaacaagtaagaaggctgctgatccaaacagtaaatattcggacagtttttgtttgcttaatatcgcttcaactccgactaatgataaaagggcggcaacaaataattgcacaacaatcaacaataattcattttgattgaacaatgagtatatgcacaagactaatacaatgcaagaaaccgaaatttttgcaacttttagcaaggtatcactccttatgctaaccttaacacgattacgcgtcttaatccgagagcataaagaatcaagataaaagaagtgttttaaacaaaaagagcattacactaaatgctctttttcatgccacaccttctgcattcacgtaaaaatattccactcttcacagagcttttaaacaaagtgtaatcacaattgtcgcagcggccgtattttacatcaggatattctttgtaatcatatacgattgaagtgtcatatccgtttgtttcgtatttctcttccacaagatcacctacataatttattcaacatactcaagaataccaaatttcgttcgatatagggagggaacaaatgattggattagcttattttttaattatttggcttggagttggattattgactggcattaagtttatttttgttgatcaggtctatgatgaagagtttaaagaactcatggataaagaaacagcagcgggcatggaaaggaatttggccagcctgtttttcaaaaataagcttaatgtgattgctttttttatgttaattggtttactgccattggcaatgaggattacaaaattatttaaaagaggttgatttatgcctttgattgattatttttatgtactgcagtttgaaaacaaggaatactttaaagcatttaaattagatgagagtggttatttgacatctagcgacctccatgaagcttctaaaatacataatatgttagaagtcatcgaggtagcaagtgagcttaaaacgaagtgtaatgtgcaatgtgaggtaagggaaattcaagtcgtaaagcgttaggagtgttcaggtgtattggatagagtggattgagaatggagaaaagaaaaacattgttgcagaaggttggattgaatgggctgctatacttgaagacttgtatcagaagcggttcgagtatgttgaatggaagcggctataacatcttcactattctataaatatgaggtggttgattatatgagtgaccaaaatgaaaaaagtccttcatgggtaggtgacattattaagctgagccctaaatatttattgggactagcagttttttctggaattgggctttggttagggaatgttggattaggaaaaacacttggtataaaagatgctataaatagctataaactttacctagggcttgttttcttagcatcaaccagtttcattttatctcactttatttggtggataagtttggggataaaaaataaaattgaccaaaaatacagttataaactgcaaaaagaaagactccgaaatcttaataggagggaaaaacaaatattaagcccctacatctttgacgatgttcggtctgtggaattaagtataactgatgggacagctcaggaattagaacatttaaagattatttatagaagttctaatattagtaatcgtggttcttattttgcatacaacatacagccttgggcgaggggatatttaacaaaaaacaagcatttattacatgagtcaatagatcacatcttataagacatacagaaaggaaatattcaaatttgaataatataggagaaataatttctaattttgaaggtatcattggggctttattgggagttatagtcactttaattcttactcacatattaaagcactttgggcaaattaaattttatatagttgactttgaaatatattttaaaaccgataatgatggttggggaactaatgttatgccatctaaagatgaagcaaagcaaatagaaatacactcccagattgaaatatacaatggcgctgagatccccaaggttctacgggaaattaaattttgcttttacaaaaacacaaatttaattgtttctgttacccctgatgataaagcaacaactgaagagtttgctgagtttggctattacagggataagttatttaatattaatttgccttctaagcaaatcatcgctattaatataataaaatttttaaacgaaaaggaaactaaacaagtgaaaaaatgcaatagggtttatcttgaggcaaaagatcataacgggaaaatgtacaaagtattcttaggggagttttaaaatgaaaaacacatttttatattttagatgggaagacctccatggtgaaataggtgttgattcctttaatttattgagagcaagttattctaatttgagtgaacagcaattagtagagttaattaaagagttgatatctatagagcgggaggatatcgctgcgaaatttgatatacacctatctgagaatgccccagttttcgatgaacggcaacatgtggtttataaaggcgttgccggagatatgaactacaaagacatgttgctttctttggtaacggcattagatttgactaatacacttgaccatgtgcagaatatcctgtccttagctaaatgcttaagaagttttgatagagaaattttcgctaggtttgcaaaggatattgcggaagaggtgtattatagccttaagtaggaccttttgctttagaagaacacaatgaggtttagtcctcattgtgtctagttaaaattggaattttaaagagattacaaatacaaaaaatatgtataaaataattgactcgtaatgtgatctatagtattattaagttaaccaataaagacaacaaaaagaaatgaggggaaataatggagttaataaggatagctatgaagaaagacttggaaaatgacaactctttaatgaataaatgggcaacagtagctggccttaaaaaccccaatcctctttatgacttcttaaaccatgatgggaaaacatttaatgaattttcttcaatagtcaacattgttaagagtcagtatccagaccgtgaatatgaattaatgaaagattactgtttaaacctagatgttaagacaaaggcagcaagaagtgcattggagtatgctgatgcaaatatgttttttgaaatagaagatgttttaatagattcaatgatttcttgcagcaatatgaaaagtaaagaatatggaaaagtgtataaaatacatagagaactgtctaacagtgttattactgaatttgaggcagtgaaaagactcggcaaattaaatataaaaacacctgaaatgaattctttctcaagactcttgctgctttatcattatttaagcactggtaacttttctccgatggcccaacttataaaacaaattgacctaagtgagatttctgagaacatgtacattagaaatacatatcaaacaagagttcatgttctaatgtctaatataaagttaaatgaaaattcattagaggagtgcagagagtactctaaaaaggcattggaaagtacaaatatcctgagatttcaggttttcagctacttaactattggcaactctctattattttcgaattatgaattggctcaagaaaactttttaaaagggctaagcatttctgttcaaaatgaaaattacaacatgattttccagcaggctttgtgcttcttaaataatgtatggcgcaaagaaaataagtggattaattttgaatctgattcaattatggatttgcaggagcaagctcattgttttatcaactttaatgaaaattccaaagcaaaagaagttttggataaactagatcttttagttcacaacgataatgagcttgcaatgcattattatttgaaaggaagactcgaacaaaataaagcatgtttctattcttcaatcgagtattttaaaaagtctaatgacaaattccttattaggctgccactgttagaactgcaaaagatgggtgaaaatcaaaaacttttagaattacttttactttaaaggaggtgagacaatgaaaaaacttattatggctttagttatcttgggcgcactaggcacttcttacataagtgcagattcttcaatccaacaagcttcaggtgattatgaggttgctggaatgccacgtggagcataaaatccattgacacataaagttattagtattattatttatttaattaaattaaacagagaaaaggaagacgtttggctcttttgagctaagcgtcttttgtagttttaaggccatcacttaaatattaggttttaataacatctagtgatcaacttcaaatacatacaccctaattaaatgaaatgcattacaaagcagcacattcgcaaaaaaattgcgtagaatgtgctatttgtcgtttaaaaaaatctttacttcccttttgtaatgcattacaattgctatagatgcaaaagataaaaaatatgtatataggaggttggtggtatgtccgcaattagttacttaaaaaacagtatgacaatgcataaaaccatttaccaaaagaaagttgaaagcttagttaaaaatgatttgttttttcatgaaaaaagcattgaaaagtcaaaaataatgaagaatgaaaatgttcgaaaacaactaactaaaggatacatgaaattgctaagcgaatacaaggaggattaatgatgcatgttgtagaacttaggtctacaaatcataaagatattgatgccgattttgtattaaatgctaaacaaacttacatagagagtgtactaaacattaggaaaatgattgttaatgcaaaaactgaagatgatctacatggtgcaaaaatagagatagcagcattattaaaagatctaaatagagtattattaggtggagatggattaaaaagaagcattgaaaataatccgcattttagatccctaatacattttgtgaagaatttaaaacgacacattgcaattgaatttgaagagtttatttatcaaccataacatatacgcactgcagtctatagtatacataaaaataggaggttgacatgtcagagcgaataaaacagctaatggtcaaacgtggcatcacaatagaggaattgtcgagggagacaatgattgatatgcagacattaaacaaaatcattgaaatgccagatgaatcagatgttacaaccataaagcttatcgctctggtgttgaatgtctctattgatgagttattagatgagaaaggaggagaagataatgcaaaataaaattaaacaattaaaaaattatgcggtttacgatgatatcgagggctttttaatcaataaagatataagaagtagctcagggaattctaactatatgatgccttcatcaactagaagggtgtcgaacaccagaaagaattatgaaggggatattaagcagttctttagtgtgattaaaggtaaagatgtcaaaagtttagttcccgatgatttagttgtaagtaaaagcgaattaagcaactatgtgaagtatcttcaggaaaagggattagttaataatagtattaacagaaaaatgacctccttgaagatgctctatacatatttggagcatgattataaggactatattgacttgtcggtgtttaatactgtcgaaaggcttaaaacagtaactaaaaactgggataaaacaacccagacagaagccgaaagaatcgctcaggatatgtatataaatgaaagacagaaacctttaatgaaaaagctgtttgttaaattcgccatcagaacttcttttcgtgtaagtgcgattttgcgagtaagatggaaagacatacagcttgatgaaagtacaggccattatatagtaacagttattgataaaggatctcaggttgtgtctacaggcattaaccaggtattttatgaggaattgttgcagctgaaggaagaggatgacagcgaaactgaattggtttttcaggggctttcggaacaatctttacgacactccttaaaaaggtcgaaaaaaaggttaggaatacctcctgaaagagaattagtcttacactcatttaagggtgtaggaattgactatgtctatgagaattctggtcacgatttacttgcagcaaaagaacaaggaaatcataaaaacacattaacaacagagagatatatgagcagaaagattaacatagcgaactctgctggtgtaacaatggatgaaaaaatcgatttaaatccactatatgaagcaacccaagaggattttattagtttttttgaaaacgctgatcttgttacattaaaaaagtttataaagcatgtaaatgagcgataatcattttttcggtatattactcagttcaaatgataattcttcttgattaaccagattgcctttggtaactttaaatttagcaacatgacatgaggtgaaaggctatatgacagtgatctttgatcagtctgcaaatgagaaactgctttcagaaatgaaagatgctatctcgaaaaataaacacataagatcttttattaacgatattcaattagagatggctaaaaataaaattactccagggacaacacaaaaattaatttatgatatagaaaatccagaagtcgaaatttctaaagaatatatgtactttttagccaagtccctatactcagttcttgaaagtgaaaggtttaatccacgaaattacttcacagaaacggatatgagagaaattgaaacgttatgggaaggatctgtggaggaagatataaaatttccgtatacattcaaacaagttgtaaagtattcggatgataattatttcttccccatcactgctaaagagttgtttatgctatttgaaaataagttattgcactataatcctaatgctcaaagaacgaacaaaacgaaaaaactagagggctcagatattgagatacctgtaccgcagctcaataaacaatcggttgaagaaataaaggaactgttcttagatgggaaattaattaaatcagtttttacgtttaatgcacgtgttggaagcgcaagttgtggcgaagaattaaaatatgatgacgacactatgtctcttacagtgactgaagacaccattttagacgttttagacgggtatcaccggctaataggcattactatggctataagacaacatcctgagttagatcatttgtttgaagaaacctttaaagtggacatctataactacactcaaaaaagggcgagagagcattttgggcaacaaaacacaataaacccagttaaaaaatctaaagtggctgagatgagtcaaaatgtttattcaaataaaattgttaagtttattcaggacaatagcataattggtgattatataaagacaaatggagactggataaatcagaatcaaaacttacttataactttttctgacttcaaaaaggcaattgaaagaagctattctaaaaaagatttttctactcaagcagacatcttaaaaactgcaagataccttacatctttctttgatgctttagctacacaatatgtagatgagttcttaggtgatatagcaaaagaacggaagagaagttttgtaaacaactatttgttctttaatggttatgtgggattagctaagaaattgcaattagatggggtaagcctagacgagttggaaagtaagattactgatgttttaggctctatagattttagtaagaaaaataagttgtgggatgaattaggtgtagtagacaagaatggaaatgctaaatcaccacaaaagatatggaatttcttcaataatttaaaaatagacgagtaattacttaggagttgtttgttgcaatgttcaatagtgagattaaggaaaaatatttagataccttatctgagggtatggttatgcagatgaggcctatttttgcaaaagcagagattactgagactttatataataaagacatttatgatttcacatcaatgcaaattttagaacttatacgatcattcgatcaaaccactatcggtagtgttcgaagaaccttagcattattgtcattgtatattgattgggcaatttcatataagttaagtaaaggattaaccaatttagcaagaactatttctgaagaagagctttatgaatgtctcggggacaaaaaattatatattacttatagtgaattagaggaaatggaaaatcaattagttaattatcaatctaaggctgtgttaagactactttttgaaggagtttctggtttagctcattctgaattgctaagtttaacgaagaagcaagttgaggatgcaatgcttaacggtaacgttttaaccctctatgattcaaagcacggtgaacgaaaactaaaagttagtagtgaatgtcttgttattgccttaaatgcagctcaggaaactaaatataaattaaagaatgggaaggcaaaaggccaaacaaaagaagtctttttagttgaaaatgattatgtagttaaaacaaaaagaacgtccaacaaaggagacggccaagcaagtaaatttgtcataactaatctaattactgatatatctgagttctttaaaattaactttttaacaccaaatactattgttagatctggtcatttgtatagagcatatcagctttataaagaaaaaggggttattgataactctgtaaggtatcagattatagatgactttaatttaagggtaaaatccaaatatcgagcagtttattcaatgcaagattatattaatgaggaagaagttaataaatattacgcagaagaactaggtctaaaagagacgaccatttaaatatgaaatccatttgactattttggttaaatggatttttcttttatctcaaaaaattgtgaaaaaattcgcatttcgacaaaaatagacaaaataatcactttaaatacatgtttaaatgtagtaagatggtcatgtaaaccatatggtttactaaggaggagaccaagaccaaagtcttagtcgtttcaatgcctttcaaccttgaattcatagaggtcttcgacattacaatctaaagcagcagcaattctttttgcagttcgaatagacatatctactttaactaatcgattatagtcgctcagctgctgtttcttaatcccagttatctctgaaagttcattgattgtaatgtctttctttctacataattcaggtatcaagcattgcccgatctcaactttaatcataatcggacatcctcctgcgttctgttatggaaagacataatacatatcataccatacgaagccgataaataaccactagcataacacctactttctatgtataatgattatacaaaacagaacgcacgttcccttaacaccttaagggtttatcacagaaaattgaacataggagaatgaggatggcaggttatttaaacaatattgcactgaatctggagattgtactcaaaaacaaagcagatagtccagaagtctctgaaacattagtaaccaggatttgtgaaaatttacttttatctaaagaagtctcgtttttaaaagctgacggatcagttgaaaattttaaattaagtgatatggaatatgaaataacaaatacagaagaattgcctgagtaaaaataaaaaaagaaagactccattaaacataatgtaatcagcagcaagaggagaatgaaggtattgttttgaatatatttgttgatcaagataattacaaagaggttagtctgaaacttacaaaaaaattgctgacttcagaacattatcaattcctactttgtttcaagggagagaaattagatattacaatttcagttacaccacaaagcctcgttaagcttagggatgacatcaatgaattgatctttatgttctcagattaaaattagattcggtcacataaattggccgaatctaattgacagatattaaatgatgggttatagtttattcaaatacaaataatatgtatataggagatggtaaagagagctatgttgcttgatgaaaagctcgataaattaatgaaaacgattctgcgattaaaagcatacaaagaagaggaaaatttacgaagagtcatcggagaatttcattcaataattgattatgcttacgaggggatgtatatagctgaagatatgttaagagaagaagaaagtaagggcaaagaagtaagtacatattgaattgtgtaattttcactaaggtaacaaaattaaaattagtggataaaatgtaagtttcatcgagattcgaattggagggggatatcacttggaattatcattagatgaattgaagctctgtcttaaaccattagtgtttttcggtgagttaaaacttgaaatcagtgattatgaagaaggtaagaaaattgaagtgctggatcatgatgaagggtctttaattaatttagcagaccaaacgattaacgaaaattatgtgtgtactacatgtaattgtactttatataccaatgaaaataatgaagtatgtttcatagagcatccgtatggtgcaatcacagctgtaaataaagatcaagtgattcatttaactaagctaattggagcaatcataaatacggatgaggaggatccagttgaatgaacacagcatacagagtttgggacggcgagcagatgcattattgggatgatgaaggtttgagccttatcatcaaaagcaacggcgattggactttgaaacgtttatacacagatgttttggttccggttgtagacagcacgaatagaaacgcggctctcatgtggggagcaaaggtaagaggcaaatttatttatgataggtctatagtaaaaataacgagtgatgataaagaatcatcagatgtttgcgaagttaagttttcagatggcgttttccaagtagatgtatcaaaaatttccgctgattatgacgtgactgccgtcgggtgggtggaatatgcaactattgaagtaatcggagacgtttatcaaaatcctgagttattggagggtgtgaaatgacaatcaatttgaaagtaaaacaagagaagcgcaaagggttatcaattaatgatatccaagatggatacttcattttaagaaatgacgatgtttggattgtgaaaatggatgttacaaatagaaataagatacatttaatcgatttagagacgttccatgttaaaactgtatcaacaaagaacgatttgaaaagtttgtttgaagattggagccgaattaagatattaagtccgaaacaggtgaatttaaatatcgggttccaatggaaagagtaaaggagggcgcggagtgacaagtgaaatgcaattacaggcacagatcgacgttatcgaaaaagaaaataaggaattgcgtcgcaggaatgaggaattagggcagacggtcgaatgtcagaacaaacagatcgtcactcaaaattggagactgttgtttttcgcttcatcctggatcgtttatggaattgttagtgctataaaatacctttggggataaggagggcgttgagtgatggaggaaatagataacaacgaattgaagttccgaatgattacgccggatggagaatcatttccggttaattctgcacctattgaaggctggcaaaatgatatttggaagacgtttgatgaacagaaacgggttttcgatgcagagattaaaaaagcatttgaacactgtaacgtaccgttggaggaaacaattgaacgggctgaattagtcgtagataaggacgacaacactgttctgaccatagacaaactaccggttttaatcttatataaacctgaatttttatattcgaaaggaaaagcagttcaaagatacaaacgactttatgaggaggacgtggaatgaaggaatttcatttgcacaaatatcccgtgacatcagttgaagggaatgagtatgccgttagcatttataacgatagacactcaaaaggttttgtcaaagtatctttatataaaaaggtgcgcggttttttcaggaaagaaaaattcaagtgtcttacaagagaaggagacttcgctccgagttatttcgaagaaaagtgggattacgattacatacagatggcaatcaatgaagttattaactatgaaaactccataaaggagcaaattaatcatgaaaataaacaaaaggctgcaatagaaaaatttgaagcgtggagtggccaggaggtgtaactgttattggaggttaatgtgaaaacaaaccaaagagaaaaattcatccgaaatggtatcccatatgatgaacttgatacacaaatgattcatttaattgatattttaaatttcaaaattggattaaaaacacgccactgttgttttgggcataaaccatacgaagaaattcaagtgatgtttgaagacgaagtgaacataaaagaagatcagattctagaattagcagaactagcgggtagggaatggaaaggcctacagttaagctttagcaaatgggcaagattttccccattgatgtttaattggtcattggtgttatcgaagagattcagaaacccagaagatccaaataaataccgttatctaagatcagttgaagaattctttgagagctatgctgcaaagaagtgataaaagatgcattttaaattaaatgagacggaggtatttaatggaaagttatctaacagtaattgaacagaatggacagcttttggttgacagccgtgaagtggcagagatggtaggtaagagacatacagatttacttagaagtattgatggatatgtagcgatcttactaaacgcaaaattgcgttcagtggaatttttcttagaaagtacatataaagatgcaactggtcgctcattgaagcatttccatttaacccgaaaaggatgcgatatggttgctaataaaatgactggtgctaaaggggtattattcacagctcaatatgtttctaaatttgaagaaatggagaaggcgttaaaagcaagaccgtccctaattgatacatatctagatatgaatgaagatgaacgtgccattgcttatttcactgaaagaaaagcaaaacgagaattgcaggagcaattaacattggctgaaccaaaagtggagaaatatgatcgctttcttaatacagatggattaatgaaaataggacaagtggcaaaagcaattggcataaaaggaatgggccaaaacaatttatttcgctttttgagggaaaataaagttcttattgatggaacaaacaaaaacgccccatatcaaaaatatgtagaaagaggattctttcaagtgaagacccaggagacaagtgttggaattaaaacaattactcttgttactcctaaaggtgccgattttattgttgatcttctaaagaaacatgggcacaaaagagaaatagcatcatagatttgaaaactttagataaaagtaaaattttaaagagaatcggaggatggaagatggagaataatgttttatacggagtttacagtactagatcacgaaagttttgctttggaattgaggagccttcaaaaacaaaagcaagaaaagagctattcaatcgaattggtacagatgcatacaaatggcgttttgaaataagaaaaattaaaagaaagtagatggaaaaatgaaatttgcaccaatggataaagttaaatttaaaacagctagtcatctcaacaaacttcgaacttttaaaaaaaagagttcctgaattagacgatcctttactcggcgaatgctgggaatttgaagaagatggtttgagacaatttgattgggaggagaactacgaatttgtcgctagacccaaacattttaattgggattaaaaacagagtctaattgaagtttaatgagaatcgggggaataaaaatggagaaaatgaacctgctaaaagaaataacaatatttgatttaaataaaatcaaacctggcacaaaagttcaagtaacttggtataaaggaacagagatggagtatacacataatggcgaagttatcattaataatggggaaaagttttattataattacgttgataaagaaggatatgtaggtcactgtcatgtaaacgcacttgatttgaaaaactatcctgacagtctaattgttgagattaaatcaaaataaaattgaagttttaatcaaatacaaatgaataatcaatccagaaataagggaaattaactaaaaaattgtgaggaattttcaatgaaacgatttattttagttttatcctttttaagtattattgttgcctatcccattcaaacaaacgccagtccaatgccttgcagtgtaatactggagccggtagataaaaatcttaaaaatgctaaaggtgtagcattaatctataaggtgcaattgaacccaccgagtgctgccagaaccaatataagtattcttgctgtccatcttcctgcaccttcttcttttggaaattacgacagttacgaaggatttgctactaaaccaggtgagattagttggcggtttaaactttatcctactcctgaggaagagagtcctagttgggcgggaagaattgacacaatttcggccgaaatgaagaatgttaaagtgcaagtgcgtctgtcaaattctagcacacaaaagttggggccaagtatattaacgaaaaatattgagtcctgttattgaatgtcttggggcaacagtgtaaaacaaacttggattggattgatgtaaatgattaaatcgattattttacctgaagaaaacacaaaaataactgtaggtaaaccgataaatgatgaatcaaatacaaaggtaattgctatttatgactatagagaagaaccagaagaagctttctgggtacacttatcaaatgggaatgatctatttgtagataaccatgaagtcattgttgagtatgaataggtctgttaataatggttgaataaaaagactgttttaaagaaagggtgagaaccgatagtcaatttcaaaaaacttagtgatccagaatatattaagcagatggaaattgagagaaatgaacgtgagcggatatatcaagaaaaggagtctataagaaagaaaactgtgtgcttcactggtcataggccgaacaaattgggtggatacgatatgaaaaatccaacaatgcttaaactcaaagataagctgcttgcagtaattgaagaattaatcactaaggaaaacaagtataggtttataactggaggagcgttaggaactgatcaggctgcttgttggtgtgtgcatattctaaagaagaaacaccctcatatcaaaaacataattgccacacctttcaaagaacaagataaagtttggtctgcagaccaaaaaatgtggtacaaacgtatgcttaatgtagcagatgagattattaatgttgaagaattagataaatataaagttagtggagagaaaccaggagagttttcgccagctaagatgcaaaagcgaaatgaatacatgattgatcacagtgaggcaatagtagctgtttatgatggaagtaaaagtggtacaagaaactgcttaaattacgccaagaaaacttacttaggacatcagctatggagacttcatcctgattttaattttgaattagatattacgtattttgttggatgataaggagaggtgaacttttctgaaactaatagaagaaagaacatatgaagaacgattgtacatatattctgatgatattgaagccagaaagcatttcgtaagtgaattaaaaccaaaagggtggatggtggacaattgctgggttgggattgatctaaatcaaataaaacagttttatcgattcaagagggaattaactgatgattatgtgtttaacagatagactaaagagcagggggcaattaatataggtgaaaaattaattgatagtaaaaagcataaaataataaacggatattatcacaagaattgtataagttgtaaaagctggttaccggcaactgaagagaatttttactctgtgaagaaaaataaggatggacttcattcatactgtaaagcttgtgtattaaaaaaggctaaagaaagcatgttgaagaattatgacaaacagcttgaacgaatgagggaaagaaatcttcttccagggatgaaagaggccaaaaagaaatacaactcaagtttgaaaaagaaaaaaacacaacaaatctggcaagaaaagaacaagctaaaattaaaaaactaccgtttacaaagagatgctcacaagaaacataacattacagatgtacagtggcaaaagtgcaaagactattttaacaacaagtgttcctattgcgggctgaaaattgaagatcataagatattattcaaaggaacctatatacaaagtgattttcataaagagcatgtagatcacaaaggggctaatgatataagcaactgcatacctgcttgtaaatcttgcaatagctcaaagcacgactttgcatttgaagagtggtacaactcatcaaacaaaaacttttcatccgaaagattactaaagatcaaagagtggctaaatcgttttaaagaggaacgacaagattcagaatggaggacaaaaggataggctgcaacaaatacataattgatactgtaatgatacttgcacaagtaaatagaggggaatttgaaaacattgagcgcaaaaaatctcctaaaaatgaaagaggggggaacaccccctcgataaatcaataatttgcttggtacttccctacataccatccatctttatattcaatgccttttaagtaccagtttctaccgttttcgtctttctcaatatttttaaaatcattaatattgtgatggtaaatatactttgtatgcaattctttcacacttatttcgtcttgaacaatgttattctctttaaccatagcagatgggctagtagcgaatgcaggagaagcagaaacgagtaatccaagagataaaacagaaccagtcaatacttttcttaatttcatttgaaccatctccatttccttttaatgtattgcaattacattatatggtttttaaagaaggcaaaatagcgaaattactcccatacatatggaaattgtgtgtcggttaatgtcgtgatagatgagaaggcaaatggagagatggattataggatggaatcataaaaaactatagaataaaaataaaataagtggaggttatgttggtgataaagaggaatctgcttagcaaccacgttgatgagattatcggagaatattacgctgctaaaggatattcagtccatagcattgaccgccaggaaaatggacaactaatcgttgttacggagcgagtagcagaggagaaggaaaatgcaaaagttgatatagcatttgattttgtacatagaagaccacataagaagaagtatttagcataaaaaaggcaaagaggaattaacactctttaccgttaggtttcttttttagacgatcacagataaatttcattatactgatagctattgcaacagatccaattattaatgtgatttggaggatgaatattactccgaaatttatattcacattgtcaaataagtcactcgaaaaggaaagaagcttatgaatacccaaggcaagtacgaaaaaggtgaggcatattacgacaagggatgctttggaataatctttagcgtggtcaaaattataaattgctattgatacaaataataaacccgtagcgatcttgtgggatagcgaatcattcgccgaaaatgattgcactactatgcttaagaaaaatccagtaataccgattgttttactcaaggaatcacctactcttatgtaagttaagtatgagtttaccaattaaaggggattttctcaagatgatacacattaaagttaaattaaaatcgtgatttaaaggagcggagataatgaacacttatgtagtcgatgacagcaagtataaatgtatttatgcgggaactgagaaagcagctgcttttaataatgaatttgaaaacggaacaagagtaagggtttggtttgaaggccatcacataaaaacgtttgagaaagaacaaagagaagtctgtggagtaggagaatggatcgttaagtatgatgctgctactgaattgcaaaaggaagtaaatcgtttggaaaagacctatttcaagaagaaagagttgttagacactattagacaagctgatggggtcggaagggaaatcaatgaaaaaaagaaatcaatactcaattacagtggatgttaatggaggagaatataatcaggagtttgttattttagcggattcgctaagtaaagttgggcgagataagataattgctgatggtgtgacaattcaatttaatgaccagattcttgaattgaatagtaataaagaagattcgaatgattattataagggtcaaacattaactgttaaagaagattgcctaaataacttctggaaaggcggaaccgttactgttgaagatgtagatatacatagaggcatattgatagacggtgtcgtttacttagaaaaacaagtggtagacaagtatttttcaaaagaagaggaatgacatgtacaggaagattttcgatatggttaacggtagtgaagagcaatcaaaaataactgattggctatataaattaatgattgaggatgaaaattcactttacaaaatcgacattaaagtttcgaaaaggaggatttctgaacaaggagatatttatagagaggagggagaatacatagagaacgcagatcttcaaactttaccaatcgggacaaaatcctttgtgcaaaacggttgttggaagggtgaaattgtttctaatgaaaagaaacatttatatatgccacagattggagagatgagggaaatcaaagttggatcaactgggttgaatatagagattgaataaaagatagtttttaactaaacatattaggatggatcgttatcgaaaaagcacacgtatcgataacgatcataaagtattaatttctatgccggcgtttttcttcgaagtgatcaggataattctgtttagatttcgatttgaacacaaaataaagtcctgcaattaagatgtagtccatgattttgtcaaatgaccaattcacgaaacaatctaagattaattccatttatttcacctccgagacaaaaatgtccagtctcttttatatggcaagcgtatgacaacctgcttgcagtaataaaggtgaaatgaagcttggaaatttaaaaaggtttaaagaaaaatagcatttaaaataaaatatttattttaatggaaggaggtaaccgtagtgccaaatcaagagcaaataaaacgcatgaacgatattaatgatctgataaagcttattgcaagcattgatcatcgtacattctaccgcaagtcaaaggatcgtatagcgtatttcaggtttaagaaaaaactgttcttcgttgatgattacacgggtgatgacgtttatccgtatgaaatgggatacgggagtccaaacggcttttcgcatggaggcaacatgtggcaactggtcaacagttttagaaagttcatcataacagggaaatgcggcgagctgagggattataaagaaatatgggcttacagctatgaaggatgtatgaaaatccgtcagaaggcaaaagaaatagggtttatagagactgttgattatccttatagcttcgatgaatggatgaatactaattgatccatgtactaaattttcattgaattttaaaaggctaggctctaagaagttatgtaacggagagattacactctccaggattcaaaggaaggtatgcggagtttaccgtgcttagtcttaaatctgtgcttaacgttacataagataggttcgataaatacatattcatcagattcagacttaacttgtttcatagagtggaacttagttcgttctgcatgtggcataaattccataaatccagctgaagttccatcaggataagacagaaggaattttatatcctttttggtgtagccagttatgagaacctcagtgtaatcgtaattaatcactttaagccaattatgcgaacgtttattgatctcataaggggagttagctttcttgattacgattccctctaaattcttttctttggccaggttgaagtaagcaagaccgttaccttgagttccctctataacaaagacattaggatgatccagttcaagtgaattcagaactgtcttacgctcagtgagtggcttagctgcaattgattgaccgtctttgtagataacatcaaagacacagtaaacaatattatgagctgattttttggacataaaacgttccattacagcctcaaagtcaggagcaccacctgaggcagctacaataacttcaccatcgagcactgttccatctggaatatctaagtccatgagttctgggaacttacttgttacttcgttgttgtgacgagtgtatagcttaatctgattatcaaatttagaaaggatgagtctgattccatcaaatttgagctcagtgatatagttctcgtcgttaaaaggctcttttattgaatgcaatagcattggcgatacaaacaaaatatcacctcctacttagaacatattagctaagcgaaggtgatatataaagcgatatggcagtggtacttaatgggattcaatgagctcaggtgaattgtttttaggtgaattcactaaagatgaaacctggtatgcttccatgtcatcagcatcatatggctgcagtaagctttgtagataatcaggatcagtatttttagggttgagccattccttttcgttctcatcagtaaggataaccggcatccgatcatggatgtcttccataagctcattaggctttgttgtaatgattgtgcaagtgtataaaggattgccttctggtgtgttccacttttcgtataagcctgcaaaagcgaagagattggacgatttaagtttaatccgcataggaatcttagtctttggatcaaggcgtttccattcataaaaactgtcagccggtatgatacaacgtttgcttacgagcggctttcgaaagctgggtttctcggacaatgtttcagcacgggcattaatcattttatagccgatcttttcgtctttagcccatggagggataagaccccatctaagtttgcccagacggttattggatccatcgttgatgattgtcaggatgttttgtgaaggagcgacattatagctagggtgatattcaccttcaggtaagaattgatctatattgaattgctcaatgatgtcatcaaactcagaaaataaagtgaacctgccacacatgttcatcatcctttagggtttttgaatattgtacaggcttgatacacgaaaatcaaaaaggaggaatgtgatgccgcagcaaacagttgaggttaaagaagttgatgtgttgattaggggaatatggagaaagaaaaagttcaccgatattcaaaaggggcaaacctttaagattgaggagaacggaagaacaaagaaatacatagcgagaacagatccttattgggatgacatgtttgaaacttacattattgatttgttggataaaaataaaattagaagaaataagtaaacagaaatctagataaaaacgatattttaaccagaatccagggaggtaattgaaatgaacttatatgaaattatgttagagcactttgcacccaagggaagtgagcggggtatctttacatatttgcttgctcaatctgatgaagaggtatatgaatggttgaaaactgatccgagcttgtctgacggcagggcagtctataccccatatcaagacaacgaagcaaacggtaaaacatatgcaatttataatcagagctttgatattgttggtcatgaaaaatataaagatcgaatgattcgattaaaaggtgagttgaatgatgaagttgaactaaccgatctttattacggaatgaccttagtcgggtggagtatggtgaaatcggatattccatcggaacaaattgaattgttaaaagatactggcatcagtattgagtctgcataaaagtaattttttattcggagaagggggtggtactaatgtgattgcttataagatgaaagtaaaaaataaaaataaacctatttaaggagagttgttgattgttaaagtttaaaaacagaatagtagaaaaaagagttaagggggcagagaaggcaagctttggcgggccagtccttctctaccgcacacttcgcaaggttacgaagctatataagtatatcacagacaagaagtcttttccaatcctagttacttcattgtttgcattgtttaatcccaattcagttctagctgcagataagtatagtaattttgaagagttgaaagaaaatgagtcacctttgagctataacattctaactaccgatgttgacaggagagtgcttattctggcaccccatggtggaggtattgaaggagggactagtgagcttgcaagagaattaagtaagtcttactctgcctatctatttgaaggtttaaggataccaggagcttctgagttgcatattacaagtacgaatttcgatgaacctcaagctttagatttattgagtaagcatgatttaacaatctcaattcatgggtatgcatcaagtaagaaacacactttagttggtgggacagacagagaaaaagcagcaaagatcacatcattacttaccgatgcaggcttttctgcagaattactgtctgaagattcccgtttagcaggcacaaatgagcagaacattgctaataaaaatagcactggtatgagtattcaacttgaaataagcactgaacaacgaagagaaatgtttaatacttttacactggctggacgcaatggaacgcagaatcaagttttttatgactatattgctgttctaactaaattcattaatgaaaatgtgtattgtatggctggtgtagcaccatgacattgttgaataaatccatacgatactatgttgactttgatcagtggggaataaatgcatttaactcgaatccaattgaaacaactaaaggatttaatgaagctcttatatatgcatcagagaacaactttcctattgttgaagttccaaaagggaattttattattgattcagtaaatacattaaatcaacgaaatcctgaaattggtgggggaattaaaatcccatcaaatatggagctccttttggatccagaagcagtgtttcaagttaaccctaatgggtatcagggctattcttgtttttatattgggcttgcagagaacgtaataattagaggaggtcgtattataggtgaccggtatcaacatgattattctctaattgataccgatagaaaaacacatgaatggggatttggaatacatgttcatggaagcaaaaatgttttgattgaaaatgtacaaatctcagattgtattggagacaacatttggattgcagctcacggaatgatgaattacccagggatggtttatacgccttccaaaagtgttaccgtaagaaaatgcgaactaaaaagagggagacggaacaatttagctactaacggttgtgaaggattattggttgaagactgtgatatagaggaagctggaggagatacaattggccctcaactaggtattgatttagagggctacggagaaaacggaagaaagtatgatcatccttatgagttaacgatatcggattgcaggtttagaaaaaatggtcgtggttcggttactgctcatacaagcggtaaagtttccatcaaagataactactgtgacaatgttatttcatatggctacagtacagatgtgagtattaagggtaacaagataataaatgaaggggggtctaaagagtacggaatagactctgtaggtgtttcgagcactgagactggcaacagaattcaaataactgataacaatattcaagggtttaaaataggcatgatgattagagggaaaggggtatcgattgataataataccgtaaagaacgcttcaaattgtgcaatagcaacacatatggccgaagatgtttccatttcaaacaacagaatacaggacagcgattgtattcagatccaggtgagaaattcatcagatattaaagtaagcaataataaagggaaaggtacaacttcagcatatgcaattaaagtgatggattcgaatgacgttaaattcttaaataatacgttctccaatctttacggaggtctatattgtgagagatctcaggcagtcagaattaagctaaacgatttcttattgagtggaaaaggttacgggatatattgggataaagattcagaagtcttcctaacaaggaatgagatatttgaaccaagaaatgttgcaattatgggggcagctgatatgtacaatatcagaataagtgataaccagatctataattgcaaagcaatcattgcgatccacttaataggcggttctgagcatatggttagaggaaatgaaattatgtttaacagagattcagatcaaggctatggaatatatttaaacgggacaaaaaaggttcgattaataaggaatgatgttcaaggtattggtgcaagagtgctttcgcatccatttgcaacgtttaatgcttccagtacaactttaatacataatacatacgacagcggcacacctagattagccttagatgatacagtaatcgattataaataaaaaattcttaacgagaacacttgttccctttatgggttttggtatataatttagtagtaccaaaaatttcaaaacaggggatgagagtatgagtgagcagaagcttagaatcggagaaatacggtatgaggttttcgatgattatgatccattaacagaggagtatttaggaaagaacctagcaaatgcttattttattgctcaaattaaaaaggaaaatgtagttcaagtagggaataggaaaattaattactcaagcgatgttaaaattggttttgatgcattcggggaagaaactaaagagaaaatcaaagagtatcttctggctgcctatagtctaatagcagaaggggctaaagacgatggtctagtagaatatttataaggcaatgctgggctagtctctaagattagcctagttatcatacgaataaaggggttaactgaatgtcaaacatcatttctaaagagcaagatgaagcaattaaatactttagaaacaaattaaatttatcagacaaagacttatacataccgttgattaattttgaactacttagagacaagaacgagcaatatgcgaacattctttatgagctgtataaaaatgatccctatttgtttattagagctttaaaggaaggttatgtggttaatcagccaattgcatttgatgaggccattgtgcgattctttaatggagaagaactggctattgtacataaaacaacaggcagaagatacaatgtaaatgtgaaaatgaagcagctgcctgatggcttttcattgcaaacaatggatatgtggttgtggagtgagcttgtttgaaaatagcaaactctttacctatataatgaaaatatgatagaatatagaagaaattgataattgaggagatgtttttgtggagtttaaagttggacaagacgtatcagaaatttggaatatccatggatcaattcttccggaagttttaatgtatatgttccctcgttcagacgaatcttatgattgggaatttgtaaatgacaacggaagacatatctttactgcctggagaaaaagtgaacctattcctacattagaggaaattgaaaaagcagcaattgagcttgaagagaagaaaaatgcacctaagccaaaaactctcgaagaaagagttgctgatttagaaaaacaagtagcttacttaacgagtaaggttgaaggaacaaactaacaagagtcccttattggggcttttaaatttaaataaaatgataattttattcgaattaaaaagagcgcaaatgaaatacaaaaataaaaaatataaaagtttataaaacatgtagacaaagataaaaaatatgtatataataaaatcaagttaaagggaaggaggcgaattacttggaggtacttgggataacagagaaagcgttaaactattacagagaaaacgttaaagacaacaagaccattactcctgatcaggcactgttaaagatgataaggaatgtcctacttgtcaaagaaactcatcctgagcgagtgaaaaaacgtttattttgcacagagtacgcttacggaaatatgataatcaaagttaacagaaaaaagcaggtatttgaaattgtaaataaatcaggatgcttttctgaccaaaatgattggaagttcccaaaaagaaggtacatagaacttagtaaagaacttggaatcaaagactgcaagtttagaaaaattacatattcaaagaaaaatcacaataaacaaaaataaaaatagaggatgattaaaaatatgacagaaaacaaaacggtattacgtgaagcatcaaacgttgtaacaattgaaggaactttagctgaagtacgacacactgaatggaaaaatggaaatggactaaatattgaattagacattgaggttgcacctaacgaagtacatacagttaaaggcttttccaagtataagaaagatgatggtactgataatgcagttgcaaaggggtaccagactattgtaagcgagtataagtcaatcgcaaaacacggtagagatgaagctgacaaagtaagaattactcaaggtaaaattagcttaaatgagtattattcacacgggatttttaaatcatatccacaattaatggctaactttgtgaacagactggatgctaatgaagaattcaatcccagagcagaatttgatgttgaggtgtttgtaaagaacgtaaccgaagaaaaagtaaaaggggaagaaacaggtagagttaatttaaatggctatattcctgtgtacaacggaaaagtaattccttttacatttgtagtcacaaaagaaggctcacaatatgttgaaaataattatgaaaagggaactaccgttaacgtttttgggaagatcattaattataaagaacaaaaagtaacaaccaaagtagcggcatttggagaagataagaaagaaattacttcaattacaagaagagagtatctaattacaggtggtaatgatccttatgatgaggatagtaagaatgcttttaatgcagatgcaattaaaaaagcgttgactgaaagagagatttatctagacgagcttaagaaagaaggaaataaagaaaacaataaaaagtctgggtttggtggaagtgctcctaataacaagccttcaaagccggttgaaatttcagatgatgatctccctttctaaaataaaatagatcattaatctaatacataactggggtgagctccgactcacctaacaaattcaaaataaaaggagaactgaaatggcaatcgatattttcaacccacaagtttctgtagtagcaaaaggattagaaggaaaagttatcacaatctacggttctaacaacttaggtaaaactaagcaaagcactcggatgaagaaaccgttatatctgccattcgaaaaaggattaaatgctattgccggtgtccaattcatgcctatcaatagttgggctgattttaaaaaggtaaacaagcagttaaccaaaaatgctgaaaaggccaaagagatgtatcaaacaatcattgttgatgaagtagacgcttttgctaaatatgcgactagatatgtctgcgagcaatatgatgtagaacggattaaagatggtaatgatgggtttggcctttggaaagagtatgaaactgaagtatgggaagaaatcaataaattaattggcgtaggatttacggttatctttattgctcatgctgctgaagacaaaaaaggcaaagtatatccgaagggggataaacgagttttagctccagtaattgataacagcgatattgttctctatctaagttctaatggtgttgatgaagatagaaaagtaatcaaatcaagtgcttggttagctgaaactgaagagcattttgctcgtagccgatttgattacattgacacgtatcttcctgaatttactgcagaaaacttagaaaaagcaattattgaggcagtcgaaagacaggagcaagcagaaggaattgttgctgttacatacgaagagcaaaaacaaaacaacgcttcagaagaacttgatttcaactcattaatggatcaaattaaagaaattggcatgaagcttaatgaagaaggccgtttagaagaagttaatgagattacagagaaacatttaggtaagggtgtaaaagttactgagtgcagccgtaagcaagtaggtgtcatgtctgtaattctagatgatctaaaagaccttctagcagaataaaagaggagagattattctctcctccttattaggagtgattatttggggagacaagttaaatgtccttattgcgagaccaagttagacaaagactcagccattccttataaaaaaagatattaccatgaaaagtgttttaatacctggaagcaagaatcagatcacagaaaagagttaattcaatacatatgcaatttatatggtcttacatctccaactggcatgatgttgaaacaaattaaagagtttcaagaggaatatgggtataagcttaaaggcattgaactagcgcttaggtacttttatgaaactttggataatcaacccagagaaggtgatggcattggaatcgttccatttgtttatgatgaagcaaagcggcattacattagacaaaaagccatccgaaaatcagctgaagatccaaagaatcataaaagagaagaaattactttggtcataaaaaaaggaatgagaaagaaaagagggctagttgatatctcaatgctataggaaggagagtccatttgctacaagacaaacaggcaataattcaagttttagggagcattttaaaagatcccacaatcttgtcagagagcaataaatataagataacttcggatgattttccttcaaggtttcattcaatattattttttgccatgagcaacctatttcatcaaggaactgaagtattgaatgacgttgaaatagatggatatctaaaggattacgatattcaatataaaattttccatgataataagggtcttgaatatatagaaaaaatacaagagttggcagttgtcgaaaactttgattaccactataaaagattaaaaaagtttagtctgcttagagaaatggatggcttgggattcgatattaaggaaatatatgatgaatctctgattgacccaaaagaacaagaaaagatgcaagaacagtttgataagaagtcgattgatgaaattttgacagcttatgaaatgaagattgtagacataaaagaaaaattcagaacttcatctgaaagtgtgggaatccagggtggagaaggtattaatgaattattggattcattcgaagagtcgccggatattggagttccattaaatagcgaaatgcttacttcaatttttcggggatcacggaagaaaaagttctatctgcgctcaagtattacaggtggcggtaaaacaagaaacatggtcgctgacgcttgtcgcttaagtgcaactgaactttatgatcctaaaaagaaggaatgggtatcaaacccatggagtgaaagttctacagttatttcaacagaaatgatggccgaagaattgcaaagtttagcacttgcctacattagtagtgtagaagagaaaaaaatccttagaaacacaatcaatgaaaaagaaaaacaacttgttcgtaaggctgctaaggttcttcaagagtctaacatatggttcgaacatctgcctgattttaatattcaggagattgaaagaacaattgaaaagaacgtcattaaaaacaatgtagagtacgtttatttcgattatattcactcatcagtaaccattttttcagagatgagcaaaaaaagcggtgtcaacttgagggaagaccaaattcttttacttatgtcagataagttaaaaggcttatgtaacaaatacgatgtctatatgatgagtgcaactcagctaaatggtgattggaaagaagcatggttaaaaggacaagtaatagatgcttcttacttgagaggaagtaaggccatcgcagataaaacagatgctgcaatgataattcttcctttaagtaaaaaagagaaggatgcaattgatccaattttaaaagaaggattttatccagagccaaattttgttacacatgtatttaaaaataggggaaatgagtatgacaaagttaaagtcttctcccatatcaatatgggcaacatgcggataaaggactgtttcacaacaaatcttgacaatgaactaatcacagttgagaaattgaatataaaagcaggatgaggggtgtagcgccctttgaagtatgataaagacagagtaaaagaaagcctaaccattgaggatatacataagattttaaaagatttaggtagcgagaacaatctgtgggatcaacaaggaaatccaatttacagaaccgtttgtcacaatgcttctggtgggagctataagctgtattactatcatgaagcaaaacagtttcactgttatacagagtgtggggataattttgatgtattcgaacttgttataagagcaaaaagccaaaaaggaattaatatctcttttaatcaggctatcgaatatgttgccaaaatagcaggaagaacatttggatttgggaatagagagacatacataaacaatgatttgattgatgactgggaatggatggggaagttcaaaaagaagaaaaaaatacatattgagctccccagctttaatgaaacggttctagatgtatttgtgccttatcctcaccaattgtggctaggtgagggaataagtcacaagacattaaaagagtttgagattgggtattattttagacctcatacagaagggattaccattcctcatcgagatttaaataataggttgattggtatacgtaggcgctcaatgattaaagaagaagttgatgcaggctataaatatatgcctttaaaagtaggcaatatcttatataaccatcaaacaatgatgaatctatatggattacataaaacaaaaaattcgatagaaaggttcaagaaagtattgattttcgaatcagaaaaatcagtattaaaatgccaagacttttacggtgaatcaaacttcacctgtgctgtttgttcaagtaatatttctaattttcaccgtgacattttattgtctcttggtgttgaagaagtttttattgctcttgataaatatcgaccaccaaaagaacatgaaacagaggagaaatatcaagaaaaactggttgaatatcagaagaaaattctaaagctcgcagcaaaatttactccttatgttcgtgtatatgttttgtgggattatgaaggcttactggattataaggacagcccagcggacaagggaaaggaaactctagaggagctaatgagaaggaaaattgagattggcacagatgaagggggaatttaatggagtatagactaattggcgacaatgattataatttcgatcctttagctactatcttaaaaaatagaggcatagaagatccaaagttgtttgttaatgttgatcaaagttcagttattcattattcaaagcttaataatattgataaagctgcagattgtcttatcaggcatttaaataataaaaataaattgtttgttcaggtagacagtgatgttgatggatacacatccagctcaatcattataaattacataaagaagatttgtccgaaagctaatatacactacagaattcaagatgggaaagagcatgggatttttattgatacaattcctgatgatgttgacttagtcataatcccagatgcaggttcaagtcaatttgaggaacatgaggctcttaataagagaggcacagaaataattgttattgatcaccatgaatgtgaacgagtgtctgaacatgcgatcgtagtaaataatcaactttcgcctaattattcgaataaaactctgacaggtgcaggaatggcctataaattttgccaggcaattgatgaaaagctaaataaaaatgaagccgaacaattcttagaccttgtatctattggtaacattgctgattcggctgattcaagaaaccttgaaaccaggtattttatgaatgaaggcttgaagaaaataaaacatccattattaaagaagctgtttaagaagcaagagttttcaaccaagggtgacaagagcatacagaatacacagttctttattaaccctttaattaacgctgccattagggttggaagcagtgaagaaaaagatcaaatgatgagagcattcctcctttctaaagaaaaggttccctacaaaaaacgtgggcaaagtgaaactgagcttgtatcaatacatgaagacacagttaggattctaggaaatctaaaagcaaagcagaaacggattgtagatgcagctggagtggaaattaaaaatagaatagaagagaaaagtttaacagcgaataaagtactcattgtttacattgaaggaattctagataaaagcctaactggactggtggccaatcagcttgcagaagaatataaaaagccggtcttgttagccagaaacgatcccgaaaaaggtaaagatatcttgagtggctctatacgaggatatgataaagggtttataaaggattttaagaaagagcttatagatactggattatttgagtttgttgaaggtcacccaaatgcagcgggctttgcaattaaacgacagaacttaatcctggtgaacaaagtgctgaatgaaaaatttaaagacataaatatcgaagaagatattcagaatgttgattttgagatcccagcaaaacgattgagaaaagaatttatccttcaacttgatggttacaaagactattggggttacaaagttgaagaacccttaatagctataacggatcttgaaattgaagtcgaacaaattgagcatttagggaaaaagaataagacaactgttaaatttaagcatggcgatattgaatacataaggtttaaaagtgatgagaattactttaatcagcttactgcatcaaatggaacgttagtcattaatgtaattggcaaagcaaaggcaaatgaatacaaaggcaagaaaacacctcaaatcgagatttatgaattggaggtggttcgcacaaaacaaaaagaacttgtgttttaagggggagaaaagttgataggatgtcactgtcacacagataggagtaacataaggcttctagactcaacaaactcagttaaagaactgctcaaaactgcagtaaagatggaatataagggattggccataacagaccatgaagtcctctcagcacatttagatgctattcgaacagttagagaaatgaaaaagaagggggatatgccagaagattttaaactgatattgggcaatgaagcgtacctagtcgattctttagaggaagttcgagataactataaatcgggagtgacaaaatttccgcatttcttgatgttggcaatggatccaaaaggacatgagcagttaagaatactgtcttctcaagcctgggaaaactcattttatacaggaacaatggaaagagtgccgacagtaaaaaaggatgtagaggagctattaagtaaagatccaggccacatcattgctaccacagcttgcttggggtctgaggtaaacattcacctgttaaagataaaggcttttgaagaaactggtgattctcagtcaattaagcagcacaaactaaagattcatgagtttataacttggtgtatagaggtttttgggaaggataagttttttatcgagcttcaacctgcactgagtgaagaacagatttactgtaacaagaagctgatagatatagccaacgggtatgacttgcaaatgattgttacaacagatgctcactatctaagaccagaagatagagcaattcatcaagcctttttaaacgctaaggatggagaaagagaagttgattccttttatgaagcctgtttcgttcaaaacgttgatgaaattcacgagagaatggactacattgataaagaagtcatcgatcaggccataaaaaatacaatgctcattggtgagatgattgaagactatactatagagcacgaaccaattatccctaagatggagcttcctaactttaaattaagacatttatttaaaccagcatatgatcaatatgaatatataaaaaagatgtctgaatcagcagatgaacaagatagatatctccttaagttaattgaggacggatttgaagagaaattaaaaacaagcgaactaacgagagaagcttttcataaaatattgaacaggattaacgttgaactgggtgaactttgggaaatcagccaaaagctgaatcagtctatgtcttcttattacataacagttagagaaatcattaatattatttgggatgatgagtgtggaggagatagtttagttggggcagccaggggaagtgctgcaggttacttagttaattatctactcgacaatactcaaattaatccaatgcaatatgatttaccacattggagacatatacataaatcgagacctgacctaccagatatcgatattgatactgaaggatcaaaaagacaaaaaattcttaaggcactaagagaaaggtttggagacaagcgtgttcttcaaattgctacttttggaactgagggttcaaaatcagcgcttcagacagcatgtagaggcttaggaatcgataatgatatatcccagtatttaagtggaatgattccatttgaaagaggatctaactggcctttgaagcattgtttttatggtgacaaagaaactggcaggaagccaattaaagagtttattagggaggttgaacaataccctaatcttaaagaaacagctttaaaaattgaagggttaactaataagcgctcttctcatgcagccggagtaattatctttaacgatgaatatacaaagtcgaatgcaatgatgaaaactcctaaaggagcttatattacacagtttaatatgggtgacagtgaagccatgggctcagtaaagtttgaccttcttacaattgaagctttagataagattagagtaacattagaccaattaatcgagaataatgaaattgaatggcaaggaagcttgaaggaaacatacaacaaatacatccatccagacgtaattgagtatgaagatgataagctatgggaaatggctggtaatggggaaatcatggatttattccagttctcaactgaagtcggtcatcaatcagttgtcaaagtaaaacctaagaacttacttgaagcagcagtaaccaattctttaatgaggcttatgtcagacggtgaagaacagcctgtagatacatatgttaaatacaaaaataaccttaataaatggtatgaagaaatgacacggtacggtctaagcgaaaaggaaatcagagtaatggagaggcaccttaaggacatttatggtgttgctgatactcaagaagtggttatgcagatggttatggataaagatatagctaactttgacattaaagaatcaaattatcttaggaaatccatagcaaaaaagaaagaagatgtactaaaagaagtggaagaattgttttttaaaaaaggaaaggagattggcacttctgataacctgttgaattatgtctggaatgttcaatttaaaagacagtttggctacagttttagtttacttcataccttggcatattcaattattgcattacaggaattgaacttaaactatcgatataatcctttatactggaatactgcttgtttaacggtaaacagcggaggaatagataccgaggatacaaaagacaacaaaaagacagctgctacaaactacggaaaagttgcttcagccatcggaaacattagacaaagagggattaaaatagacctcccagatataaataaggctgattttggttttaggactgatattaacaacaattcaattttatttggacttaaaggaatgaatggaattggagacgatgttattcatcatatagttctaaatagaccatatagtgactttaacgactttattgaaagaatgtttaagagcggcattattaagaaaggacaagtaatccaattaataaaaggaggctgctttgattcttttggaaacaggcaagaaatcatgaaggcctttattagcttaatatcagaaccaaaaagtaagcttacgttgtctaatttaaaaatgctaattgaaaacaacattgttccttcagaatttgcacaagaagtgagattctttcgttttaaagattacatcagcaaaaaggtgtacaaaacattaaagtcgccaaaagataaactttttttattggacgatgtatcagcttcgttttataaccagcatttcagtgaggatagtgtagttgacatgttaaacgggcagcttgtcatttctgaaaaagcttttaaaaaagaatatgataacaagatgtctaatataaagtcctggataacaacagaagaaccactgaagaaattgaatgattgtttattaataaaagagtgggaaaaatacgccgatgggtcattaggaaagtgggaaatggattcattgagctattattataatgaccatgagctttctggtgtaaactttgccaagtatgatattgctgacttttataaactgccagcagagccggtcaaaggtaaaccttatcaatggagagggaaaactctctatgaatatgagactacacggattataggcactgttttagatagggataaaaacaaacatgcaattactcttctaacacctacaggggtggttacagttaaacagtggtcgggcagctttagtcattacaataaacagatttctagatcaattggtggcggaaagaaagaggtaatcgagaaatcttggtataccagaggaacattgctcatgtttactggtttcagaagaggtaacaattttattccgaaggtctataaagatagcatatataatcacacagtctgcagaatagattttgttgataatgaaggaagtatgagtttgacaactaaaagggcagaaatataaatcttaactgatataggagagataaaaattttcaaaaaacttatagacaaacataaaaaatatgtatatcatagaattaacaaaatggcactttttgctacaattggtttgttaggagtagggctcgtatatagcgctaaaaacttgtatacacatcaagataatcaagtctcaataaaaaagtcattttatttaaataaaaaagaggtgaggcaaaaacttattcacgaaattgacgttccaagaatccttcctaggctaaagagtgaggaagaaaagcaggctgaaagtagaaaaaagtatcttaatgcgacaattacatatctaacagaagaaaataaaaaagcagcaaaacatacaaaaacaaaaaaagtgcaaaaaaccaatacaaagagaaatcttgataaagcagtttcaaaaagtacaaatgcaaaggcagtgaagagtcatgaagttgttgctactgcttatactgcgttttgctctacagggtgcacagggaaaacaagaaccggctacgatgtatcaaacacatcctattacaatggaaaaagaataattgctgttgatccagaagtaattcctttgtattcattagtgcaagtttcatatgaaggaaatagctttcaagcatatgcaatagatacaggaggggacattaaaaacaatcgtattgatattctaatggacagtgagcaagaagcaaatgcatttggtcgtaaaaatgtaagagtaagctggtaaatcgatccaaatgactgaaaggtataaacatttcaacaattcgttcgatgcaatacataacatgaaatttatcccaaggaaaactattacatagagagagtgaagaggatgttcattttggataaagaggctaaggtaaaatcaactggagagcgtgggattattgaagcgatctatcctgaaacagaaacagtagaactctgttattatgatggaacttatgatgaaagacgttttgatgatgttgttatggcaacaagcagttaaaatgcatgacaaaaataaaaaatagggtgagataattgaagtgtattcaaattgaaatgtcattcacagacgaatatggacaggtgaccagattaaataagacttataaaccgtcgattattgaagaacataaaggggaaatccctggattgttgctagatgattttaagaggttcttgtcgtcccttgggtttaatgaaaaacaggtttcgagaatagtaacagaagattaagaggttttttattgaggggaggtggtattaaattgcctaaatactggagttatcctgttggactagctgtagaaattaacaataatgcacgatatggatgcccacatcatgtggggagaaaaggaaagattatcgagcatttacattcagctacatatgactatgcagttagcgatgaaacaggtgacattacttactttaaagaacatgaattaacaccactaaagggaggtttagcttatgtttaaaaaaggtcaaaaggtaattgttgattttacagatgagattggagctgttgcgaaagttgattatcgatacaaccagatagaagtaaagtatcctgatggcacttaccaggttgttggatttcataaagtaaggaaggtggaggattaatgacattaattatcttggaggggcctgattgctgctttaaatcaacagttgcagcaaagctaagtaaagaactgaagtatccaattatcaaaggttcaagctttgagttggccaaaagcggaaatgagaagttatttgaacacttcaataaactagctgatgaagacaacgtgattattgacaggtttgtttattctaacttggtatatgcaaagaaattcaaagattactcgatccttacagagcgacagcttagatttattgaggataaaattaaagcaaaagcgaaggttgtatacttacacgctgatccaagcgttattaagaaaaggttgagggtacgtggagatgagtatatagagggaaaagacattgattcaattttagagttgtacagagaagttatgagcaatgcgggattacatacatattcatgggatactggacaatggtcaagtgacgaaattgctaaagacataatctttttagtggaataggggaatttatgaaaaaagtaattgcgattgacatggatcaggtcttagctgatttactaagtgattgggtagcttacattaacacatacgatgatccttttctcaaagagaaagacatcctatgttgggatataaaaaaatatacaaataccaacaataatgtttatagacatttagattacgatttgttcagaaatctaaatgttatagaaggtagccaaagagtgacaaaagagctgatgaagaaatatgaagtgtatgttgtgactacagcaacaaaccatccagattcccttaaagcaaagcttgaatggcttacagaatattttccatttattcctcatagcaatgttgtgctttgtggcaataaaaacataattaaagcagacatcatgatcgatgatggaatacataacttagaatcatttgaaggaatgaagatactatttgatgctccccataacaggaatgaaaatagatttattcgtgttatgaattgggaagagattgaacgaaaattactttaaaatatctcatttatccagaaaggagaaaacagtggaacgttttattaaaagactgtcagcttcttgtgagtcaacaattcatcacaaggtatatcaaattatgaacgaagcaaaaacagagtttgaaaaagtgctaaagaaattaaaataaaagatcaattttatttagagtaaaaataaaatatatggaggttgtttgttgagtaaactacgtgtaatgagcctttttagtggaattggtgcatttgaagctgcattaagaaacataggcgttgattatgaactgattggctttagtgaaatagataaatatgcaatcaaatcttattgtgcaattcataatgtaagtgaaacattgaatgttggagacataagtaaagctaagaaagataatattccatattttgatttgttaacaagtggatttccttgtcccactttttcagtagccggcggccgtgatggtatggaatataagtgtagcaattgttcgcacgagcatttaattacttatgaggattataagaagggagtcaaatgcccgaagtgtgaagctgtttctaaggctaaagatgaacggggaacgctcttttttgaaacagctttgttagcagaagagaagaagccgaaatttgtgatattagaaaatgtaaaagggctaattaatagtggcaatggacaagtgttaagaataattagtgagactatgaacaatataggctataggattgacctagagctacttaattcaaagtttttcaatgttccacagaatcgtgaacgggtatacataattggcattagagaagatttggttgaaaatgaacaatgggttgtaggtcagaagcgaaacgatgttctgagtaaaggtaaaaagagattgcaagaaataaatataaagagttttaattttaaatggcctttacaagacactgtcacaaagaggttgagagaaattcttgaggattttgttgatgagaagtattacttaaatgaagaaaagacgaagaaacttgttgagcaactaggaaccgcaccgctacaaaaacaagaagtaagggagccgttaatggtgggacacgtggatttaaaaggtcacgatgccatcaaaagagtttactcgcctgaaggactttcaccgacattaactacaatgggcggcggtcacagagaacctaaaatcgcagaaaagcagaaagaagtaagggcagtgttaacgccagaaagagaagagaaaagacagaatggaagacgttttaaagaaaacggagaaccggctttcacggttaatacaattgatcgacatggtgtagcaatcggagaatacccaaaatataaaattagaaagctctctccattagaatgttggagactccaagcatttgatgacgaagattttgaaaaagcttttgcagcaggaataagtaactcacaattatacaagcaagccggtaattcaattacagttagtgtgcttgagtctatatttcaagaattaatacatacatatgttaataaagaatctgaataaaatttgtcttttaaacaaatataaaataagaggagtggatcgattggatagttacccagagtccctaaaaaaagagacagaggagattaaagagcgtgttaggaatggaaatatcaaagaagacaagattaaagaaattgcagaaacgacagttgagtttttgaaatcagaggagaaaagacataaatacttttctgaagttgctgcagctatggctgataacttaagtgagtttttcaagtcgtatttaaaaggagagtgaatatgctaactgatcaagaaaaaattgacttggtaaacgctcttgattttgtagttattgaaccacatacacaaagcatttacgtacataacgatgaaaagactaatggagtattagctaaggttttgcacactatttcagtagatgagtatattgagagctttaagaaaggtagtctaattgatatctttccagcagcaatgcaagaagccggtgcggaaggatttaaagatggccagtttgtgattatgccaaagaaattttatgttgatcaatgttatgcgatgagtaaggaaatcgagcggttaactaacctaaacaatctacacaatattaaaccaaatacatatcaaggcttgattcattaaattgtttcgagaaaaaatgaaaggataaagggatgtttattgaaaaagtattatgtaaggtgtaaagacagcaaaggtgaaaatgcgtctctagttattgaggcgctatcacctgaacatgcaaaagaacaagcatacgaagtttatgaggtaggggatatttataatgtaagcctgggagaaggaaagtcgaagaattgcctagaccgaaaatattccccatacataaaaaatgacaatggaaaagcaataaccatattttcatagggagagggtatcattaaggatattgttagggatcttgtaattgatgatatagatgctgctgaaggagtattggataagctttatgtttatttagaaaacactttaaggcctgaagaaaagcgtgtttgggagcggtgtgataaagatataatgtctgtttttgcaaagctgaaaaatattaaagaaattatttaaaaaccgatagacaaaaacaaataatatgtatataataaatttacgttgaggcgaaggagagtgttaatgaatcatatatgtgacatctgtaaggagtacataagcggaaaaacaatttgtcttaggatcagcgatgaaaaaacttatgtagacttcaactgttgtgaaagttgtgcaaagggttattccgataaagtgaaaaatgaatgcagcaatttaagtgttaagaagacattagaacatttaggattaaatatcaaatacaaaataagaggataaaatattccttttatacaaatgtaaaaataaaaaacgccataagaagttttatggcgtctatcgaacagggaggtgattcaaaggctctggatttactctgagattagtataggaatgtagcaccaacaatgatcaataggatgaataacacaacgatcaagacgaagctgcttccgtatccgccgccagagtatccaccagaatatccgctgtagaatcccatattgccacctcctttagtaaggatagtatatggtatggcaaaggttaaaaattcgacatagatttcagtctaaaaaagaaaaaatgaagactttgtctaaatttaagagttgaataaggagagttgatgaatgaacatgtttgtaattgctgcaaagagtgaagggaaatatctctatggttaccacccacatatttactcaaatcttaaacaagcagaaaatgcattgaagacaatgagaaaaaacggaaagttaactgaaagagacaaggtatatggactagacggtctgatgttggtggatctataaaaaggaaagatatagatggggaaatatgatcaaaggaaatactaatgatttcccgggcaagcgcagtatacgacaaattaaaacaagcagaaagaaatattaggggagatgagagtatgcaaaccttagatgcaccgatttacgaagttaaacaggaaagtgactggtataaatctgagaagaaacgcaaagaggatataaactctttctttgataaattcgaagaaaagtatggagtcaaggaaggcttctcgttttatcactctgagtactttggagtctacgaaggaacagaagcgtatgaaatatttaaaaatgacattgttaaaaatcaagtagacggattctatgctttcaaaaaacgatctaaatactttaaagaaataaaagctatgattgagcaaattgaagaagtgtatccatttaggtctcatgatgagctggggttaaacaacatgactggtcgtcaatggataggtgacaggtggttctttggagttaaaactgaacagcttgttaatggagacagtgtggttgctactgactataaagattatctaaaaattgtaatggagcatttagattaaaattcaatttttaaagagacttataaggaggtgaataagtgggacgccataaagcaacgattgaaggattggttatgaaagaaaggtattactcacaccgtgccccaggcacagagaggtggattactcagccagtgtgtaaggtaactcgtactgaaccaatcttcgagggctatatagatattgagcctatagaaattggaggtaaagtttatatccctggacttaatgaatatgtcatagtgactgacaggcagcgaaacatacataacgagtggacatatcaaacagacagagttattaagacaattatagatgaaaaaagcttgaaggaatgcgaagaacacaataataagaaagcaaaaaacaatgatactcaaaatcaaagacagataaaaacttcctggtggcagaggctaactaaaaaagactaaaggagagatatttattgaataaggatacaaaagatatttggagcggattctttatggggtcaggttcgttaattgtagttggattacttatttttgttgaagcgttgactatgtcactaattgtttattacggattgaatcatgtgttaaatcctttgcttattgatacatacaatattcaaaatgtccatgtcactttacctcatgcatttgttattggtgttttactcaatgtatttgtcaaaggtgtaaaacggtcagatcaggaaaaagatgagaacattttcaagaaagccggtaagtctttatttcattcaactttcgcattgattgttctatatgttagcacattgtttatctaaggaggcactcaagatgagtgatgataatgctgcaaagattattttcaaaaagaaatcaactggtaaaattgtcggcgaaatgaaagctacatctttagctgctgacaccattttgcaaaacgacaataagtctaaataaaagttttattttaagccgaaattttcaaaaggagagttagatatgatcttaaaagaaattgccgtatatgaagaaacactgaataaacatttaccaaatgaaacaagaatggttcttcattacaaaaatgtagaggcaactgaaaacgaagataaaatcacagtaaggattagtaatgatttattggtttataaatgggttgaactaggcggtgtatctaagggcacttataaaatgaaaatgactagtctagaagatgaaacaagcgaagttaatgtgaaaatcgaaagaattcaaatgaactcagacagagatttggcggtagaaatagaatttaatgtgctcaatccattccagagcgttgtgggtgtacctggtattcattcgttctccataaaaggatgattttaaagagattagtggattctaaatctaaaaaataaatattaaaaggagcattgtgctatgggaattaaagcagcagtttttgaaataaaagcaacttgttacgctcatgaaggatttaatgacgaaagtccatctgttcaaggagcagcgttagaacaactaggcaaggatatggtagatcatttgctcgaaaacggagttgatgatgtgaaaattaaaggcgattacgttgaggaattggaagttgaaaaacccattatgaagtattttgaagtgtttgacccctattatgcattgattaaggcttatacaaaagaaaaggcaatggaactgtatacagatactgttacagatgatgatgatggagagttaagtgatgaaatgacagaagttgggcaagtttatgcggcgatacaacatggaagggcgccaggagaagataaagagctcatgccgtttaaacaggttcttgaggagatttctaatgacgaagagatggtattgcttattgatggcagtttactttaaagaataaaaataaattaagaggatgatgaagatgaaaatgaaatatggactttattgtatgggatcacttgttaatacttatgatgatgcaattgaggctcataatgatgcagtatatgctcaagaagaaagcggagtaccgcatgaagtaagagaaattcaataaaaataagaggaggatattatatgattcaagggttttataaagatcagaaacttcatcttctagaagatcctatgcagcagtacaccgtcatgaaagttgaagaaaatgcagtatgtgtttaccggtggatcgatgattatagacacaagattgaaagattcacagatgttgaagaggctaaaaaactccttggagaagggtggccgaaacaatagaagacacaatgaaatttatacagaaacaattggaggacgaatagatgtcgcaaagtaattataggccgtcagttcctagatgggttggcgatatactagagctagacaagaaaagaagacaaaatcagtacagaggctcactaacgtcaggtcaagagaagaaggactgggacgagtggaagcgtagatattcaagaaaattaaagtacgcaagattaaacggatggacgatcgaagaagagtgacaattcctaaggaggacgaataggtactgcttgaatctagataaaatcacagctttattcaaaatacaaaaaataaggagatgtaaaatgggggcagctagacgtattgatccaactcaaccatatgtaaaaaagaagaacattattaactttacagtagccactgagaacactcatattcatttagctgatgggcaatctttccctgtattaaaaggagagattattgcaactgaccaacaaggaaatcaatttgttgaattagaaaagaatctagatgattacgttccagttaagaaaagttccttatatgaaagtatggcacagggctacatggaaatgggcgacattaatcgtgagatatcagaagcattcaattacgctgaaaatgaagctgaaacagtgactacaaaattaattacaggggcttataacgattagtgatcattacatatgagagtaaaacaggaaatgtaaaaaggtttgtcaaagcgctgcaacaagagtttgacgttgaggcaattgaaataactgatgatacgatcatcaatcaagaattcatacatattacatatacgataggctttggggaagtacctgaaaggactttgagttttatcaataagaataaaaataaaattagaggagttgctgttagtggtaacaaggtttggggtgataactatggtttagctggagacaagctttcagctaagttccacacaccattgttattaaagtttgaacttagtggaacgaaacaagatctacagaaaatcattcaggaggtacaacttattgacaaacacaataccaaattggatcaagctcaataatgaaatcatgatccagaaagatgggaagtatcaatttgaaaaggataaggaggccgtacatagttactttgttgattacataaatcaaaacacagtctttttccatgatctgaaagagaagctggactatctgattaaaaatgattattacgaggaagaattcttaagcaaatatacattcgaacagattaaatcaatctataagattgcttacagttacaaattcagattcccttcttttatgagtgcctttaagttctacaatgactacgcattgaagacaaacgataaaacaaagatcctggaaaggtatgaggatcgtgtctcaattgtggctttatattgcgctgatggcgattacgagaaggctgttgaggaagtacatactatgatgaaacaagagtatcagccagcaacacctactttccttaatgctggacgtaagcgaagaggtgaaatggtgagctgcttcttacttgaagtaggcgacagtttgaatgatatttcacgtgctattgatatttccatgcagctttctaagctaggtggaggagtagcattaaatctaaacaaactaagagccaaaggtgaagcgattaaagacgtagagaatgcgactaaaggtgtcgtaggtgttatgaaacttctagataatgccttcagatatgccgaccaaatgggttgatttggcccctttcatcagcaatggtgatcgaaaacctctttaattcatgggaactcctacagggacaatcatgagcgaagcaagactaagtcttgaacgtgcaacgactagccgaaaggcgtaggctgcaagctattggcagtcgaaacaggaggcacccttagagggtgaagatatagtctaaccttcatggtaacatgaagcagccatatggcgggacgtgcttagcgaacacgtttgaatggtctgcaaagacaaggatcaggagcagtttatctaagtgtattccatccagacattacagacttcctggataccaaaaaaataagtgctgatgaagatgtccgagttaaaacactgtctattggcgtagttgttccagacaaatttattgaattggcaagggaagacaaggattattacatgttctatccgcattcagtatacaaggagtatgggcagtatctagatgagctagacattaatgaaatgtatgatgagcttgttgaaaatccaagagttagaaaagcaaaggaaatgctcgaaagttgttggagcaattggctattctaagaagcgaatctggctatccgtatattatgttcgctgacaatgtaaataaagtgcatccaaatgaacatatttcaaaagtgaagttttcaaatttgtgcgttactggagaaacacttcttttaactgagaatggatatgaaaaagcagccgatctttataaaaagcagaatgatcttaaagtggtcattgataatagaacaaaagattttgcagttggtagcaaaggtaccacaattgtagatgcaattccaatgcaactgactaaaaaagatgcggaaatatttaaagtcaaaacgaagcaaggatatgaaattagggcaactgagtggcacaaattctatgtgaaaagagatggtgaaattcaaaagctccaattgaatcaactgaaaacaggcgataaattattagtccaatcagctgaaggagcatacgggaaaattcatgaacccgatcttgcatacattatgggcattatagctggtgatggaaccattactgaaaaaactgccaagatttatttatacgataataaaaaagttcttgagcagaaagttactgatgcagttcaccgtattattcaaaaacacaaggttgatcgtgcttataagcacaatacatcacttctcccaacatttaatatggccaacccagaaaaacaagatttgctctacatgaatagtactgtcttatttgacatcttgaagaagttcggtatgaacaaagaaacaaaaacaagagtcccagaattcatttttcaagctaataaggaaacgcaagcagcttatttatcgggtttattccagactgatgggtgtgtaaatgcaaatcataaagccaaagcattaactattgagttaacatccatccactatgagagccttcaggacgttcagaagctgttactgaacatgggtgtttatacaacgatttattctaacaacaagcgctcacaagaactccttcctgatggaaaaggtggttctaagctttacaatgtaaaaccaacacacaaaatcagtattcaagatagaaactcaagagagttgtttatgagtattgttgaaatgaaagaatacgatgtttataaattcaatttgttaactgagacattgcaacctaagtcaagaaagccaaagcatgattttacagctgaaattattagtattgaagaagatggtgttgaggatgtttatgatacaacacaagaagactatcactctctgattttcaatggaattgttactggtaactgttcagaggtacttcaatcgtcacaagtatcagtttatacggattacgataaagaggatgaaattggcttagatatctcatgtaatcttggctcaatgaacattgtaaatgtaatgagtaatcaatcaattgcttcaacagtcagaatagcaattgactcactgacaactgtcacaaggaaaacaaacattgtaaatgctccagcagttgcgagagcaaatacattaatgagatcaattggtctagggcagatgaacctccatggatttctagctcaaaataatattgcttatgaaagtgaagaagctaaggattttgcaaatacatactttatgatggttaacttctactcactgcagcgttctatggaaattgcacgagaaacaggggagacatactacaagtttgatggttcgacttataaatcaggcgagtatttcgaaaagtacgtaacaaatgattatagccctcagtatgaaaaggttaaaaagctatttggagatcaacatattcctaatattcaagattggatgaagcttaaagaagatgtaatgaaatatggtctttatcattcctatagacaagctattgcgcctacgggaagcatctcatatgttcaatcatctacagcaggtgtaatgccaattatggagagaattgaggaacgtacatacggaaacagtaagacatattatccgatgccaggtttatcggctcagaattggttcttctataaggaagcatacgacatggatatgtttaaggtagttgatcttattgcaacaattcagcagcacgtcgaccaagggatttcatttacgttgttcttaaaggatacgatgacgacgagagacctaaatagaatagacctctacgcacatcatcgtggaattaaaactttatattatgccagaactaaagatacgacccaagagggatgcttgtcctgtgtagtttaataggtacgtttacgttttggttcaaaattaacaggatctcccggacgtcgtttgcacttaattttgttaaattttctcataagagcattacaaagtaaaccaaatataagcttcaaaatatattcgattaaacatgataaaagcctatcacacaaccatccagttgaaatgactgtactctctaacaaagatataaggttatctaaaaaattcactgtctttcattcctttcgaatgtttgacagtaatataggagtctgtcaattcagcttttaaattcactgcatttttttcggaaaaaaatatttcaattgaaaggacatgattaattgacaaaaatttatgacgcagcaaactggtcaaagcatgaagacgattttacccaaatgttctataaccaaaacgtgaaacagttctggcttccggaagagattgctttaaacggcgatctcctcacatggaagtacctcggaaaaaatgagcaggacacttatatgaaggtactggccggacttacgcttcttgatacagagcaggggaatacggggatgccgatcgtggctgaacacgtagatggacatcaaagaaaggcagttttaaatttcatggccatgatggaaaatgctgttcatgcaaagtcttacagcaacatctttctaacattggctccaaccgagcagatcaatgaagtctttgaatgggtgaaaaacaataggtttcttcaaaagaaagctagaacaattgtttcagtctataaaacaatcaagaaaaacgatgaaatttctttatttaaaggaatggttgcatctgtgttcctggagagttttcttttctactcagggttttattacccactttatttttatggacaaggaaagttaatgcaaagtggagagatcattaacctgattatttaatagtcccttttgtcggcaacggcaaatgtgaacctctctaattgctggaaaatccttattaggacaatcagcagcgaagctatgcgaacccaaaggaggtgaaaatgataaggaaagaagtcgaagaagcaccttggtggataacggaaacgggagttatcatatcaaaaaaattaaagaaaccaagaaagacatttattactccacatggctatgaaatgataggatacacgcatccgaaaaaaggaacacagaactatttagtacataggttagtcgcaaaatattttatttatgatataccaaaaggaatgtttgtaaaccacatagatggaaataaactaaacaaccacgttcggaacttagaaatagttacacctaaagaaaatactctacatgcaatgaaaattggattaatgtcaggacaacctggagaaagtaattcaatgtcaaagctcactaatatggaggcaacaaatttaatctatgatttgattgctggaatgaacaatgttgaagctggtgaaaaatacagccttcatcctcgttacgttagtctaattcgacataaaagaagatggaagactttatgggatcgcatagaacgttcaacgactatcgcataggcggcgaaattccgcaaaacgagtagggcgcaagctattggcgtgggtgagaaccccttaaatcgaaacgggaggcatcctacagggatgatgatatagtctgctccttacggtaacgtaaggcggttgcgacagagcaacgaaccgaaagtagcgaactcggttgaactaagggtattagagacgaagcgatacatggcgtatatgtaggattgttagctcaagagatttataagaagcaaacgccacagaagcaaaaagaactgtacgcatgggctttaaacttactgcaggaactttacgaaaatgaattggagtatacagaagatgtctatgatcaggttggattagctccagatgtaaagaaattcatcagatacaacgcaaataaagctttaaacaatctgggctttgatcattggtttgaagaagaggatgttaatccaattgttatcaatggtttgaacactaagactaaatcccatgacttcttttcaactaaagggaatggatacaaaaaagcaacagtggagcctttaaaggattcagatttcatttttaccgagaaaggatgtattcaatgagattaattaaattagagcagcctaattgcaatccatgtaaaatggtgtccaattacttagaacaagtaaatattcaatttgagactgttgacgttacacaggaaccagaagtagcagcaagatttggtgtcatgggagtaccggtaaccattctgctgagtgatcagggagaagaagtaaaccgaagtgttggttttaagcctaatgaacttgatgagttactaaaggaattacgataaaagggtaattttaaacaaacttgaattaaaaggagctaatacataatgcaaattaaaatcaaatacttagatgaaacacaaacaagaattaacaaaatggagcaaggtgattggattgatcttcgtgcagctgaagatgtagcgatcaaaaaagatgaatttaaacttgttccattgggagtggccatggaattgcctgaaggttacgaagcacatgtcgttcctcgttcgagtacgtataagaactttggtgtgattcaaacaaactcaatgggtgttatcgatgagtcttataagggtgacaacgatttttggttctttcctgcttatgcgttacgtgacacaaagattaagaaaggggatcgaatctgccagttcagaattatgaagaagatgccggcagttgacttgatcgaggtagaccgtctaggcaacggtgaccgaggtgggcacggatcaactggaacgaagtaattggattttgtatttgaaatatagattattttaaaagtcatcttgaaaaacatttttaatcatattacctttttctaggaaaggggattaaaatatgaaaataactattgaagaattacctgaattaaggattgcttatttccgaaacgttggagagtatggtggtaagcaaaacaaagaactaatggaatcttttaaaaagtgggcacagttgaatggtgtatttcataactctgtaattttaggaattccacaagatgatccaagtattactcctaaagaggaatgccgttatgatgttggtgttgtattaaatgaagattttaatgtgctgcaaccagctcaagttggtaagttacctggagggaaatacgctgttttcttgcttgaccatacaaaagaggcagtaagtgaattttggggcaatattttctctgaaatagaaaaaaatagtctaactatgagaggagaaccaattatagagagatatacttcacaaatgattgataatcacttatgtgaagtattagttcctatccaataaagaaggtgggtaatttcccacctcctatatatgtataagttaaatgctctgaattaactcgtttattttatcaagattaatggtaatgttgcatattgcaattacgaagtatagagtaccttggtatcgttcttttttaacaaaacagttaattccaaaaccaatcaaaaatgcaattatgattagctgaacgaacacaaataattgtgaattaggactgaagaaagaataaaccaataataacaatagaatcagtaagctaacgatttttaatatttttcgcaaattaacactcctttaaatacattgtttttaatttaccataaaagatttttgttggaaatatttccgaataaaagaatacttttatctaatatttaaggaggaagagattattaacagcaaagaaagagatttacaagcgaaatatgacgacatgctttataggaacggtctttgctttgggtttcttcagttacaaggacttgaagatgaatttattgaacatatgagacaagttgctgagtacgagaaagacctgagatacaagaaggcagcagctaacttcatgaagatgcatgaccaaaactgggtgggggattaattgtttaaggataaaaataaaataataaagagtgttgaaaagatcaacaaacttgaagaagggttgtcgctatttgaagaaggtgacgaagaatatttaagtgtattagtgaaaattcaggggctatatgatgaaatctcagatactgctttagagtgttttaaagagatgactacaaaaattaggaaaactggtcagaaacggattataaaagggattgatcagttgccacatacaattaaagaaaacattgctgatcaagtgaatgattttaaagggggagctatttgaataaaagcaaatattaacggtatagagtttgagggtgagtaaaagccaacccaacacaaatataaaattaggagatgtttactataacatatgtaactttatttctatcagcttatctaattgtattaaacattaatgaggtcaggttgattatgcgaggggaaagcaatacgtatataaaagtaaagagtgtgcttgataattcaactccagaagatgcgaaacgaaataagaatttaatttacctgtttactttgcttaaggggagttctttaatcatccccttggcatataacggtttaattatgcatgaaaatatccttatactctgttggacagcattttcagttatatacacagtcctaagcatgtttaaggttttagacgtgttggagggcgaaacagtgagccatagtaggtatatttatttggcttatgtctttgggaaccttatctttgctttgagtattatttttcatataatgtgaaattgtgtttagctgcactcattatacggctcaagcccttttagcataggtcttgaaggatgtcttggagagtttttcacagttagaagcttgtcaaaatgagtttttattacataaacctgattctgattcgcttctttaagcaacaacataaagtcattacattgttttttatggaattgcctatcaaataaatcagggcaatctccccaagccaagacgactttttttgagtctcttacaagggggctcaatacctgccgattagttgccattactgtatcaaataaatttgtattttcgtgttgtaagtttttaattagagaagataacattgtagaattggtttcataaaagggatacagattggcaatatgtattgtacctacttcgttaagggtgtggctgaatttacaaagcttgtttatggttaggtcagaaatatccctgcctgccatacttggatttaacattatataaacaaaagaggagtctaaagagttgtttaactttatcgataaacagtacctagcttcgatggaatctgttaatctttcagttttacactcaataacttcgctaacaaactccggcttatacttataaacaggcataactgaccatccctttccaatttataactaagaatatcttaccaaagtgtgtaaatgaaaggaagttaattttaaatgactcaattcgataaacaatacaactcaatcataaatgacattataaataatggaatctcagacgaagaatttaatgtaagaaccaagtgggactctgatggaacaccggctcatacactaagcgtgattagtaagcaaatgaggtttgacaactcagaggttcctattttaacgacaaaaaaggttgcctggaaaacagccattaaagagttgctctggatttggcagctgaaatcgaacgatgttacagaattaaataaaatgggtgtacatatctgggatcaatggaagcaagaagacggcaccatcggaaatgcttatggatttcagttgagcaagaaaaacagaaatctaaatggagaaaaagtggatcaggttgattatcttctgcatcaattgaaaaacaacccatcttcacggagacacattacaatgctttggaatcctgatgaattagactcaatggccttaacgccatgtgtatacgagacccaatggtacgttaaacaagggaaactccatctggaggtaagagcacggagcaatgatatggcgttgggaaatccattcaatgtatttcagtataatgtgttgcagcgcatgattgctcaagtcacaggttatgagcttggtgaatatatctttaacattggggattgccatgtgtacacacgtcatatagacaatttgaaaattcaaatcgaaagagaacagtttgaagcacctgaattatggatcaatcccgaagtcaaagatttttatgactttacaattgatgatttcaagttaatcaactataagcatggcgacaagcttttatttgaggtagcggtttaaccaatttgtattcataaataaaggttgttgaaacaaactctctcaacaacctttatttattttagttaagtatacaattacatttgttgttttgggttgaaaagtctgctgcttgagcattttcagtagagacagataatgatactgaagataccaacaaaaaggagaacaagaataaaaatgattttttcataaataaagcctcctatatatagtgtaaggtaaggatagaataaaattacagaaaagtcaaaataatttatattttaaacgggttattaaaacatcttcgtatgaacagaggggtttgtcagggctaagtaaatggatttaagaatgaaaataaaataactatagacaaatacaaataatatgtataatataataatagaagatgatgaaatgacagtttttttatctaatatacaaaaacaaaaatatacattttttaaaactaatattttattcaaactttaaggaggtgattcattggaagtaggagacaaaatacataacaccaacgaacagataacagccttagagaaaaagaaataccaaattgaaacaactttacttgaaaaacaaagggatctgttaaaactcgaaacacagcaaaacaaagctaagcttgaattgttattcgagctaagtgaagtcttaacccaattggaaggtgaagagtgggtaagtgccactattgctttacgaattattaaaagaaataaaagaaagtacttagatctctttgatcttaatgatgacaaagcatacgtaaataaggataaatttaaatttcttcatgatgaattctttgagctgaaacaacaattaaatgatatctgaggagttgtcagttgacggtagcgaaattggaggtgacaaatatatgtgtacatgtgaagagggtagtggcaaatgttcttattgtgacggagcgctggatatattctaaatgaagagaacgcaatttatagagtggctaatcaaaggaggcaataaaatggtacagacattacacagtgcaagtcgaggagcttaataatagtagttagtgacataaaaagaggtggaaacaataccattagttctgtatggatttagagaagacttaaaaaagagaggggaattatccccctcataaattaatgaaattgaccgcccatgttttgttgagctaagcgaactaaacgtttagtgatttctccaccaactgaaccgtttgcacgagttgtagtctcagcgcctaattgaacaccaaactcagaagctatttcaagtttcatttgttcaatagctgaagctgcttgaggaattagtaaatcattattgttgtttgatcttgatctactttgttgagccatcttattcatctcctaaagtgtaatgaaaacaagcttgtttgaatcatattatggagagattattttaatttatacacgccaaagaaataaatttttcattaagaaaggtggagacaaaatgaaaattgattatgtttcagatctccatataaatcattggattccttggaatgtaaatcagattaagtgggagaagcgaacaagagaaattgtaaataggttaatctcaaacggtaatggggaggtattggtcattgccggcgattttactgaatggaatcaacaaactttatgggttttagatgaggcagcaaagcaatacgagaaggtttactttacatatggtaatcatgatctttatttacttagcaagagccaaaaaaggaaatactcagactcgttaggcaggttgaatgatctaattcaaaaagctgctgacatgaaaaatgtaacaccattaattaagacaactgaaacatacaaaggaaaagtctttgcaggagatgtaatgtggtaccttccaaaaggaatcgaaggatgggacttctttaaaggagtatctaacgattctaattacatttggcttaatggttataacaaagtagatggtgtaagagcgatgtggaaagaatcaatggattggtatgaaacgcttgaaaatacacaagttgatgtatttgtctcacatgttccacctgttcacaatccttattctccatttgagcctaatacatgctacatggttgatgtcccgttcattaacgcaaaacactgggtttgtggacatgatcatttacaagctgagtttgacaaagatggaacgagctttcacatgaattgtatcggatacccgtatgactatgataattatccgagtgtcaatgtgatacctggtgaagaagtagattcatataaaacgtttgagcttaaaacattcgagatttagatttaattaaaattctaattttatacagaagggaaggggagacatggaaaatgaagttgtgtttttttgtagaaaatgcaatcatcacttgtttgctaaaaatcctatgataaacacattaaaggttatatctgaaatggattgccctaattgtggagaagagggttatcataattggattctttcgcatataggtgattcagagaaagaaaaggagaactacaattggaagtagataaaatgttgaatttattaagaaagaggtgtagctataatggacagtagagaacaaattgattggacttgtaatgaatgcaattttagttggataggtgacaattcagatttttcatgtccttcttgtgatgaaatcgatataaagccaaaaaataagatacttgattgattaagacgttgatttcatttagtgggataaactcaatgaaagagattgaatttgaagaagttaaaaaatttgttgaagtaatgtctcggcgacttagatcaaccaaggtgataaaaattcatatcagttatgcagaatggttagttgcagaagtcgaacgcttaagggggttagtcaagtgagtaatagtttagatgtacaaggagggattgaatggagaacgtaatgtcctggtttaatatagactttgaaattaaatcagacaataacattgataaaactttattgtgattatttgatcttatgaaggaaagtctcatgatttatttcaatattgaaaactcttctgatattcatgagttttttaaaaaatcgcagtagcaaagaatgatgttgattatcccttccttgaatggataaaggaaaaaggtattccaagattaaagaatattgattttaataagctacccaatgacgatcgctttcttgccatgattgagtttgatgaatttgttctgcaaaatgaaatggattttgaagatcctgaagaggttcgagggtgtattatttcaacagttaatagcctgaaggaatatattaatatctgccacaataaaacatgattggaggaaagatacctgattgttacagcctggatattgttaattgtgtttggtttattcgctttatcagattttgacttaactgagaacgaaacaaagcatattaagtttttcattttaatgaaatttgtttctgtctttatagctgctattgcagcaggagtgatttggggaggattatttcaatgattgaaatttttaaagatacaggagctacccatgatttagtttatcattctaagattaacacgtttgtttgggatgtggaatttgacattgttttatcagacagtaaggaattaaataaatgttattttgtgaaatgctttaatccgtatcgaataaatggaaagtgtgattttgcggttagttcaatagatatattttccgaaggtaaacgtctcttaattgaaaatgaattcaattttaaaattacaaaggcagtccacgtggcaacatcaaaagacgtaactgaaatagttttgcatttaagtgagagaatcagtagtccatttccaattgtaaaagaagttgtttatctagattaatgtaaataggaacaggataaaatcggtcttttatttagaataaaaataaaattagtggaggtattatgtgtaatcgaaatgttattacaattccatatgaagaggatatgtcaaagtattcaatactacaccaggtaggggggcgaattgagtattttcaaaaagagtattcacaatatccaatgttcgcatttgatagtgaagaggattacaacgaatataaatgcttaataatgcagcttaaaaagaataaaaaagtctctagtttctctttttaaaagagtagggtattgcaaacaacagtttaatatgcaaaaagtaatgaactaaatattgcacatatgggaaagaggcgagaaaaattaacgaggcttatcattcaattcaaacactgttaaacaagatggatagacaaatgaagacagtgaaggaggccattgaagaaaaagatttgcaaagagcacatcgtaacttaattaacttggctgacaataatgaggaattaatgcaggaaataaggtgggtcaaaaagggaaccatattataagttatttggttaattgtctgcgctctttaaagttccatacataaagctcttctatagagcaacctatggcatcagcaaatgtcattgctgttccaatattcatatttgatttaaaaccacctacataatcattaatacgttgttttgataatccagtacattcaacaagatcttcaattgaaacgctatattcatgcatgagctcattgagtcttgaatcaactggtttccattgttttttcactatgcacacctctttcagcaacgattttagcacatacataatttaccttcaatatagattaggagagtgattgattgggagcaaacaatcaagggaaagtttttgaagcgaacattgaaaaatctgcagcagatcaaaagttattcttttaccggattaaagatgttaacccaatgttcttgaaaagaggggcagcagtatcaaaaaacaaatatgattgctttctgttctttaaggggtacttgttcccctttgagcttaagtcgacaaaaagcaagtccatttccttcagcgagaaaatcataaagccgcagcagattaaatatttaagggaagcaacacaatacccaaacataatccctggttttctgtttcaatttagagagccggaaaacaaagtttatttcgtacatattaatgatttccttacatataagaacatagctgaaaaacagttgaaacatacatataagaataaagtaaacaaagccagtatcccgattgcgatttgtgaagaaatcggtactgaagtgcgctcgatgaaaaagaaagtgaattatacatattatttaaacaagctttgcggggaactaattaagaaagaacagtcaagagacaaaccattacatacatataatactcctgtgaaaacgggggtgtagccttggaaccttaccaacgttatgaggaattaaagaaaaaacaataaaggtagtccagaaagaaaattacagtattcgatatataactcaggatgaagcaagtaatgacttagatgagttttataaacaatttgctcaacatttattagaagctgctctggaaaggaaggcagagtaagcttctttttttcgttagatatgtagtaagtatcttaatatacagctttatctgtactgatattaatgacatgctgcactcggtgtgaaagggcagcttccaccacattttgtccgccgatgagattggtctggatcgcttcaaatggatggtcctcacatgtcggaacctgtttcagcgcagccgcgtgaaagacgatatcgacgcctttcatcacctgattcacccttctgtgatcgcgtacatctccaagtacaaataatagccgcttatcctccgcatacttttggctcatgacatactgtttactgtcgtctttgctgaatacaatcacctgtttaggtgtaagcatcaaaaggcgtttgacaatttgactcccgattgaacccgttccgccagtgactaaaactgttttgttatggaaaaatggttttagttctgctgtttgctgtttaggcatggcttatcctccaactctcgtttctctaccatgcatcatatgttcaactttgtaatcgaattaatgaaagcaaccaataaaacaaaatttaggggaatgatcatgtcacaaagtgttcttttttaatagaaaatggaaaaacggacgtaactagggaaaaacaaaactaaataaataatgtactaaatattcaacatatttttatttcgctccgcaaaagtaaatctggcaaagtcatctcaccacctctttggggaataagttgtttatgagtcagaaaccctataaaaaaaggttcattttcctcacggtaatcacctgtatatattttacaatagtagtgttagtgataaaagaggagggtaccaaatgaaggttccaaaaacaatgctgctaagcactgccgcgggtttattgcttagcctgacagcaacctcggtgtcggctcattatgtgaatgaggaacatcatttcaaagtgactgcacacacggagacagatccggtcgcatctggcgatgatgcagcagatgacccggccatttgggttcatgaaaaacacccggaaaaaagcaagttgattacaacaaataagaagtcagggctcgttgtgtatgatttagacggaaaacagcttcattcttatgagtttggcaagctcaataatgtcgatctgcgctatgattttccattgaacggcgaaaaaattgatattgctgccgcatccaaccggtccgaaggaaaaaatacaattgaagtatatgcaatagacggggataaaggaaaattgaaaagcattacagatccgaaccatcctatttccaccaatatttctgaggtttatggattcagcttgtatcacagccagaaaacaggagcattttacgcattagtgacaggcaaacaaggggaatttgagcagtatgaaattgttgatggtggaaagggttatgtaacagggaaaaaggtgcgtgaatttaagttgaattctcagaccgaaggccttgttgcggatgatgagtacggaaacctatacatagcagaggaagatgaggccatctggaaatttaacgctgagcccggcggagggtcaaaggggcaggttgttgaccgtgcgacaggagatcatttgacagctgatattgaaggactgacaatctattatgcaccaaatggcaaaggatatctcatggcttcaagtcaaggaaataacagctatgcaatgtatgaacggcaggggaaaaatcgctatgtagccaactttgagattacagatggcgagaagatagacggtactagtgacacggatggtattgatgttctcggtttcggacttggcccaaaatatccgtacgggatttttgtggcgcaggacggcgaaaatattgataacggacaagccgtcaatcaaaatttcaaaattttatcgtgggaacaaattgcacagcatctcggcgaaatgcctgatcttcataaacaggtaaatccgaggaagctgaaagaccgttctgacggctagaatagaaagcagcttgtgcagctgcttttttctatgaataaaaaaatcgttcatagcaatgaacgatttttcaagaaagcgccagatgaatcgcttttagttttgcaggaagctcatcaaacgtaaatgcgggtacggtctctttataattggctgctgcagctttttgccgttcttcagggtggttgatatagaaagcggctttttccttaaagtcgttcatgccgtgataagaaataatggatgaaaaaggatgcgccgcgggtaaatctgttaattgaaatgcttcgcatgcagcgatatcaaacgttcggttattaaaactggcatttttgatgcgcatagtattttggttgaaagcaaaatgatagggacgatgcgcattaattacgatgtctgccccattataataatgaacggcctgttcgggtggaacccatgtgctgacgacatcaatatgcggctgtttgagcacttttttaggcagatattttccccattccttgccgattacccgaaccgtgaatggcagatggaccgcttctttcataagctgaacccgattagggtaaggatagccgatgattaacagatttgaatgataggaatgttcggtgcccatttttttaaacagccgatggttaactggtatcggaacataatagacgttctggtagccgagctcttgatagtagagagctgcattttgttctatcgttaatatggcgtcagcaagcttaattacctgaaggctgatatccatataaaatgggtcttcggtcagccaaacatacacggggatatccttaccctttaaccaggtcagccagtcgtgaggaacgcggtctccaaccatcataagtgtgaaatccggctgaaacgcttcgatcttcatcaaagattctgcttcaggtttatctgcaatcatatactctgtatgagtgttctgaaaacattcttcagcccagcgatcaaaataactgtatattcctccgtatcccgactggatatacaagactttcatcggatgttatgaaaagaacgtaacgctttctactttgtctacatcaattaatgttgtagcttggcctgccggagtgacggagctttcctgtgttacaaatacgatcccgtgaacctgatcgaaagcaacgaaaacaaccggtccgatcatgtcacctgaatcagtcacaatgctgattgtagtgcctggcgtaattctggcaaaaatccatcttgccggaagagaagggtctaaaatagattctgccgtaaccgtttcactttcatctactttttgatcgatggcagcatcaagcaaggctttaagattactatccatattttctcctccttctgttgcagttggaaataaagggcttaaaacggctttaattaaatccttttttaactgtgcattttcagagctcattacacacacctcctattcgatagtgaactcacgttattcatattcttccggctgttatttggtatgagtcgaacgccgtacctgatctatttttcatctatttaaggaaaatgctgattttttaatggagtggacatagcctataccataaatcgaagtcgcacatattgtgaaacagagataaggataagggagagggatgatttggatttagagaaacaagtggatcgagaagaaaaccaagatgatctgcattttattttgcttttgctgattctgctgatacgtcaatcgtcttctgaaggaaatccatctgacctcagacgccagcttgtttttgcaaaagagctgggcgtaccggtttcaaaagtcaatttgatcaacggagatacacttcaaaatgtcatcgtaaaagaagttctgactgatttggttattttccaaaacccgttaaataacacgagatctcatgtttcactctcaagtgttgtaagctggggtgctttttaaatgatgacagaggctctgcttgctgcggagccgttttttatgtttgacggcgggaggcggtatagatgggagagaaagtgtctattattttaacaagttacaacaaacccgattatttgcaaaaagcgatcgaaagcgtgatacagcaaacgcatgatctttgggagctttttatcatggatgatcattcgaatgcagaaacaactgcggtgattcacaagtatctccatgaccggcgcattcaatatcataacagtttcgtgcatcctgcagatcgattaaaaacagcccgttatgccacattaattaacagtgcgctcccatttgcagacggcgattacatttcctatcttactgacgacactgtttatcatcctgagcggctgagccgtatggtgcaagagttttcacataagcctgaagcgcaggcggtctattcaaaacaaaaagttgtacatgtaaacgaaaggggagaggaaatctcacatttctacagaaatgccaatgcagtgcttgatcaggccgcttttcaagttgatcattgctcagttatgcatcgccgttcgttacttaatctcattcaccataaatttggaggctactgggatgatgatatgaagcattggaatcatggcgacgcaattttttgggcgagactcaacaactttaccccatttctgccgataaatgaagtattagacacaacctataaaaccccagattcatttcaaaatgcatatcggtttctgcccgccgatttgattgacggctcttttgtaaaaggttcagatcaaaatgtgtatttttttgatcagggtgtaaggcatcctgttggagaaaagtggggttttttgtatctaaatcggactgtcgctgttccagacccatatttattccaatataggattggcaaaattttaaacattccgaattatattttagtaaaggaagctgaccatcctgcaatattttatatcgaagccggaaaaaaaaggcgaattgtggaccagtatgcgtttcaattttatcaatttcaaagaaaagacatagtgacaattggaaaagaagagatggagacgcttccggaagggccgccgattacgtggaaacgatctgaattgatcaaaaatccgcctggccgacgtctgtttttcatcgaacgcgagccgtttttgtttctaaacggcgtctttcacccgattagtgaacaagtaacaaggaagttttttttacatcagaagccaatctccgcttctttccgaaatattcagcaatttccaattggaaagccgttttatccggtgtacgatgagattataaagaaattgaatattgcaacagagtaaaggtataggtcataaaaaggagacgttcatgacaggacattattcaaaaacggaacatcaatatatattgttaacgtctgaatcggcatcgtttgatcattacagcgtatacagagatccgcagcttccgcaaattttttctcataactttgttcagctccatgatacgtttccattggagcggttacttaactttttaccctccgtaccaaagctgcttgatgcgaattatctccatttaaaagcgtcgccgcagcatgtttttccgctcggtttgaagcagtcacttgtaaaaagcggttttgtcgtcgaggatgagctactatatgacatgaagcttagtgactggaaggggcagatgggacatcctttaaccgcatgggggacggcaaaaagtcttagcgacggatcttctattatgaaaatttacgattccatttatattggagaagcaatcgctgaacaaaaattaaaaagaaaatatcctttctatgaagcagatataatcattcttgttgtttgttacagcgaccaggcacagaaagttcccattgggtgcggcgagctgtttatcgatcatcaagagaaaacggctaaaatcgaagaagtggcaattttagatcagtttcaaaggaagggctacggcagtatcttagtgaaagaaatgctgtccatcgccaaatcactaggaatggaagcagcctacttagtggctgcaagcactgacggtgcaactcagttttacgaaaagctgacgtttaaaaaatatgagcgggtgcatactgtatttcattatttccttacatgaaataggcgtttgcacaaaccatttgggacttggcccgcataaaatgtcgtatatcgtgataagaaaggatgaaaacagcatgtatggatactctgggtacggttacggatttggctgcgggacaaatacatttgtgttaattgttgtcttgttcattttattaattattgttggagccgcttttatttgctagatgctgaaatttcaaaagagccttccttattaggaaggctctttttatgtgaaaaagtttttgcggggaacgtcatgccgccatttggacactcatacaatatggtaaaaggggttttgaggtgggagcatgagcagttatttgattaagccagagcttagctcggcctatccggttgtcagttatgcgaagggttcatatgtttatgatcagaccggaaaaaatatctcgacggctcgtcaggtgcggtgacatgtaatatcggccacggagttcgtgatgtgactgagaagctgaaagaacagcttgatcaggtgtcttttgcttaccgctcacagtttacgagtgagcccgccgagcaattagccgctctcttggcacaggagctgcccggagatgtgaattggtctttttttgtcaacagcggatcagaagcgatagaaacagctatgaaaatcgccattcagtattggcaggaaaaaaagcaaacacaaaaatccatctttttgtctcgatggagcagttaccacggaataactttgggagcgctttcattgtctggtttttatgaaaggagataccggttcacccatctcattgagcggtatccagctatctcagctccacatatttatcggctgaatcacgagacggaagaagactttgttcagactgcagctgatgaactggacaccatgattaaaagaatcggaagccaattcatcgccggctttgtggctgagcctattattggtgctgcaggagcagcgattactccgcctccgggatattatgagagattaagtgaggtatgccgcacacacgatgtgctttttattgcagatgaagtgatgacggggcttgggagaacaggaaggatgctcgcgacagagcattgggataccgtacctgatattgctgtactggggaagggactcggtgcggggtatgcacctattgctgctgccgtcgtatctgattctattattgaaaccataaaacaagggtcaggtgtgattatgagcggtcacacatatagtgcacatccctattcagccaaagctgctcttgaagttttgcgatatgtgttaaagcacggcttgatcaaacaatcagaaaaaaagggcgctgtgctgaagaagaagcttgatgaggcggcatctcaaagcggcattataggtgaggtgcgcggaaaaggactgctattaggcattgaatttgtggcagaccaaaaaacgaagaaagtgtttccgccagagcaggcgataacccagcttattgtcagcgaggcgaaaaaacgcgggctgattgtttatccttccaaagctggaatagacagtggagaaggagatgctgtcattattgctcctccttttactatttcagacggtgaaatggaagagcttatctctattttttcagaaacagttgcagcggtcgaaaaaaacttaaaaaggattgacattaaatggcgccatttcaaaaagcaatcagcattgacacagcaattgcagatgttcgggatggatcggttctgatgtttggcggttttgggggagtcgggtcgcctccttcattgattgaagcgatattggacagcggtgtaacggatttgactgtgatttgcaatgacgccggtttcccggatatcggaatcggcccgcttattgttaatcaacgggtcaaaaccctgatcgcctcgcatatcggttccaatccagtagccggaaaacagatgacagaggggacgttagaggttcaattttcacctcagggaacgcttgcggaacggattcgcgccggcggagcggggcttggcggtattttaaccgacgtgggcattgataatcaaatggtttgcgaaaaaaaggacatcgtaacagtggcgggaaaacgatacttgattgaagaggcgctgactgctgattttgctttcatcaatgcttacattgcagatgaattcggcaatctaacgtatgacaaaaccgcgcgcaatatgaacccgcttatggcaatggccgccaggagaacctttgccgaagctgagcgtatcgttccgatgggggagatttctgaagaaatgattgtcacaccgggggtttttgttgagggggttgtacgaagcgagggagtgaagtggaaatgggcttgggagtagcagaaagagaacagattgcaaaacgcgctgctactgaaattaagcagggcatgattgtgaatctcggtatcggtatcccttccttggtaccgaactttttgaagcctgacatgcaggtcatgtttcaagcggaaaacggtgtccttggcattggagaaagtcccgaaaagggagaagaggatgcgcatttatgcaacgccgcgggatatcctgtccgcgctgtaaaaggggcttcttattttgatacaaccatgtcttttgcgatgatcagaaaaggcaaaattgacattacgattttaggcgccctgcaggtgagccaatcaggagatttggcaaattggcttgttccgggaaaaaaggtgcctggtatgggcggggcgatggagcttgcccaaaaagcgaaaaaagtggttgtcgtcatgagtcatacagatcaaaagggaaggcctaaattaacagaaagatgtacgctgccattaactgctgcaggctgtgtagatttgattattaccgaaaaagcggttcttgaggtcgatagccatcacttcattttaaaagagctgatgaatggctcgacaatcgatgaggtgacgaggctgacagaagctgaaatcaaaatagatatgcctttttcttaagagggggaatgaggatgcaagacattgaaagaaaagtaatcgagtggcttgatcagcattcggccaaagccattcgtcttctcaaaaggctgattggggaaaaaagcacattggggtcagagtttaacgcccaagctgttgtgcttgaaaagctgcggcaatttcatatggacattgatgtatgggagccaagcataaagcaattaaaacagcatccctactttaaatctaaccgatccgattttcatgagagcccgaatatcgtggctaaaaaaacgggagccggcggaggcaggtccctgattttgaacggtcatatcgatgttgtgcctgaaggaagcgtaaaggattggaagtatgaaccgtatcaagctgtcgaagaaaacggtaaaatatacggccgcggctcaacggatatgaagggaggcaatacagcccttctttttgctttagaagccctgcacgcctgcgatgtcaaactgaagggagatgtattgtttcagagtgttgtagatgaagagtgcggcggcgccggtacactttccgccatcatgagaggctatcgtgctgacggggcgctgattcctgaaccgacgaatatgaaactatttattaagcagcagggttcgatgtggtttcggatcactgtgaagggattatccgcacatgggggcacacgctatgaaggggtaagcgcgattgaaaaaagcatgcacgttatcacagcgatacaagagctggagaaagtccgcaatgcgagaatttcagatccgctgtatgacaatatcccaataccggtaccggtgaatatcggcaccatctcaggcggtgcctggccatcttcagttgcagaccgtgtcgtcatagaagggagatgcggaattgctccccatgagaaaccagaagctgtaaaacttgaattggaaaactggctgaaggatttagaataccatgacgaatggtttaaacgccatcccgtacaagtcgaatggtttggcgctcaatggctgccgaatgatttacctgatgatcaccctttaatttctgtgctgcaatcagcctatcaaaaaatgaaacagacagagccgattattgaggcttccccgtggggaacggatggagggcttttgtaccatgcaggagatacaccagtgatcgttttcgggccgggggaaacaaaaacggctcatcaggccaatgaatacattgaggttgaagccatgatagaatctgctaaaattattgcactttttgtcatggattggtgcggccttcatacagatggggaggatgcggatgctcaagtcaataaagagtagcggtgtcacagcagttttggaccatgacggctttaataaacgaatcagagtggttcgttatgacggagccattgagaaggccctgccggatatcgtggcagcggcaaaagaagagaatgcagaaaaaatcattgtctatgcgaagcagcatgatgagccgatccttgccaaacaattatttgcgccggagggctatctaaagggctattatctcggccattcggcttgtgtcatggtacgttacctttcagaaagccggagacaaacagattcttatacagaggaacaggagatcatcgaagccatatatcgcacagcgccccgtcttcgcaacgacagtacacccgtttttacgatgagaaaagcagaaacaaacgacatgtaccagctatcgatgctgtataaaaaagtattccgcacgtacccaaccccggtatttgaccccgcttatattgaaaagacgatgaatgcaaatacggtgtattatatcatgcttgatcatgaccgcctgatcagcgcagcaagcgcagaaatcaatccagagcttgggcatgcagaaataaccgattgcgctgtgctgccggaatatcgcggccattcgttaacaagctttttaatcgaggcgttagaaaaagaaatggctggagaggatatcgttcatgtgttttctctcgcccgtgcttcgtcttttgggatgaatgctgtgttgtaccattcaggttatcagtatggcggaaggctgatcaataattgctttatagccgaaggccttgaaaacatgaatatttggtgcaagcaactgtaagtcaaaatatgcgcgaggaggagttcgtttgaaaaacaaatggtataaaccgaaacggcattggaaggagatcgagttatggaaggacgttccggaagagaaatggaacgattggctttggcagctgacacacactgtaagaacgttagatgatttaaagaaagtcattaatctgaccgaggatgaagaggaaggcgtcagaatttctaccaaaacgatccccttaaatattacaccttactatgcttctttaatggaccccgacaatccgagatgcccggtacgcatgcagtctgtgccgctttctgaagaaatgcacaaaacaaaatacgatctggaagacccgcttcatgaggatgaagattcaccggtacccggtctgacacaccgctatcccgaccgtgtgctgtttcttgtcacgaatcaatgttccatgtactgccgctactgcacaagaaggcgcttttccggacaaatcggaatgggcgtccccaaaaaacagcttgatgctgcaattgcttatatccgggaaacacccgaaatccgcgattgtttaatttcaggcggtgatgggctgctcatcaacgaccaaattttagaatatattttaaaagagctgcgcagcattccgcatctggaagtcatcagaatcggaacaagagctcccgtcgtctttccgcagcgcattaccgatcatctgtgcgagatattgaaaaaatatcatccggtctggctgaacacccattttaacacaagcatcgaaatgacagaagaatccgttgaggcatgtgaaaagctggtgaacgcgggagtgccggtcggaaatcaggctgtcgtattagcaggtattaatgattcggttccaattatgaaaaagctcatgcatgacttggtaaaaatcagagtccgtccttattatatttaccaatgtgatctgtcagaaggaatagggcatttcagagctcctgtttccaaaggtttggagatcattgaagggctgagaggtcatacctcaggctatgcggttcctacctttgtcgttgacgcaccaggcggaggaggtaaaatcgccctgcagccaaactatgtcctgtcacaaagtcctgacaaagtgatcttaagaaattttgaaggtgtgattacgtcatatccggaaccagagaattatatccccaatcaggcagacgcctattttgagtccgttttccctgaaaccgctgacaaaaaggagccgatcgggctgagtgccatttttgctgacaaagaagtttcgtttacacctgaaaatgtagacagaatcaaaaggagagaggcatacatcgcaaatccggagcatgaaacattaaaagatcggcgtgagaaaagagatcagctcaaagaaaagaaatttttggcgcagcagaaaaaacagaaagagactgaatgcggaggggattcttcatgaaaacatgcgaatggtgcggcgagctcgaagcggtgcccggcaggaacacggtgtactgggagctccctgatggaacgagggctatagaactgacagacacccctgccatggtatgttcttcctgcggtatgacctatcaagaggaaaacacggttaaagagattgaggatcagctgcttttaattcaaacaaaaaaactgcctgaaagcctgacatatcagcagctcatggagacagaaagaattttgaaacgcaactattttgacttctcctgagtcatgtttcagtattcttttgttgtaattttacacttgaactgtataatagaacaacaaaagacagacatcaggaggggaaacccatgaaatccttttatcactatttattgaaatacagacaccctaagccgaaggacagcatcagtgaatttgccaatcaggcgtatgaggatcacagctttccaaaaacatcaaccgattatcatgaaatcagttcatatttggagctgaatgctgattaccttcacacgatggcgacgtttgatgaagcttgggatcaatacgagtctgaagtgcacggcagataatagctgtttcatccgcagatcactgcggatttttttatgtccatacccataccataattggatatttcctttggttttcatgcccatgcgaattggcttcacccggcatacgatagcgtatgagaaatgttgcggcgagggggagacaccatgaagcaaaataaaccgaaattccaagtaggggatatcgtagtcgtcattatgtatggaacagtcggcaccatcacaaaagtacaccaaattgataaacactatctttatgaagtcaatcataacgaagttttatactttgaatcatctattcagctttataaagattatgagggtgtcattgtcgacatggagaagcttgatattgagtatgaattccttattggggacgttgtttatgttaaagattatggaaaagaactctttcgcattatcggccatagaacagaaatttggagatatttagaagatggctgggaagatatcatttatgagctgacccgtttaaaggatggagagtggcttgaaacggaggaagaggatctcacgctggtgcttagaaaatatgaaatggaccagtttgtgcatcagctgttgtttgtccattatgtcggagaaactggccatgagatcggcgaagatatcgcatcgtctgctcttcttcagtttgaaggcggtgatgaagatcaagatacccttcacatccttgctgtgtcaattgttgatgagcttctggatatttataatgactacaaaattctgtacgaaatgtttcaggatgaagaatataaagacatgatgatgtttgttttggaaagtttaaaagagcatttcagttaatttgtgaacatacggatcaagacatataaaaaatatggcagacagccccaaatcatcacacgcgtcattcctttgagcgttttttccattatgatatcaaatctttctccgtccagtgcttccatcattttagcaatcatagcgtcagcctcccatggctcgttttttattcaatatatgactgaaagaattgtttagaacaccgggtataattcagcctgttttttcataaaacataaaaaaggaggcggtacggagatgaaagaaatagatcttgtgattgatacggaagaaatcgctgaatttttttacagagagcttgcaagacggggctacataccgagtgaggatgagctgtttgaaatcgctgatattacctttgattatttgatagaaaaatgtatgatagatgaagagctggatgaagatgagtgaggcttaaaaccggagcggtcagctccggttttattattcatgttctatgacttctgtgaaaattgaggtggttaaaattgtacaagcccgttagtttgtttcttttctttttaattctagctgcggccattcatacaaatgctgttcaatctgcagatgaagcaataagcaaggcagctgttttgatccgtcagccatggcttaatgaagtcatgacggggatcacgcatcttggtgcttcttcttttctgctccctctaattgtcatcattggagcaggcatgtttttctacagaaaaacatgggacggcctgttgatgctcttagtattcggcacagatcggctgttaaacaaagtcttaaaagaatggatcgaaagagtgaggcctgattttgcaccgctggttcatgaatcatccttcagttttccgagcggccattccatgaatgctgcttgtgtctatcctgttattgcttactttttagtgaaacatctcccgtttttgtctaagcataaaaaaatggtatatatcatagccggtgtaattgctgttttagtcggcataagcagagtgtatctgggggttcattttgtgacagacgtgttaggaggctttagcctcggcttgcttctgtttttcctagtaaaaggttttgacgaaaagattaagcggtttcgacaaaaatagagagaggaaaacacagcaaaaacgccaatatgttaaagaaataaaagggaggggatcttgatgatgttatccgtgtttaaaaagaagtcttgttcctatgacgtgacaatatttcagacaccccggtttggcgaaaaaaagggctacagagccgtctatcgaactgaactgaacgggagcgatcatcaagacgtgctgaaaagagcattctctttgtttaatgtattcgacactgttccgagtgattatgatgcaagattcatggccacaggggacgtgatcctgattgatgaaggcagaaaagggaaaacatattatcaactgcttcccgccggctggaggaaaatcaatcgtctgattgtacaaacgacataatgaaaagaaaactgcggaaacccgcagttttctgcagttttaaggcttgcgtttggcagcggaatattctttcccgtgtgcttcttcagctgcaatgatatctttttcaggtatatgattgttctttttttggccggtgatccggttacgatgttttttacccatgtcccacccctccttcctgcggttaggttttcaaattaacaccccgattatccgtttttctgaggaagtgcctaacagatcctcgaacatttcttttttcgatatattcctttataatcaatgctgaagtttgtttcatcatgacattcgttgtaaaatggacgggctggatgataatttagatttacaggaggatatgagatgagtgtacatataggtgctgaaaaaggacaaattgcggatactgtgcttttgccgggagatcctctcagagcaaaatttattgcagaaacgtatcttgaaaatgtagaatgctacaatgaagtcagaggcatgtatggatttacgggtacatataaaggtaaaaaaatctcagtacaaggcacgggaatgggagttccgtctatttcaatttatgtgaatgaattaattcaaagctacgatgtgcaaaatctaataagagtcggttcctgcggcgctattcgtaaagatgtcaaagtgcgagacgtcattttggcgatgacctcctcaactgattcacaaatgaacagagttgctttcggaagcgttgattttgcgccttgcgcagatttcgagcttttaaaaaatgcctatgatgccgcaaaggataaaggtgtgccggtgactgtaggaagcgtatttacagctgaccagttctacaatgacgattcgcaaattgaaaaacttgcaaaatacggtgtgcttggcgttgaaatggaaacaactgcattgtatacattagcagcgaagcacggaagaaaagccctgtcaattctcaccgtgagtgatcacgtattaacaggagaagaaacgacagcggaagagcgtcaaacgacatttcatgatatgatagaagtggctttacattccgtatcacaataaaatatatcaagaggcgtgctgggtgccggcagcctcttctttatgcatgcggaaacgattgataaaaggaaggtaatgtaatatgaaaaagtccggtaaatggttctcactggctgccgctctgagtgtaacggcaatagtcggagccggctgcagcatgtcgaacggagatgctcaaaaggatacgaaaaccacagcagaaacaaagcaaacagaacaaaaaacagctgacagcaaaaaatcaaacactcaaaacagtgagttttcattggaaagccagtatttcaatgatattaaaaaagtcgatggtctggaaaccattcaaaatccagaaaatatactcgcgcttgtcaataaacaatatgcactgcccggaaactatgaacctagcgatcttgtcatacctgatgtagagttttcttttgaagaaaagattcaaaaacgttacatcagaaaagaagcggccgacgcattaaaaacaatgttcgatgctgccaaaaaggaaggctatgaactggcagctgtctcagggtaccgttcgtatgacagacagaaagtcatttttgacaatgaagtaagcctaaaaggggaaaggaaggcaaaggaagcggtcgcttacccgggtgaaagcgagcatcaaacaggccttgcgatggacatttcgagccggagcaatggctttgagctaaatgaagcgttcggaagcacggcagacgggaaatgggtgcaggacaatgcttataaatatggctttattattcgctatccgaaaaataaagaagatatcacgaaatatgaatatgagccatggcatctgcgctatgtaggcaaaaaagccgcaaaggtcatccaagataatgatttaacgcttgaagagtactttgaaaaagtgaagaaaatttaaaatgaaaagcccgcttacactagataagcgggcttcattgtgtctggtgaatctagcatttgttctatgcttaccagaagaataaaccagccagagccactcctgcaattaaaccgagggaaatcccgtaagccgctccatatccccaataaccgccccaatatccgtaaccgaaacctcttggccctccgccgaccggagctataaaaactctgtctcttgttacacgggtaattctgccgacgtgaactctcccgcctctctctgtaattctgacgactttaccttgatggtttttgcaaagatgataatatctctccaatattgttcccctcctatcctgactttctatcagcatatgatagataggaaaaaaaggttggacgaaaacagggggcgatacgccgttttacttgtacgcgataaaaatacaatgacccatgtactcactatataactgcatgagctgataatgtgtttgaagcgtatcgtaatagatgggatcaatcgtttgcgataaatccatttctgtggttggttcaaattccatgtcttccggaagaagtgacatcgcttctgttttttgaaagccataggatcttaggagtttatgccattcgctttcttcatgtaagcaagtaaatccgtaaaaatccatcatttgcttcttttctgcagggggcattggtttttttaaagcagcttcgataccaatcagcatcccgctgggttttaaaactcttgaaatttcttgaagagaggatgtcaggcgtgaaaaactgaggaccgattctgacaggacgcaggaaaaggactcagaagaaaacgggagatgttccagctccgcctgatatgcagggatggcaagcccttcattcgcaaatctttttttcgctttctcaagcataataggatctttatcaacgactgttacaggatacagcaaatgtcctaaataagccgccgtttgccctgttccgcatccggcatcaagaatcggctgatccggagagggtgcagccttttgcaagaccgcttttgaaaaagccagcccgcctgggtgcgcccctgcgacaccgaataaggacagcatttctaaatatcggctcaatatcgaatcctcctttttccttatcatatgtcgtataaagacataggtttatgaaaagcaaaagaagggcgtttctctttcatttctgctccgagttgacgaataagaattcgtccatgataataatgtaagaagaaaaaggtggtgtttaattgaaacggcaattaaaactgttttttattgtgctgatcactgcagttgtcgcttcggcgcttactttatttattacgggcaattccagtatcctgggccaaaaatcagcaagcacaggagacagcaagttcgacaaattaaataaagcgtatgagcaaatcaaaagtgattattaccaaaaaacagatgatgacaaattagtagacggagcaattaaaggaatgattcaatcactggatgatccgtattctacatatatggatcaagagcaagcgaaatcattcgacgagacgatttcagcatcttttgaaggaatcggagcccaagtagaggagaaagacggagaaatccttattgtatccccaattaaaggttcacctgctgaaaaagccggtatcaaaccgagggaccaaatcattaaggtaaatggaaaaagcgtaaaaggcatgaatgtaaatgaagccgtcgctttaatccgaggcaaaaagggcacaaaggtgaagcttgaactgaacagagcgggagtggggaatatcgatctttccattaagcgcgataccattcctgtagagactgtctattcagagatgaaagacaacaacatcggagaaattcaaatcacttctttctctgaaacaacagctaaagagctgacagatgcgattgacagtttagagaaaaaaggcgccaaaggctatattttagacttgagaggcaacccgggcggcttaatggaacaggcgattacgatgagcaacctgttcattgataaagggaaaaacatcatgcaggttgaatacaaaaacggttcaaaagaagtcatgaaggccgaaaaagaacggaaagtgaccaagccgaccgtcgttttagtaaatgacggtacagcaagcgcagccgaaattatggccgctgcccttcatgaatcgtcaaacgtaccgttaatcggcgagacgacattcggcaaaggtacagtacaaacggcaaaagaatatgatgatggctctaccgtcaaactgacagttgccaaatggctgactgctgatggcgaatggattcacaaaaaaggcatcaagcctcaagtgaaagcagagctgcctgattacgcgaagctgccgtatttggacgcagataaaacgtacaaatcaggtgatacaggcacaaacgtcaaagtggctcagaaaatgctcaaagcacttggttacaaggtaaaggttaacagtatgtatgaccaggattttgtatctgtcgtcaaacagttccagaaaaaagagaagctgaatgaaacaggcatactgactggcgatacaacaacgaaattaatgatagaacttcaaaagaagctgtctgataatgatacgcaaatggaaaaggcaattgaaacactgaaaaaagaaatgtaaaaaaaaccacagacgcgtcgcgcgtactagttttagtttagtcgtccgttcg

SEQ ID NO: 54 - DNA, 1224457 bp, Bacillus subtilis WAUSV36
tatatgtatgctatacgaagttattacgaatagtaaaaaaaccatacgcggctgccgcgtatggtttttttatgcgcccttttgatttggattagcgtcttgttttttgccaaataaaccttcaatgacaggattggatcccgcgtttttaacgaacagcggattcaggatgaccacagcgatcatgttggcggccaatccccagaatccttcataaatgccatgtgcggattgagtgatatacacaataaacgttaccgctaggccggctaataatccgataaccgttgcttctttcgtttggtttttccagaacaggctgacagcaatcgcagggaagatttgcaccataccggatacacctaatagctgaagtgtcactaaggcagtcgggaacagcattccaaacagcagcgcaagaccgatgacaacaaacaccattgaacgtgtgacaagagtcagcttgctttgcgacacattcggatgaatcaaatcccggtataggttgttggcgaataaattcgatgcgccgattgccataatggaacaaggtattaatgaagcaagagcgatagtggcatatgcaaagccttgtgccacgccgccgtaagatgtttgaatcaaatgcagcagcgccagccttggatttgtatcttccggcagaacaagaaaggcgataaagccaagaaaaataaccaaaattaacacgatattataaagcggcaaaaacatgctgttttttcttactgcatcagcgcttttcgccgtgaaaacacctgtagcggcatgtgcccacataaaaagtgccagagcggaaacaatagatgctgtgataaaccaaggaatgccttttggcccttctgacggtatcgtcagcatttgcggcgcttccttcactaacgtgtcaatcattggcgtccagccgttaaaatgaatgagagggagggacaccaccataaacagcataatgacccatactaaaatgtccttaatgatggctgtatatgtgggccctttaatcccgctgaagaatgtgtaaagagcaacaagaataaatgaaatgatcacaacgaattttacgttaatatagccagtgccggcaacctgaagcgtgtcttgaatgccgctcagctgaaggcatatgtacggaataagcatgagtaccccaacgatggcaacgaggcttgccaaaagcttactgttaaaacgttcccgggcataatccgcgagtgttgttaatttatgaattttcgcaactttccaaagttttggcaagaagaagtaggcgataaagtaggccaacacagaataaggaatggcgaaaaatgcaacacttccgcctgtaaaagcagtactggtcaaccctaagaaagtataggccgtataaaggtcagcgcctactaaaaaccagacgagaagaccgccgaagcgtctgccgccgacagaccattcttccacagaagtacgtgaggatttgtctcttccggcgagaaagccgatacagacaacggttaaaacaataatagcagtaatgagaagtgcagtcagattcccttgcattattcaagtcctccatcttttttttgcatctgataaatgccaaacgagcataacggcgtaacaataatccacagcagcagccaaaagtggaaaaacggcaggccgaacataatcggttctattcgattcacaagcggcaaaagcgcgagctgaacgaatggcaaaagaatgagaataacaataagtgcttttttaaccatttactttcctcctgaaacatgataatgctcactataatagcagttgtaagaaaagatcacaagataattattagaaaaaaatgattttttcaattatttaatcaaaacacatggtttgcatccttttcaataaaggtttaaaataataaatatcttgaaatcgagataaataggagtgagaaaatgaaaacagaaggattgcaccatgtcacagcattcgccagagatccgcaagaaaacttgcgattttatacagaagtgcttgggctcaggctcgttaaaaaaacagtaaactttgatgatcccggaacgtatcatttttactttgggaatcaaaacggagatcccggtacaataatgaccttttttccgttccaaggaagcggacagggaacggtaggaaaaggccaagcgggccgggtgtacttttcagttccctcaggctccctgtctttttggaaggaacgtcttgagaaaagcgggctgagcctagaggaaaaaacgttgtttggtgaaaaaggtcttatttttgatgatacagaagaccttccgctggcgatcatggaggatgcgaaaagcggcaaaagcgagtggacgcctgacgggatcacaacaaatgaagcaattacgggaatgaaaggtgtgctgctatattcctacgacccgcaggcgaccatacaattgttaacggaaagctttggatacaccaaagtggccgaagaagaccagattgtcagactggcatcttcagcggcggtcggcggtgtcattgatgtccatttacatcctgaaaaaagaggagtcggaggatatggtacggtacaccatgtagcgtttcggactaagaaaaaggaacaggcgaaatggctgccgattattgctgaaaaccatctgccttcgtcagaaattctcgacagggaatactttacatcagtttattttagggagaaaggcggtatcttatttgaaattgccacagatgaaccgggctttatgacagatgaaacgtttgctgagctagggacttccttaaaactgcctgaatggctggagaaacatagacaacaaattacagacattttacctgaactttaaaagggggaatttataatgaagcatatttatgagaaaggaacatctgacaacgtacttttgctgttgcatggcacgggtggtaatgaacacgatctgctttcattggggcggtttatagaccctgatgcccatttgcttggtgtcagaggatcggtgcttgaaaatggaatgccgcgatttttcaaacgtctgagtgaaggagtttttgatgaaaaggatcttgtggtgcggacaagagaattgaaagattttatcgacgaggctgcagaaacgcatcagtttaatcgcggccgagtgattgcagtcggttattcaaacggcgcaaacattgcggcaagcctgctttttcattataaagatgtgttaaaaggggctattctgcatcatccaatggttccgattcggggtatcgagctgcctgatatggcggggctccctgtttttatcggtgccgggaaatacgatcctctttgcacgaaggaagaatcagaagagctttaccgctatttgcgtgacagcggggcatcagcctccgtttactggcaggacgggggccatcagctgactcagcatgaagctgaacaggctcgtgaatggtacaaagaggcgattgtataaaaaaccttagtccggatttcggactaaggtttttcatatccttacagccaagttgatacttttgaaagcggcagacggttgctttgatgcgcaggcttcactgctttgccgattgaaataagcataaccggaacatagcgctcactgatatcaaattgcttttggaactgctctttgttaaatccgccgattgcgcaagtgtcataaccttttgcttttgcggcaatcataagctgcatagcagctaaagaagcatttaagaaagcggaatcacgtgcgaattgctcgctttggtaagcaccgttgatttggccgagcaatgtttgtttgatttcatccgtaatatagccttggcttgctaattcagcataaacttcttcaccgttttcatttgcctttaaatcgcctaaaatggcaacaacagcagaagactcaacgatttgtttttgattatacgctacaggaagaagctccgcttttgattcatcgctgtggaatactgtaaaatgccaatgctgaaggttccaagcagaaggcgctttagtggcaaggtctaatagctcagtcagctcctccttagagatcggggcatttgtatcatattcctttacagatgcacgtgcttttaaaacatccagagtattcgtcatagtgtttcctccttcggataaacgtggtatgataatagaaaagttagaagcttactaaatgtaacttgaaagattattgtaatggatcattgaatacatgtcaatcaatagatgaagggatgaagacttatgggaaatacgatgtgccctaaaatggaatccgcattctcattgctgggaaaacgatggaacggtctgatcatccatgtgctaatggatgggccgaaacggtttaaagagataacggaaacaataccgatgatcagccaaaaaatgttggcagagcgcttgaaggagcttgaacaaaacgagattgtcgaacggcaggttctccctgaaacgccggtcaaagtcatctacacgctgactgaaaaaggaacagcgcttcaagctgtatttcaagaaatgcaggcatgggccgatcaattttgcgagcctggtgacacagtgtgtgaagaagagaaataaggaaagcggcacctgaaaaagagcctttgtttccatggtgagtcatgtaagtacggttcacacccgtttacatgactttttatatttgtcagactgatatttccggattggcaaaaatgtcatgtgcatatgaaggggatatataaaataggaaatgatcaataagctataacatccaacctattgtaaatggggattatgatgtatcttattatgcaaatcagcaaaattttatattttcagccaaaacccagtcagcttccaattggcatttaaaccggatataaaaggagatccaggtttttcgtattgctggatgcttctatactgatgacttccgcatttatgaaaaaagagagagcttctttggagctctctcttcttttttttgtggggagacgaaatcttatagttttccattcaaaaattgcgcctcaccgagaccgaaactccagtctgcgtcaccattctcagtaatagataccatgaggtcgtcaggggaaatttcgcattttttttctagcctttcagcaagcagagcatacaatttttccttttggctttcggttcttgctttgcttgtcatgctaatgatgaccatatccttggttctctgaaaccctaatcccgcatcctggattataagctcgtttgcgggatgctgatggacaatttgataacggtctctttccggaacaccaaatgcttcaaccatcgcttggtgagcagtatctaataacaattgcagcgatttttcatcacggccctcaattacatcaaaacgcaataatggcatgtgtactcctcctcttatgaagttgttatccgtctgttctcatattgtctcatttgcttccagacaatggagagatataatgattggcagtcaactttaaaaaacataacatataaccaaaagttaatcaacatataactaataaatcattgggttaggcggtaggtaatcgagacaagctcataaaaacgattgacagtcattgattaggagattagtatgaacatattagttgatcaaaagataacaatcatataaccaagacgtttttagttattaatgaaagcgctttctgttcatctaggcatgaaaagcgccaaaacattgtcgcgagaatcatataaaacacttttggaggggtaccatgccgattttaattgtagctgtcggagtgctgattctgttatttctcattattaaagtaaaattaaatacctttgtctcactgattgtcgtttcatttttagtagccatcggacttggaatggatatcaataaaattgttctttcaattgagactggaattggcgggcagctggggcatttagctttagtgtttggacttggcgcgatgcttgggaggcttgtctcagatgctgggggcggctaccggatcgccattacgctgattgacaaattcgggaggaaacgaatacaggcggcggttgtggttgcctcttttatcatcgggattgccctattttttgaagtcggtcttgttctgttgataccgattgtttacgcgattgctaaagaattaaaaatgccttttctgtatctgggaatcccgatggccgccgccttaaatgttactcacggatttttgcccccgcatcctgctccaactgctatctcagttgcatatggtgcccatattggccaggtgctgctttttggaatcatcatcgctgttccgacaactgtgattgccgggcctttatttaataaatttgcgatgaaacggtttcctggtgcgtatcaaaagcatggaaacctatcggggttaggaccaaggaaagaatttcagctggatgaaacaccgggctttgcgatcagtgctgtcacgtctttattcccggttatctttatggcaatggcaacaattttttctttattattgagtgaacattcaaaaggaaaagacattatagaatttatcggcactccgggaacggcaatgctcatttcgctgttgcttgcactctatacgatgggatatgcccgtaaaatatctatgcaggaaatcggcagatctatttcagaatcaatttcgcaaattgcgatgatgctgctcatcataggagggggaggagcgtttaaacaggtgctgattgacggcggagtcggcgattatgtcgctgattttttccgtcaaacaaacatgtcgccgctattcgttgcatggaccatcgccgcggttctgcgtctgtgtctaggctctgctaccgtggctgcgcttaccacagcgggaatggcagctccgcttatggaggctggcagtgtaaaccctgcgttaatggtgcttgcaacaggagccggcagtgtcattgcgtgtcatgtaaatgatgcaggattttggatggtaaaggaatttttcggcttgagcatgaaagaaacatttcaaacctggacgctgcttacaacagttctttcggttacagggctcggctgtgtgttattggcagggcttgtgatgtaacaatcatagacagtccgtagcccaatcgtttttcttccttgctgaatactttacgtataggcagacataaaggaggaaaaaatcatgtaccctcatcattcgtatttacgcggaatcccaggtccagccggatatccggcgcgtagtcctttttgtttggcgctcctctagtcggcggtttattaggcggttttctcgggagtgcgctgtttaactattctcgtccctatgcctatcctcctggcccttatggatatggaggcggaccgtacggttttggtgccggcgtgccatacggggggatatcccggcttctattaataaaaaacggcctgcatcgattgcaggccgttttttatcggatgatttctacctcggacatattgtagtcttgctgcttttgaaacatgacttccagaaggccatccttatagacggcttttgttcctttgcgtttgactaaacaaggaaggtttacttttttcggatgatctgctcttgggaggttttccaaccataattcgtgagatgtgtgtttgattctcacttgttccagccattcttcgctgattggcacctttacaaacacatggtctgctgtttcgaatatatcaatatcaggtttgacatcaggttttgcatcaggtttggcgggatgttctttttgggggagaggatcgcggaaaggaaattgagccgcataatcactgccgaacacactttccatcacacgattgacatacgtttcaacttctttcggatcagctttttttaatgcttctttagaaaattgattgtggaaaggaaagtacttgttccactcaaacattgtcttcacatcctttcttcacggacaaaatagtatatgcccaccagatctttcacgtgatataatataagatgctctaaagaaaggcagggatatcaatgcaacatgcagaaacaaaaaaaggcgttatttacacagccgtttcatttatcatgtggggcctgtttccgctctattggaagcttctcgaacagctgccggctcttgatattttggctcatcgtattatatggtcttttgtttttatgtgtatcgtactttttttcttgcggcaatggaaaataggatggcaggagttgcgctctctgaaaaagaacggagggatcctctctttatttcttgcttctatcctgatttcgatcaactggtttgtatacatatgggctgtcaaccatggctttttgcttgaggctagtcttggctattacattaatccgcttgtatcagtgctccttgggattttatttttaaaggaaaaactgaatcgcctgcaattagtggccgtttcgattgcggcagccggtgtcatcatctcggcgttccaatacggctccattccttatgttgcgcttctgctcgcattcagctttgggctgtacgggttaagcaaaaaaagaacaagcctgccgagcgccatcggtttaacgctggaaacattcatgattatgcccattgcattggggtatttgctgttcagcggacatgttcagccagcgggtgcagaaagcggagggacgtggctgcttctctttttggccggtgtgtttacggctttgccgctcttattgtttgcggaaggagcgaaacggctgccactgtatcaagtcggtatcttacaatatattgcgccgaccattaccctgctgatcgggctgtttgtttaccatgagccattttcaagctcgaaggcttttacattcagctgtatatgggctgcgctgctcttgtttacgttttcacaagtgaagtggaaacgggcgtcaaaaagccattgaggcctttggcttttcagctgatgcatatattatgtataatcatttcatgtatgtaagacataaaggagcaagacgatggacaatgataaagagatagtgaaagcctatgcttcactttggaataaccgatctctcgcacatgatgacgcagaagcggtagcagaggcgattgatcttgagctcttggataaacgaacacatccaagactccgaaaaccgatgctggaaaaatattttgccgcgattcagcgcattgtgaattcacagctcgaaccggctgtgaaatatcagctggtcaaattacatacagaacgtgcagagtatttaaaagaagaaagaggggagcaatcatgaaagcgatcataaaagaagatgtgcaagcatctttagaacgatatgcggaccgccctgtatatatccatttagaaaccaccacaggttcttattcagcgcacttaaatgaaaagaacatgacggttgttgcgtatattcgcaatgcaaaagtcacttatcatcaggcaaaaatcaaaggcaacgggccttaccgcgttggcttgaaaacagaagaaggctggatttatgctgaaggcttgactgaatacacggtagatgaagaaaaccgtttattaatggcgggacacctgccgggcggtaaactggctatttctctgcaaatcagcgaaaaaccgttcacagtttaaagaaaagggtgaataataatgaaagaacatgtactagtaatcctgcctcaccctgatgatgaatcatatggagtggcaggcctcattgccttaaacagaaaaaaagacattcccgttacgtatgcctgcgccactttaggtgaaatgggcagaaatatgggcgatccatttttcgcgaatcgggaaacgttgccgctgctaagaaaacaagagctcatcaacgcttgcaaagaaatggatatcaatgaccttcggatgcttggactccgtgacaaaacgctcgaatttgaagacgatgagtatttagctgatatcatggaagagatcatagatgatgtaaaaccaagtttaattgtcacattttatcccggacacggtgtgcaccctgaccatgatgcatgcggggaagcggttatccgtgcattataccgcaaaaagaaagaagaccgtccgcgtacaatctgcatggccattacccgcaacagagaagaggttctcggcgaagctgatgtcgtacttgatatcaaagaagtagctgatattaaaatgaatgcgttaagagctcaccgcacacaaacagaaggcatgctcagagagcttgaagagaaattgaaaaataatgaacctgttatggcaacatggtttgaagaagaaatatattggacgtatcaatggaatgattaatcaaaaaggtataaggccttaagccttataccttttttaattttaagtccgatgcaatagctgaagcgagagtggatctcaaggaaataccttcgaaagacaaacctagctgaaccgctgtttgcgcgatttccggacggattccagacaaagttgaagaaacaccgattaaacgaagcgcctcaatcagactgaacagctgatgggcaaccatcgtatcaatcacagctactcctgacaaatcaatatacagttgtgtcaccttttttttcgcacattgatgcagtgtgttttccataatcagcttggcgcggactgtatcaatatctccgattaaaggcagcagtccgacgctgtgaaacagcacgatgaccggagcgctcaattcagtaatcatatctttttgggcctgaagctgaaggcttgtgtttttgtacatttcttctataaaaatatgaatcacaagatcaaacgcttttataagggcgtgatacaggtcttcggcttcttcgcttttcacagtattctgattgagatggacaaattctttcacataagaaacatataaatctctcactctgacaaactcccgaataatatagtggataggagtttttaaatgctcttgatcctgtgtgacttcaaaggcccattctttcagtataggcaagtatacgtcctcatcatctataaaaatacggtttattttatagttaaaggcaagattctggctctttaaattgtgaatgacaacagggtctgttgaggcataaatggaattgggatcagtctcctcgattgtttcataccatgttgaactgatggtttccgcatgctgggaaagatactcgaataatttttgttttttgccatgattgatcacctcttttaaatgtgttgtttttgcgaataacgtttttgcagttttgccagcctgaaaaacagcccaactgctccggcggcgagtcccgctattaatccaatccaatagccgaatgcaccgaggcttgtaaacgtaccgaccatataaccgaccggaaggccaatgacccagtaagagacaaaagcggccgcaagcgtatagttcacatctttgtaccctctgagtgctccctggatcggtgcggcaacagcatcggaaagctgaaaaaatagcgcataaattaaaaagtgctgtgtcagccggagcacatcggggtcagaagtgtacatgcccgcaatttgctctctgaataaaaggatacaggcggcagtgaacaaagaaaagccgatcgccatcatgatgccgattaagctatatgagcgtgcatccttaaaacgggctgcacccgcttcaaatccgacaacaattgttagagccatggacacgctaagcggcagcatatataaaagagacgcaaaattcatggctgcctggtgggacgcgatggtcactgtatgaaaatggctcatgagaagcgtgacagctgcgaaaatgctcgtttcaaaaaacacggcgaacccaataggcagcccgattttgagcaaatttttgcatgctttccaagagaacttatacatggtaagaaaaatcccgtattcagaaaacggtgcgtttttatgaataatgaaaaaactgatgatgcatatacaccagtaagttaacgcggatgccagtcccgcgcctacacctccaagtgccggcattccgaacttcccgaagataaatacataattcaatacaaaattgattggaagagaactgagtgtaatcatcatggtgactctcgtttttcctaatgagtcgatgaatgatctcaacacggtgtaaacaaataaagggaaaattcccagtgataaaaagcctaaaaagtgtttagcaatctgatgcacgtgaatatcaaggttcaatcggccaagaataaggtcaactgcagcatatccaatcactaaaacggcgatgctaagaagcgcggccacgtatacagcttgtaaaacagtaaagggaatcttctgttttttctctgcacctaataactgagcgacaatcggggtgaccgccattaatatacctgcaagtcctgtgtaaacaggggtccaaaggcttgagccaatggcgacaccagctaaatcagcggggctgactttccctgacatcacagtatctagaaaagtgatcagagaaagccccgcttgggtaatgaatatcggtattaaaatgtgcaagagctgtttgattttttcccgggcgttttgagtttctttcatacattgatctccgtttctttttcataacgagagaaattataacattttatgtataaaaagcaatgaacgccgggcctattctttttttgtcggtttcgtttttctaaacatttgggcataaataaaagaaagcgaaatcacgcctaaaaaggtgcaaatatactgaatgattctttcgatttccattctttacatccctcctttaccaatagaatgtgcatcaataagataagcattcgtgaaaagttggaaatttaaacaggagatgaaggctatgcgctatgagcagatatcagaaaatgcgttcaaggggaaaatacaggtgtacttagagcaaatattaggtgatgcatctctaatcttgaaaacgcttcacgaaaaagaccagtgtctcctttgtgaattagatgatttggggcacgtttttcaggacatgcaggggattgcatcctccttttatttgcaatcatacattgaggaatttacgccggcatttattgagctggccaaggcgattaaagccttatcggaacataagcatggagctttaattgtgattgaaagagcagacccggttgaacgttttattcaaaaaggcacctccctacacgccgagatcagctcttcattaattgaaagcatcttttttcccggaaaccctcttcatgacggcgctttattagtgagggaaaacaaactcgtgtcagcagccaatgtgctcccgctgacgacgaaggaagtggatatccatttgggaacccggcaccgggcggctcttggtatgtcgggctatacggatgcactggtgctcgtggtttcagaggaaacagggaagatgtcgtttgccaaagacggtgtattatatccgttaatttcaccaagaacgtaaaaataataaaaagggcctgattaagaatcctatcatgagacaaaatgactgaattcgcatctttattaaagcattcgcttcaagctgaatgctttttgtcttgaagacagggaatataaactggtagaaaagttatatatgatgaatattaattaagtgaaatactttacctgtttatgcatttatagtaccgtataaaatattacataaattctcaaaggaagggtgctgccgcatggctaatgtattaatgatcggtttccccggtgaagggcatattaatccctctatcggtgtgatgaaggagctgaaatcccggggagaaaacattacgtactacgcagtgaaggaatataaagaaaaaatcacagctcttgatatagagtttcgtgagtatcatgatttcagaggagattacttcgggaaaaacgcaaccggcgatgaagaaagagatttcacagaaatgctctgcgcttttttgaaagcctgtaaggatatcgcgactcatatttatgaggaagtcaaacatgaatcgtatgattatgtcatatatgatcaccatcttctcgcgggtaaagtcattgccaacatgctgaagctgccaagattttcattgtgtacaacctttgcgatgaatgaggaatttgcgaaggaaatgatgggagcgtacatgaaaggatcacttgaagattcgcctcattatgaatcataccagcagcttgcagaaacgttaaatgctgattttcaagcagagatcaagaagccatttgatgtttttttagctgatggtgacttgacaatcgtctttacatcaaggggatttcagccactggctgagcaatttggcgagcgatatgtatttgtcggtccttccattacagaaagagccggaaacaatgatttcccatttgatcagattgacaatgaaaacgtgctgtttatttcaatgggaaccatttttaataatcaaaagcagttttttaatcaatgccttgaagtgtgtaaggactttgacggtaaagttgtgctttccatcggcaagcatattaaaacaagtgagttaaacgacattccggagaatttcattgtacgcccgtatgtccctcagcttgagatcttgaaaagagccagcttatttgtgacccacggcggaatgaacagcacaagtgaaggtttgtattttgaaaccccgctcgttgtcattccgatgggaggcgaccaatttgttgtcgcagatcaggtagaaaaagtcggcgcaggaaaagtaattaaaaaggaagaattgtctgaaagcctactgaaagagacgatacaagaagtaatgaataatcgttcgtatgctgaaaaggcaaaagaaattggacaatcactgaaagcggcaggcggctctaaaaaagcagccgacagcattcttgaagctgtaaaacaaaaaactcaatcagcaaatgcatagtgtaaaagcctgttcttatcgaaagaacaggctttttgccatttcataagaatgcagaggaagggatttgacacgccgatagagaattgattagaaaaatagacaagaaaggaggagaaactgcttcgttcatcaatagaaaaccatcatttttaccctcgcttaaatagttccttagactttcgaaaaacatatcgtgcttatgtaaaatgttagatgtttatttgaaggtttaaaggtcgaacgatgctgaaaatgctgcgccaaatgtttgaaaagggtttaacttgctgaaaaattgacgataaaacagttgtgtgccatttttggaaacaaaatactagctgtttttgcaaaaaaacagtttaggaggttgaatgaatgaaaaagaagattgtagccggcttggctgtttctgcagttgttgggtcgtcgatggccgcagcacccgcggaagcaaaaacgataaaagtaaaaagcggtgactctctttggaaactttcccgccagtatgatacgacaatatcagctctgaaatccgaaaacaaattgaaatcaacggtgctttatgtcggacaaagtcttaaggttcctgaaagcagcaaaaaaagcacgacatccccatctaattcaagcaaaacatcaacatacacagttgcatatggtgattccctatggatgattgctaaaaatcataaaatgagtgtttctgagcttaaaagcttaaacagcctgagcagtgacctgattcgtccggggcaaaagcttaagatcaaagggacaagcagttcaagcggatcaaatggatcaaagaaaaacagcggttccaattcttcaggttcttcaaaaagtacatatacggtcaagcttggtgactcactgtggaaaatcgcaaacagcttaaatatgactgtagccgaattaaaaaccttaaatggcttaacatcagatacactttatcctaaacaggtgctcaaaataaaaggaagcagttcacctaagaacggaaacagcggttccaaaaagccgtcaaactccaatccctcaaaaacaacgacgtacaaggtaaaagcaggcgattcgctgtggaaaattgcaaatcggctcggagtcactgtccaaagcatccgtgataaaaacaatttatcatcggatgtgttgcaaatcgggcaggttctgactatttcgggagcatcaaaatctaatccttcaaatccgacaaagccaacaaagccaaaagataactcagggtcaaacattcaaataggttcgaagattgacagaatgataacggaagcgaaaaaatatgtcggagtgccttaccgatggggcggaaacacgcctgccggttttgattgcagcggcttcatttattacctcattaataatgtatcatctatatcaagattgagtacggcagggtattggaatgtcatgcagaaagtcagccagccgtcagtaggagactttgtcttctttaccacatataaatccggcccgtctcacatggggatttatctaggcggcggtgattttattcatgcaagctcatcgggcgtcgacatttccaatctcagcaattcgtattggaaacagcggtacttgggcgcaagaagttatttttaaaaatgagtatgacaaaaagccttttataggcttttttgtttataccagacaatgattgaccacactgttagaaaaaacaagggggagacagtatgcaccgtctcttgctgttgatgatgctgacggcactgggagttgccggatgcggacaaaaaaacctccagaccctcctaaccgggtgccggaaaaaaagtggttgaaacgtcagcgtttggtcatcatgtccagctggtcaatcgtgaagggaaagcagtcggttttatagagatcaaagaatcagatgatgaaggcctcgatattcatatttccgcaaacagcctgcgtccaggtgcttctctcggttttcatatttatgagaaaggttcttgtgtcaggccggattttgaatcagcgggcggtccctttaatccactgaacaaagaacacggctttaataatccgatggggcatcatgccggagatctgccgaaccttgaagtcggtgctgatggaaaggtagatgtcataatgaatgcgcctgacacttcactgaaaaaaggaagtaaactaaatattctcgacgaggacggaagtgcatttattattcatgaacaagcggacgattatctgacaaacccaagcggcaattccggtgcgcgtattgtctgcggagcccttttgggaaataacgagaagcagtaatatcatccaggcccttttgtattgagcatacaggggcttttttagtatactcgttaatggaatatgaataggaaagggaatctgtctatgacaactcaactacagcacttaacattgccggaagatatacaacaaaagcttttatcatataaagagcagcctatttccccagagtttcaatcgcttataggaacatcaggctatgaggcggaggatgaagccattttatttgacgccattattgcattagccatggggaaaaatgtcctgctgaaagggcctacaggttcaggaaaaacaaagctggcagaaacattgtccagctattttcataaaccgatgcacagcgtcaactgttcagtcgacttggacgctgaggcattggtcggttataaaacgattgaaaatcaatctggccaggcaacaatcgagtttgtttcaggacctgttacaaaggcaatgaaggaaggccattttctttatatagatgaaatcaatatggcgaagccggaaacactgcctattctaaacggtgtattagattacagaaaaatgatgacaaatccgtttacaggcgaggtcatacgggctaaaagcggtttcggagtcattgcagccatcaatgaaggctatgtcggaactgttcctctgaatgaagcgttgaaaaaccgttttgtcatcattgatgtgccttatattaaaggcgagctgctgaaacaagtgctcatgtctcagtcagccttgaaagacgagaaattgattgacagatttatcacgctttcctctgacttgatcgttcaggccaataacggacaggtgtctgaagaagcggcatccatcagagctttaatcgatacatgtgatttagctgcttatattccgccgcgtcgtgccattgagcggggaattgtagaaaagcttgatgatgatcgggaaaaagcggctgtccgaaatattgcagaaactctgtttgaatgagggggctgcgatgaaatttatcaaatttaacgacagcacgattgattcatttttatttatgatgctgactgatttggccaaaacactcaccaagagtgaagcggtagaagtggagtatggcgttcagtcctattacaatccatttgaaaagaaaatctatatgagccacttttggaaagacagggcagctgaggacatggaagcgggtctgaaaagcgacgtctacctgcgttcagtcggaacaagatatagctcgctgcatgagtttgcgaactttttgaatgatatccatcgccatcttacgtttaaaagttttgccaagcagctctttatgctgcttgaagacattaggatcgaagaatgcatcaaacgtgagcgcccgggtacgaaacatgtatttgcgaagcgaaaagacatgtacagaaaacatttctcaacccagctgaccttaaatttggaacgaagcatttttaccgatgcgctcttttgcgcgatctatttcaagctcacagcggaatcgccgctcgagacccttccatccatgcgtgaagatatcgatctgatgcgcccgtttattgagcagcagctcttgcgtgtgtatgaagcagattcgacacggcaggttctgaaaattgttgaggacctcatggacggacttgaagaggtactcgataaagacatgttgaacacctacttctttttgcctgagcttgattacgcaaaagctgcagaacagccgttatttgaagaagagaaaaaagcgccgaagctgagtgatgacatcacgcttccaaaacaatcagacggtgatgaggatatccatgaagaagaaatgccgacatggcaccgggaaacagaagcaccgtctaaaagcttccttcaatttgatattgaacacggcgcaaaatcagatttaggaaaagatgcttcaagggaaggcgacgatggagatcaggcccttggctctgttcaaggatcagccagacaaacgaaacggaaagactattccaagctggaagcgctggagtcccaaaaagaccagccgaacggagcgggtatggctgacggcaaagaaaataaatatgcatttccaatttataaagaaccgcagccggcaaccagtgaagaagagctttcttataaacagcaggcaaaaacgattgaatcgtatcaaaagcgtttgaaacaaatgattcaaaaaacgctggagcataaaaaaacattgccgagaacagaccttcatgccgggagactgaacaataagcttcttcgttacttcactgagcgaaatccgcgcctgttctacaaaaagcaagaaccatcttcagaaatcgacgcagtttttacattgctggtcgattgttccgccagcatgttcgacaaaatggacgaaacaaaacgaggaatcgtgctgtttcacgaagcgttgaaatcggtagcggttccgcatcagattgtcggtttttgggaggacacaaatgatgcaaccgaaaaaagccagccaaactatttcaatacggttattcccttccaatcatcattaagacaagattctggaccggccattatgcagcttgagccagaagaagataaccgtgacgggtacgcaattaggcagatgacgaaaaaaatgctgcatcgcagcgaggcgcaaaagttcttaattgttttctcagatggagagccggccgcatttggctacgaacaaaatgggatcgttgatacaagtgaggcggttatcgaagcccgaaaaagaggaatagaagtgataaatgtttttctctccaactcagaaatagaagaatcgcaaatgaagacgatccaggatatgtacggaaaattcagtatatttgtcccggatgttgatcagctaccggatgttttgtatccgctgctgaaaaaactgcttcataaaagcataggatagcccttaatcctatgctttttggcgtttgttttttcgaatgattaaatttttgttttttataaaggttttttactattttgtgaacaatcaaggtagaatcaaattgcaaacagtggtaaaatatcgttggaagcgtttttattacataattttggacacagcgttcgaaagttatttcaagatagtgaatcaatcacttgattatttaagttgggggtaatattcaaatgtttcaaaatagtatgaaacaacgaatgaattgggaagatttttacggtccgaacctcggctatgcgctggagctttacgatcagtatacccaggatccgaacagcattgacccggatttgaaggaaatgttcgacgagctcggtgctccgccaagcgatataaaagaggcctcgggaacaaaagaaaagggacgtgttacagccgatctgattcaaaagatcgcatccgcagtcagacttgcagaagatatccgaacctatggccatttgaacgcttccgtcaatccgctcagaaaggatgagaaaaagagcgaactttttccattatccgattacgggctaacagaagaggaaataaaagcaatacctgcgtctgtcatctgcaaagacgctcctaaaaacatttcgaacggtttagaagccattcagtatttacgaaatacgtataaaagaaccatctcttttgaatttgaccatgtgcatgacttcaaagagcgcgagtggctgacaagaaagattgaatctggcgagctgttccagaagaactcagctgaaaagctgtcagctgtgctggaaagattgacagaagtagagggctttgagcagtttttgcaccgcacattcgtcgggcagaagcgcttttccattgagggtctggacgctcttgttccagtgcttgatgacattattgcacaatctgtcaaatcaggcacgacaagtgtcaacatcgggatggcgcacaggggacgcctgaatgtcttggcacatgtgctcggcaaaccgtatgaaatcatcttctctgaattccagcatgcgccgaacaaagatcttgtaccgtctgagggatccattggaatcagctacggatggacgggggatgtcaaataccatttgggggcgaatcgggagcttcaagacgctgaaacaaaatcagcgcgcattacgttagcgaacaacccgagccacttggaatttatcaatccgattgttgaaggcagcacaagagcggcacaggaaacgcgaacacaaagcggatacccggtacaagatgaaacaaaatcgctggccattttaatccatggagacgctgcattccctggggaaggaattgtagctgaaacattgaatttaagctctttaaaagggtatcaagtaggcggtgcgattcatattatcgccaataacatgatcggattcacaacagaaagcgctgaatccagatcgacaaaatatgccagcgacctggccaagggttatgaaattccgattgttcacgtgaatgcggacgatcctgaagcttgtctttcagctgttaagtttgcggtcgaataccgaaaaacattcaacaaggattttctgattgatttgatcgggtacagacgctatggacacaacgaaatggatgaaccgtcaaccactcagccaatgctgtatgatgctgtcagaaagcatccgaccgtcaaacaaattttcgctgaaaagctggtaaaagaaggcgtggttaccgaggaagtcgttcaaaacatcgaaaaatcggtaacgaagcgcattgaggatgcatatcagaaagttccgtctaaaaaggaacacactgcttgtgaaattgaacttccagagcctgtatcaaacggtttcccagatgtggacacttcgattgattttgatgtgctccgcaagctgaatggcgaattgatcaactggccggagtcatttaatgttttcggcaagctaaagcgcattttagaaagacgcgccaaggcgttcgatgatgacagaaaagtggaatggtctttggcagaatcactcgcgtttgcttcaattttgaaagacggaacaccgattcgtttaacaggacaggattccgagcgcggaacgttcgcccaaagaaaccttgtgcttcatgacagtgagacgggcaaagaatttgtgccgcttcatcacttatctgactgcagcacatcatttgctgttcataacagcccgctgtctgaaggatcggttctcggttttgaatacggctataacgtgcattcaccggaaacgcttgttttgtgggaagcacagtacggagattttgccaacgctgctcaagtgtattttgaccaatttatttctgccggacgcgcgaaatggggccaaaaatccggattagtcatgctgctcccgcacggttacgagggacaggggcctgagcactcaagcggaagaattgagcgattcctgcagcttgcagcggaaaacaactggacggttgccaacctgacaagcgcggcacagtatttccatattttaagaagacaggctaaaatgctgcttcgtgaagaaatcagaccgctcgtcattatgacgccgaagagccttcttcgcaacccaaatacggtgtcggaagtgcaggagctcagcgaaagccgcttccagcctgtttatgaacagtcgggactttctcatgactatgaaaaagtaaccagacttgtattatccagcggtaaagtgtctatagacattagcgatcattttaataagttagaagacggtaaagagtggcttcacattgcgagaatcgaacagctgtatccattcccggcaaaaggagtcaaagaattatttgcaaaacttccgaacctgaaagaaatcgtttgggtgcaggaagagccgcagaacatgggggcttggggttatatcagcccgtatttgacagagattgcaccagagggagtaagcgttcaatatattggacgaagaagacgatccagccctgcagagggagatccgacagttcataaaaaagaacaggaacgtattgtatctgatagcttgactcgcaaaaactaagggggaaatgaaaaaatggcggaaattaaggtacctgaattagcagaatcaatctcagaaggaacaatagcccaatggttaaagcagcctggtgactatgtagaacagggtgaatatctgcttgaactagaaacggataaagtgaatgttgaattgacagcagaagaatcgggtgtacttcaagaggtattgaaagattcgggtgataccgtccaggtcggagaaattatcggtacgatttcagaaggcgcgggtgaaagttctgcccctgctcctacagagaaaacagaaagcaaggaaagcgtaaaagaagagaaacaggctgaaccagctgcacaagaggtgagcgaggaagcacaatctgaagcaaaatcaagaacgatcgcttctccgtcggcccgtaagcttgcgagagaaaaaggaattgacctgtctcaagttccaactggagatccgcttggaagagtgcgcaagcaggatgtcgaagcgtacgaaaaaccggcatcaaaaccggctcctcagcaaaagcagcagcctcaggctcaaaaagcacagcaaagctttgacaaacctgttgaagtgcaaaaaatgtcacgccgcagacaaacgattgcaaaacgccttgtagaggtacagcaaacatcagcgatgctgactacatttaatgaagtggacatgacggctgtcatgaatctcagaaaacgccgcaaagatcaattttttgagcaaaatgaagtgaagctcggctttatgtctttcttcacgaaagcggtcgtggctgcattgaaaaaatatccgctgttgaatgcagaaattcaaggcgatgagttgatcgttaaaaaattctacgatatcggaatcgctgttgctgctgatgaaggtcttgtcgttccggttgtacgggatgcggatcgcctgacatttgcaggaatcgaaaaagagatcggcgagcttgcgaaaaaagcaagaaacaataaattaacccttagcgagcttcagggaggctccttcacgattacaaacggagggactttcggttcattgatgtcaactccaattttaaacagcccgcaagtcggtatactgggcatgcataagattcagctgcgccctgtagccattgatgaagagcgtttcgaaaaccgtccgatgatgtatatcgctttatcttatgatcaccgaattgtagacggtaaagaagcggttggtttcctcgtgacaatcaaaaatttactggaagatcctgaacagcttttattagaaggataataaaaaagggtacatcacgataaagtgatgtaccctttttgatgcatatttaaagtgatagattgctgcttttggatccagcttgcttctttttcactttttttgaccaatatgttgcaagcatagaacctgaaaggttatgccacacactgaatattgcgcttggtacggcagatagcggtgagaaatgagccgtggcaagtgcagccccaagcccggagttttgcatgccgacttcgattgcaatcgctttttgagacgggtaatccatttttaaaagctttgcacaaagaaaccccagtaaataaccgataccgttatgcaggataacaactgaaaaaatgagcaaccccgattgaagcagattttcccgattgccgctgacgacagctgagacaatcgcaacgatgccaatgacagaaacaagcggaagggcatgtacggcttttgccacttgttttctgaaaaacattttgacaatcagacctgcaatgatcggaaataaaaccgcctgtaagattgagataaacaaagaccccggcgagacaggaagccattctttggcaaacagcataatcaacaacggtgttacaacaggtgccaataaggtagaaattgtcgtaaccgcaacagaaagggcagtatttccttttgctaagaatgtcataacattagatgcagttcccccgggacagcagccgacaagaataacaccaactgcgatttcagctggaagatgaagcccaaatgcgaggccgaaagcaacgagcggcatgatcgtatactgagctattactccaataataacttgccaaggctttctgaccagctctttgaaatcatcggcttgcagtgtaaggcccatcccaaacatgataatgccgagaaaaatcgtaatataagaactgatccacgtaaataaagatgggaaagaaaatcccagcactgcaaaaacaatgacccatatgccaaaggtttgtcctgcaaaatggcttatttttctaatgatgtccataaaaacactcctaacacacttatcaagaacttcagcagaaattcttacaaatttcataacattctcttattataaataattttctgaataattcaatattagtttttggcagatgtctatagatatatgatgtaaactaattaaaatgttcttgactatataggaagatattcttacaatgaacctttataatggttagatcaaataggagtgatacggtgaaggaagcaaatcaatggtcttcgaagctcggctttattttagccgcggcaggatcagctatcgggcttggtgcgatatggaaattcccatatgttgccggaaccagcggaggaggcgcatttttacttatttttattttatttacggttttaatcggactgcctttattgttaggtgaattcatcataggcagaagaacacagaaagatgccgttcagtcctataaaacacttgctccaggaacgaagtggcattggatcggttatttaggcatggtgacgtgctttattcttctatctttctacagtgtcgtaggcggatggattttaatttatattataaaaggcttcactggcggtttatcgcaaacatctggttttgatacgatatttgcaagtaccatttcaaatccttatttggctgtaggaggccagctgctctttatggtggtaacaattttagttgttgcaaaaggggtaagcagcggaattgaaaaagcaagccaagtattaatgccggcgctttttctattattcatcattttaatggtgcgttcggttacacttgatggcgcgatggaaggaatcaaatttttcctcatgcctgatttaactgcaattgatgccaataccattttatatgcaatgggacaatcctttttcttattaagtgtcggtgtatctgtcatggtaacgtatagcgcttatttagagaaacaggaaaatctggtacagtccgctgtatctgtaactgttatgaacatgcttgttgctgtaatggccggaattgcgatttttccagctgtattttcattcggcctcaagccagaccaaggcccggttctgttatttaacgttctgccgactgtgtttaatcaaatgccgttcggaattatctttttattagcatttttacttctatttttatttgctgcattgacatctgctttttcaatgctggaaattttggtcgcagtactgtcgaaaggcgatatcaataagagaaaacgattcgcttggttaggcggtattgctatttttattgtcggtgtgccgtctgcattatcatacggtgtcttaagtgacgtcactatatttcatctgtctatttttgatgcggctgactatcttgtgagcaatattttaatgccgttaggtgcgttactgatttcgatttttgttccgctaaaaataccgaaacaggatttgtttgacgagctgaaaagcggttccaatctcaaacgaaagtggtttgcggtttggctgctgctcattcgatatctatctcctgttgccatcatcatcgtgtttttgcatgtgataggtattttttaacacacgaagcccccgaggaaagggggctttttttaatagagcttccaaacgacttcttttgcctgctcaaaacgtttttcagcctcgcgccaatccacgacattccaccagtgatcgacatagctggcccggtcatttttgtattgcaaatagtaggcatgctcccatacgtcaagcggtaaaagggggatcacatcccattggctaaagagctggtgtttttctgccgttaaaatctccagccgtcctgatcgaggtgcccagaccagaatggcccagccgacgccttccacttttttagaggcctgggtaaaatgttctttaaaagcggaatagcttccaaatgaaaggtctatcatttggaacaatgcccctgtaggacgccgttttccgtttggatgcatagaaaaccaaaaaatactatgcaaataatggcctgctccatggaacgcaagctctctttcccaatgagtgattaagtcataattctttgtcgctctcgcttttttaagctctgattctgctttgttcaggccatcgacatagctttgatgatgttttgtatgatgaaggatcataatatcgcgtgatatataaggttctaaggcggagtatttgtaaggaagctttggcagcacgtgtttccctatagggacataagcgcgtctttcacttgtatcatctgattctgtaatatcccgataaagggcagcggcctgtttataccaatcttcttctgttgtttggtcatcttccagagcctcaatcatcttgtcgatttgatcttcaaactggtcaagctgacctcgcttttgaatctgatctttcagggcttcacaccaattgaacatctccgcttgataagattcacgtttcatttgctgtctccttttcaatagaatctaaatacttcccgacagccagcaaagagaatacatatggataactgtgatagcgaatataaaattgcttcggcaatccgatccctgctggatacgcgaggctatcggcgctatgcgaactgctgtcggtaaggtattgcatgcctttcacaacagacggatgttcggaattttcatatgtgagcaaagcgtctaaagcccaggccgtttgtacaatggttcctctatgaagcggtacatatgttttgatttcggcgcttttgcaggattctccccagcttccgtcatcattttgtatggatttgagccaacgcagagccttttgtataccgggatgctttcggtcaaccccgcatgcatgcataccagtaagagcagcccaagtgccgtaaatgtagcaaacaccccatctgccgtaccaagacccattttgttcctgatgttcgaaaagccacttcactgcgcgttgaatatgttgatgtttttctgtgaagccaactttctcgcctaaaaagtgcagtacacgtccggtgaggtcggcggttgaagggtcaactgcagcgtcctcggcggattcaagcggcagaaggcggatcagtggatggttcacatttttttcgaaagcagaaaatccgccgtcattgttttgcatcgataaaagccaagataccccccgctcccatgctgcaggagaatgattgcggggaatcgcctttaaaacggctgtagtgtcgtcacagtcagggttatttgtattaatgtttgaaaacccccagccgccaggaactgaatttggatttttgacagaccaatctgctattttggtatgctggcgttctagcaaaaagtcggctgcttttgtaacagagccatccgtttcggtcacaccatttttttgaagggcatagcttattaaagctgtatcccaaacagttgaagtagagttttccagataaggaatcccgttgcatttagtcaccagtgatttaatgccggtaatcgccctcctgataataggagaatagcgtgacacaccaagtgacagaaggctgtaaaccatatatatggttgcgctcgcatagctgtataatgttccatctttttcaatccggtccagcatatacgttttagctgtctgtaggcccagctgctgaaaagcaaatggtgcatgaaaaacgcgtttccaatgtaacaaaatagacgtgagatctctttcttcgaaagcatcagaccgaagccaagtgaaaggattttttgtcatgtgcggatcgagatggtgaagagatgaaatattgcggttaataaggacaaatcgctgattgagtgttacagccataggagcaaaatgaatacgggcatatgagctgaactgatagaaatgaatcggcaatgttggggggagcgccatgagtgataatggtaaatacaaagcaggccaaggataaagcccgttcgcggcaagcatccattttgtcataaaatgaacatgtctcaaaccgccatgtgagatgataaattgttcagctttcttcatgtgcggctcagttctgtgaaaacatcctgaagccagcatcccgacatatccttggacggtagccgttagatttccgcgcgtttcatcgggatagttgataaatgtgccgtctggctgctgttttgcatgaatgccggctgcaagggatgatatcagttctttttcattttcgccttcatctagtgaggtaaggagcaaaataaaaaaggaatttgtcatgattggtccttcaaagcaaaatgtccatgaaccatcagcattttgcctgtctcttaactcggtaatggttttcttttgaaaacgcctcactttctcctgaagtgtgcccatcacgctcaactccttcagaagcatatatattcagcgtcttttactgccattacagaaagaaaaaaactgctggcaggcagcagttttttaaacatacatgttagtcttcaaggtttacccatacacttttgacttctgtgtaattatccaaggcatatgatcccatttctcgtccgagtcctgactgtttataaccgccaaatggagacgccgcgtcaaacacattatagcagttgacccaaacggttccggcttgaagtcggtccgcgatatagtgagcctgcttgacgttctctgtccatagtccggctgcaagcccatattctgaatggtttgcccgttcaataacttcatcgactgtttcgtacggaattgcagtcagcacgggtccgaaaatttcttcttttgcgatggtcatttcgtcttcaacattcgcaaacacagtcggtgcgacaaaatatcctgcttcaaaaggacagcttccgccggtcactgcttttgctccttcatcttttcctttttgaatataggaaagaacgcgctcatgctgttccttgcttacgagaggcccgatttgagtatctttatgaagtcccgctccttggcggagtgactcagcataggatgccatttcatcaacaacttcatcatattggtctttatgaatgaagacacgtgagcccgcacagcagacttggccctggttaaacatcacaccgtttaaagcgcccgggatggctttttttaaattcgcatccggcagaagaatattaggcgattttccgcccagctccaatgtcacacgcttaatgcttttcgctgcggtggacatgattttctttccgatttcagtggaaccggtaaaggcaattttatcaaccgcttcgtggttcgtcagcgcttctcccgcatcttcaccgaatcctgggatgatgttgattacaccggcagggaaaccggcttggtcaattaattctgccaaataaagagctgaaagcggtgtttgttcagccggtttgaggacgattgtacagcctgttgcaagtgccgcgcccattttccacatcgccatcaggagcgggaaattccatggaatgatctggccgacgacaccgacaggctcatgacgcgtataattaaaataagcgccggaaaccggaatcgtctgtcctgttatttttgtacaccagccggcgtaatagcgcatatgctcaatagccagcggaatatctccattagtcgtttcattgatcggtttcccattatcaagtgtttcaagctgagcaagctcagttttatgctcttccattaagtctgccagcttatacatcagtctgcttctcgaagctggagacattgttctccattcaccttggtcaaaggctttccgggcagctttaacagctttgtccacatccgcagcctgggcttcatacagcgtcatcaaggtttcgccggtcgccgggtttggagtgtcaaaggttgcccctgaggcactcggaacaaactttccgtcaatataaagcttctttgttccctgtaaaaatgtctccagccttttcgtcacttgcatcgttaaagaactcatccgtaacaaacctccagtcattttttatggtctgttctgagattcttggtgatagcacattgattcctggattgaatagcagaaataagctgtgatagttgcttcaaacgtaagcgtatacaaacattctataatagaaatcaaggcaaaatcaatgaataaccgatattgcaatttacaaaagaaaaaagctacaataagcttatagataagaaaaggagatttcatcatgattcataaaaattggcttgaaaaagaaaccattaaaaaagtaaagtgtgtgcagacaaacgcaaaaaaatatatcgtaaaccgcgttttaacgccgggaaaagaatatgaagtaaaaaatgaaacagaggagtttctctttgtggtcgacaatacgaataaagtcggcggctattataaagaatacttcgaagagatgtaatgcttccttgaagcatcaaacagattttgttaaaagcagtcgatacataaaaccgcagctcagctgcggtttttttgtggttaaaacaggaaatataaaacaaaattaaaaaatcattaaaaaccacttttttataaaaacattgctgaatattgaaacttttttctctatatgtgcgtattacttgatgacaacagcttaaaagccaaaaaacaaatcaaaaatttgaaaaatgtaatctgttcgtaatggtttaaatgtcttctatgtcgtattcttatatagggataaaggacttatttttatgtagtgaatgataaaacaaatagataaatgcagaaagaggggttcttcattgggtattttttctgttagcagatcaacggacgcaaagaagcttgaggctttgctcgttgaaggggaaagaatagaatcgatttataagctccgagtggaccaaatttgctttacaaataagcggatcattttctttgacaataaaatgttttctaaaaagaaggttcgtgtatttcttccatataaaacaattgaaagctttgccatccaagaagcgggaatgtttgatccggacactgggcttttattgatgacaagaagcaaaactttcgaattagaatttgcgaaagacaccgatttaagcgaggttcaggcggtgctgacaaagcatttgtgcagctgaatatttgatgagccagccgttcaaaaaatggttaggctttttttatatataaaaacaagaacagggcatgtgcgccctgttcttattacaccacactgtttttcgctgagttcgaatcaacaagatctgcatctaatacatttgaaatcggcacgacaagaggagtaaagtcgccattttcttctccaaacccttgatttattttagctgataaaaagtaatcgacctgctgatacggaccgagtgttaaagaggaacctcgatccatcgtattgattttaaatccgccgacatttacgacggagggtgaaaagaacatctcatcacttccttttgattgaggagttaaccgcttcactttcaaaagaggccggagaatcaatttggtctctgtcatccacatggcttctcgtgcccataaatccgctcgcatctccaaaattctgtccgtagccttgattttttttatctgaattttgccattctgccaataaattttgtcctacgttaaccgctgaagcattttcaaaggaattaattttcagcatgaaaatattaatattgatatacggagttggttgaaccacaggcaaacctcctttctatagttgtatgctggcggttataaagtatgttaagacagggggcttcaaatggatttcgaaaagatgaagcagtggatggaattcgcacagcagatgtacggcggtgacttttggaaacaggtatttgatgaagaccaaaaaaccccttttatgacaaatggccaatctccgtttccgtttgcgcagcaagatcagcgagggaaaggagatgcttcatttccgagcatggatattgtagataccgttgcggaagtgcagtttttaatttatcttccaggctaccgtaaacaagacgttcacatattatcgtacggagattatttagtggtgaaggggcagcgcttttcctattttaatgaacaggactttcgccaaaaagaagggaaatacggaagttttgaaaagaaaattccgctttccgatcatcttcatggaaagatgaatgccatttttaaagacggaatcctatacatcactattcaaaaagacgaaggtcaagcgaaaaccattgttattgatgattgattttcatactgagtgcatctgacacatcacggtcatcaattgattcaatcggaatgaccataacaataccatctgcattttgttccccaaaaccgttatttcttttgatagcagagcacctgttccttaactccgcagaaccaaaggtaagggatgagccggtgcctatcgagttagtcttgagatgagaaatattgatgttagtcggaagcatgaaaacctctcctttctatgggatatacctcattatatatgtagacgaaagaggagtatgcaaagggtcgtgatgtcatgaaaaaaatgttccggtcgctgatcaggcattgcttgaaaccagaacttgacaaactgcgtgaatgtgaagaaagactctcagtgattgagaaacaaaaacaaagcagcaaacaagagtctgaagaaacctatatacatattgaaacgctgaatgtcgaaaaagttgactatcatcttgaattcggcgagctgaccattgatgaactgagcggcagattaaatataggcgcaacctattatataccgccagaagagaaggacaaaaagtgccaacgaaaacccgaagcaccatcgacgccagcggtcacgatccgttcaaaaaggcagtagctcatctttccatcgatgtttccatgtttgacagaaggcaaaacgggaaacaggatagaaaggagaggatatacatggcactgacaaaagaacaaacacagcatctctatcataaattgctcgatatgcaaaaagaattgtctggcgagaaaaaggaaacagaatcaatgacggaagaagtgggggagctttccaatggggttgacaaccatatggcagaccacgggacgctcgtcacagaccggatgacagaccaaacagtgaaagagattgaccgggagctgttagaggaggtcaaccgtgcattacaaaagatgaaagacggaacttatggcgtgtgtgaaaaaaccggccaagagattccttacgaaagacttgaagctgttccttatgcaagaatgacagttgaggcccaagctgatgtggaggatgatctggagacagatgctccttcttatgaaagagagtttcatgaacaggtaaaagacttatccaacaaagaaacaattgatcaaaaaagctcgcagacgtatgaaatcttggatcgtgaacaagattcgaagtaaaaatgccaagcaagtacaccgatattagatgtacttgctttttttgaaaaaaatctcatattcaaaataaagtgattgactttacgtaaaaaagaaagtaacatactatttgtaagtaaatataaaaagtttaccgggaggaatacaaatgtctacagttttatttgtaaaatcaagcgaccgtacagctgaagaaggcgtttcaactaaactttacgaagctttcttagctgcttataaagaaaacaaccctaatgatgaagtggttgaattagatcttcataaggaaaaccttccttaccttggcagagatatgattaacggaacatttaaagcaggtcaaggaatggaaatgacagaagatgagaaaaaacaagcagcaattgctgacaaatatctgaaccagtttgtaaaagctgacaaagttgttttcgcattcccgctttggaacttcacagtgccagcagtgcttcatacttatgttgattatctgtctcgcgcaggcgttacattcaaatacacacaagaaggaccagtcggtttaatgggcggcaaaaaagttgcgcttcttaacgctcgcggcggtgtctactcagaaggaccaatggctgcacttgaaatgtcattaaacttcatgaaaacagttcttggtttctggggtgttcaagacttgcacacagttgtcatcgaaggacataacgcagcacctgatcaagcgcaagaaatcgttgaaaaaggtttacaagaagcaaaagatcttgctgcaaaattctaataaagccaagactcctatcgttacaaataggagtctttttgtatatacacattaatatagaagaaaataatcattcgcttttagcaataaaggctatttttttattgtaatatattttttgtttgtcgaattgtcaggtattttggagaaaaaacagttttattcactggaaaaagtttttctaaacaattgttctgacctcttgattaaaagcgcctgatggtgtactatattaaagaagctactttgtgcgtattgttaattaagttttaacctttaagctgtaatagggagttttatatcgaagccggaatgtcatgcctccattgcagaggacgacaggaacgtttctgcaaacacccactttgaggagtggtggtttaaaactttcttacttgcatacggcaagacgtagcgaaagccatttccttttcggaaatggctttttattttatctaaaaaggtttggtatagtgaatattccatttttgtgtgaaagaaatgaaggccgcttttttatgatatgatgggagaaattcaaggaaaagcgaggtttacacgttatgttacatagagcccaatcccttctggctcattattttggttatgagaagtttcggagcggccaagatgaagcgatccgcttggtgacggaagcgaggcaaaatacggcctgcattatgccgacgggaggcggcaaatcgatttgctatcagattccggcattaatgtttgaagggacgacgatcgtcatttcaccgttgatttccttgatgaaggatcaagttgatgcgttagaagaagcggggattaacgccgcctacattaacagcacacaatccaatcaggaaatatatgagaggctgaacggactcaaagaaggggcttataagcttttttacattacaccagagcgactaacgtccatagagtttatccggattttgcagggcatagatgttcctttggtcgcaatagacgaggcgcattgtatttctcaatggggccatgatttcaggccaagctacaggaatattgaaatcttgttccgtgaattacacgacaagcctgtcatcatggcgttaacagcaacagccacacccgaggttcatgatgatatttgcaaacagctgcatattcaaaaagaaaacacggtatataccggattttcccgagagaatttaacctttaaagtagtaaaaggagaaaataaagatcggtttatagacgaatatgtgcaaaacaacaggcatgaagcaggaattgtctatacagcgaccagaaaagaagctgatcggatatatgagagattgaaacgaaatcaggtcagggcaggccggtatcatggaggtttggctgatgatgtgagaaaagagcagcaggaaagatttcttaatgatgagcttcaagtgatggtggcaacctctgcttttggaatgggtattgataaatcaaatatcagatttgttctgcatgcacaaatcccgaaagatatggaaagctattatcaagaggcaggacgagctggacgggacggtcttgccagtgaatgtgttctcctgttttcaccgcaggatattatggtgcagcgcttcttaattgagcaatcagaacatgaagagaaacaaaagcaggatttaaaaaagctgagacaaatggtcgactactgtcatacggaagattgtctgcagcgttttatccttatgtatttcggagaaaaggagcctgatgcgtgcggacagtgcggaaactgtaccgatacaagagcggcccatgacgtgacgcgggaggcgcaaatggtcttatcttgtatcattcgcatgaaagaacggtttggcaagacgatggttgcccaggtgcttgccggctccaaaaataaaaaagttcttgaaaacggcttttccgacctttcaacatacgggatattaaaacaccaatccgttggcgaaatcagtgattttatcgaatttcttatttctgacgacttcatcaggatgtcagacggaacgtttccgactctttttgtcagcagtaaaggaaggaatgtgctgaaaggagaattatcagtagcgagaaaagaagcgttaaaagcggcagcgattactgaaaatgacgagctatttgaacgattgcgcatggttcggaaagaaattgcggctgagcagggtgttccgccatttgttgttttctctgaccaaacgttaaaagaaatgtcaggaaaacagcccgtaaatgatgatgaacttttgtctataaaaggagtcggagaacaaaaaagagcaaaatacggccggctttttttacaagaaatacaggcttatgcaaggatgacagactaaaaaaacagaaaaacaatctttttttctataaaaaacacattttattttctctgtttcgcctcaaaataaaaagacctgcgaagcctattatatcaagggttcagcaagtctttccatcagagagaaatccttcatgtaaaggaactgtaatctaaatcatatctttttgttattgatttgacatttacgtgtgttacgatatcacctgttagccgccaataaaaagctaacaagggaggatttacttatgaagaagacgattatgtcctttgtggcagttgctgcactttcaacaactgcattcggagctcacgcttctgcaaaagaaattacggtgcaaaagggtgatacgctctggggaatctctcagaaaaatggagtgaacctaaaggacttaaaagaatggaacaagttaacttctgataaaatcattgcaggagaaaaactgaccatttcttcagaagaaacaaccacgactgggcaatatacaattaaagcgggagatacgctttctaagattgctcaaaaattcggcacgacagtcaacaacctgaaagtttggaataacttaagctctgacatgatctatgctggatcaactctttcagtaaaaggtcaggcaacagcagcaaacacagctactgagaatgcgcaaacaaacgcacctcaagctgcgccaaaacaagaggctgtgcaaaaagagcaacctaaacaagaagctgtacaacagcaacctaaacaagaaacaaaggctgaggcagaaacttctgttaacacagaggagaaggctgttcaatcaaatacaaataatcaagaagcttcaaaagaactaacagttactgctactgcttacactgctaacgacggcggcatttccggcgttacagctacaggcattgacttaaataagaacccgaacgcgaaagttattgcggttgatcctaatgtaattccgctaggttctaaagtctatgttgaaggctacggggaagcaacagcagcagacactggcggcgctattaaaggaaataaaatcgacgtatttgtaccaagtaaaagtgatgcttctaattggggcgtcaaaactgtaagtgttaaagtcttaaactaataatatagattgtgataaaagacataagcttttggcttgtgtctttttttgttctgcttagagctgtttatatcatatgctgataaaagaaagtggtcccgtttttctttatgtgcgattcaggggctctcgggttaaaagattgattccacattacagagacattcggcatcatgacatttatagctggttgttactatctttgatcagcgaaacgagctggtgtttttggcagataataagcagttggatgtagcagataccatttacggaatcggattgatttcagacggttttttattgtgatattaggctcttgcagttgggcatggcagcttcgggagcgaagtggcacaactttgtcatactgaaaaatacaatataatcaatatcagaaattctgctgatgtgcaatggccgaccattttaacagggatatcattcaatccagtcttttattgggctgttaaccaaacaatcgttcagcgggcgtaggagcgaggatatggatcaatttaattctggttgcgacgaggttctcaaacgggaatttcaggttaacaaaaaggatcctggcagatgccaagatccttttttatttaaaccagcctttttcttttgaccgggtaatggcttcaattcgatttttcacttcaagcttttctagaatcattgagatataattccgcaccgtcccgcttttgatgctgagttcctgagcgatttcttttgtgtttttaccgtcagccacaagttcgagcacttctttttctctatctgtaagagggttagcttcgctgtataagtcctccatcagttcaggtgcatagatgcgttttccgttcatgacgctacggatggcgttggccagctcttcactcggactgtcttttaacaaatagcctttaacgccagctttaatagctctctgaaagtaaccgggtctggcgaaggtggttaagatgataattttgcagcctgtatcttttagctcctcagcagcttcaagccctgtttttccgggcatttcaatgtccataatacatacatcaggctggcgttttttgacaaaatcaacagcatcttggccggttgtacctttgcctacgacttccatatcgtcttcgaggtttagaagtgatcctaaagcgcccagcagcatttgctgatcttctgcaataaatatactaatcatataagccatcctttatgtttattttgaattattaggaattgccatggtaagcttggtcccgttttcggtatcgatgtgaaggcttccgtttgcaaactcaagccgttctctcatcccgagtaagccatgtccttttgaaaaggaattttcttctcctttgaatgttccatcgtcagacactgtaatcacaacttccttccagagctgctgaatgtcaactcggcaagttttagcctggctgtgtttgacgacatttgtgacagcttcctttaagcacatgctcaaaatgttttcattcagcaatgagatattctcgggccatttctcttcttcatagataaacataatgtcagctgcttcgagaatttgtttgatgttgatcaattcatccttgagccggatgcccttcatagaggaaacgatttttcttacttcatttaaagaagttcgcgctgtttgctgaacacttttcagttcacgagctgcttgttcgggatctttgtatatcaattttcttgctaagtcgctttttaaaccaataagagaaagcttttgcccaagcgtatcatggagatcgcgggcaattcgctgacgttcttctaattttaccagttctgcaatccgttcatttgcatcctcgagcttttcttcaagtcgttcgcgctccttgcggctttttatactgaagggcaataaaattgcgctgatgagggtaataacgacaaaaggaatttgtgtcagaaagaattccttttttaatacgagactgaaattggctgcgacggccgcgcttattaaatggacataatataaaatatgaaaagggacgcgttccttaatgtttccaataaaataagcaataaagaaagcaaaataaatataactgaacagagtaatggaggcggttgaaatgccaattaataaaaatccccacaaataaatggtccagccttttgagacaaaagcaaatcgatataccgaaaaaaataaaagcgtcaaaatgatgccgacaataataacaaatgtagatgatgatttccatataaagtagaaggggaggatgaaaaatatcgtccatatatagggcgtaatcccgtttagtttttgaaatgtaaaatgatttttaatcatgatcttacctcattttcagcttttcatcttacttgtaactttatcattgtgaaagccagaatgcaccctccaacaataaaaaggaagccttctagtatattagaagacctcctttatcatcaggcattcttccgcagcttctgtttttctggtgaatcaggcggaaggcttacaggtatatgttttatagcccgaaatgacacaaactgtttgttatcttcatcccatagacggaacgcaagtgattgcaggcttgtttttaaggtgattgtcggtacgttttttaatggttcgtgatgttcatgagcaacttcaagcttatagttaggcacctttggactcaaatgatgaacgtggtggtaaccaatattgcctgttagccattgaagcagtttcgggagtttataaaatgagctgccttcaacagcagcctgaacgtagctccagttttcatccgcttcaaaataagaatcttcaaaggtatgctgcacataaaacagccaaacaccgattgaacctgaaatcagaaatatcgggccttgcaccagtaaaaacgattgccagccaaagatcagacagcaagcggcagccaacgcgacaattgccagattcgtaaggtatgtgtttacacgttccttgcgtcttgcgccttttttgttaaaacggttcgtgatcagaaaaacataaatcggtccgagaataaacatgataaacgggtttctataaagtctgtatgcaagctttgttcgtctggatgcagctttatattcgtttactgttaacatccagatgtctcctgttccgcgtttatccagattgctgctagttgcatgatgaatcgaatggctgtgctgccattgaagatacgggaataaagtcaggacacctgtcagaaaaccgagaatgtggttatagcgtttttgtttgaaaaaagattgatggcagcagtcatggaagatgataaaaattcttgtcagaaaacctgcggcaatcaccgttaatgctaacgtaagaagataggagacatcgaggctgagataagcaagaaaccataggccgaagaatgggataaacgtgtttaaaagctgaatcaggctgttttttgtttcaggctgagcaaatgcagcgacttgctttgtcagctgtttttgtttatgtgcaatggtttgttcagtcatagtaagtatcctctcattgtgtgtctcggttcagtatacgctaatgagagaagtcttttgtagtagcacacatcatgcctcctatatgacatttgtcatgtctcgtgcggcatgcatagccgattgcgctaaaaaaagcttgtaaaaaaatttacaagctgattaatgtttatcaatccatattcgtgatgtacccgaaatagcttcaatcctgcatgttcctcctatagggaacgtggcaattggcgaggtatgtccggcatttatatttgcgatgatcgggatgccggataattctttttttgtttcgatcatggcttttacaagatctattgatacgtttgatgctttctgaaatctgccgatcaaaatcgcctttacatgtgaaaaagcggggaggtggatgagtgattgcagatcgcggtcaaacatatggatgtctgacatataatcatcttcaatcaataaaatagtatgttctgtttcgggaaaatactccgttccctgcagcaaattaagcgtgcataagtttccgccaattaaagtaccttccgcataaccttcttggattacaacagggccgttattaggataaaaacgcctgttttcttgatccaaaaaccagcgatcatcgctccactcacttgaggggtgaatttcaaacggatcgtctgaagcgcagcaagaaagaaaatactcctctgtataatcgagtccttttttcattgcaaatgttgagaagtggggacctgaatacgtaacaagacccgttttttgataaatagcgttgcaaagagcggttatatcggaataaccgcacagaatttttggatgtcgtttgattttctcgtaatcaagataacgcagcagctgatttgaattaaaccctccgagtgtcgttaaaatcgctttgacgcctggatcaaaaaaggcagcgtgcagatcatggactcttgactcgatagaggatgaatcaaattcgttacattcatttgcgtgttcagcgatggttacccgataacctaagcgttctaacgccgtttttgcttggatttttgcttcatttgataatatagacatgctggtcgcgggagacacgatccggatttcgtctccctttttcagttttgaggcgtacatagaaccctccatcaatggttttataccattacagcatatcttggctctttcttccagacttttttacaaatcaacccacttaatgctgccggattgggtatcatgatcgatacatactttgaagtgatgtttttcataaaagtgaatcagccggtctacatgattccaatcccgtttggcgatgtctccggtgactttcggtatattatggtctcttgcaatatcttttaaatatttcatgcaaatggagccaaacccgtgattcggagggccttttatatcccctatatgaatggcatcgtccttgtaagacgctacaagtgaaaaacagccttttcctcggtatgccgttttacaatcagttagcataattttgcatgtttggccatcatcaatcgaggaaacaatcatccactcatcatgtttcgattgatcaataccaagcactttggcatctttagataaatccttcatattctcctgcatgcgataaatttgaaattctaaatcatttagttcttcctcaagctcttgacgatttttttctttaacagtaaacaagatcaaactcctttcaaaaaacagcttagaaacacagttaccaattgtattagaagagaggcgtattgtaaacaacaattccattattactagaaattagcggaaagtcaggtttgatcgtttttaagagaggaaaaagaaaactaacctgtgaaaaaggaggaatcggaatggcgattgattcattgattaacaaattacagtatgtccaattggaaccgccggataaaattctctctctgtatctcaatacagacatgagagatccagagcagcaggggggagaatggaagattgccctaaagtcaggattcagccgattaaaagagtatttggcagctagtgatccagaggaggaaaagtgtctggatggaatcagggctaaaatgaatcaatacttgaatgcaatgggaaaagacatgccccgcagtctcgtgttttttgtttccgacagcggcatatgggaacctattaagcttcaagtccctgtagatacaagattttactgggaagaaacagctgtcctggatcagctaaagggtttgcgccagacatacccaagtacggcgtttattttaactcagcagcatgaagtgaaaattattgaaactgttttaggaaaaattgaggcggtggagcgttatgagtatgatatgatcaatgagtcttggaagaatagccattccgctgtagacaaagcgccaccatttgaagagaaccggatgagggaacatgtaacagagaaccaatcgagactgtataagcggctggctgccagccttgatcaaaaagctgccgcgaaaagatgggaacgaatggttattgccggggataaagaaacggccgatatcttggatcagcatatgaataaacccattcattcgaaaattcaaaagaacctgctgaatgaaaatgaacataaggtcattgaacatttgataaaagaggcgtaaacctaacaggccggggctaatagcctccggcctttgaagtgtgtctaatttctgacgaagcaatcgaaaccgttgacatcttctttgaatttgcatacgatttggatagccagtacaaattaggagaggtcaccaaatgaaccaaacagaaaataaaccgaaaaattacacggggattgtccttacgctgacagttctgattaacggtttaatcgcagtgctgttttttatgcctaaattagatcagttcagccatgcgaatattcacattttgccaatgctgaatgcgatattcaatagctttacgtttatcttcttattggccgcgctgattatgattaaacagaaaaatatcaaagctcacaaacgctttattttggctgcgttcacaacaacattactatttttgatttgctatgtgacgtaccactcgattgcggaaaacacgctctatggcggagaaggtattatgcgcccgatttatttctttattttaattacacatatctgcctttctgcaattattgtgccgcttgcgctgtttacgctgatcagaggcttcagcatgcaggtggagcgccataaaaaaattgcgagatggacaatgcctctatggctgtatgtaagccttacaggcgttattgtatatttgatgatttcaccgtattattaaaagccatactcagtatggctttttttacgtgtaaacatggcaaaagcccaaattcatttttgggcttttgtcagtaaattgatagactcttattcatgagccttggattccatggtttcaagtgttgcaacctgcaaagattcttcaacagtttttgttttttcttttactttttctgcatacgtataatcaccgtagcaatacggatagcggaaatttttcgcatttcccccgcaagtatacagatcaggattttttttgacttgctgctcggagtattgttttgccaattcctcagtatgcgttcctccatgttcagctacaaaatcaatgtaacctgcccccatgttgtagctttgaataatggtatccaaatccacgcctttttccttaccggtcttgtacatgagggtaaattgcttgatgccttgtttaacactgagttgagggtctgttatctcattgcgttttaaccccagagattcagaggactgcatgggatcattgccttttccttttgactcctgatacatcatgcctaatatgagtgatgtataattagagagtccttggctttcaagctcttcttccaccaagggtttgtaatcggttaaacgttccaaaacaatcgttttcgtatcgatcggaagttttttgattaaatcccggttgaaaaaaagcaggaccaataaaaaagaggcgatgacaaagacaaaaatcatcataaaacccgcagcagcgaaacagccttttctctttttcttcactgtgtttcaccctcaatgtttggagcagtatgaccttttttattatgacataagagggtatatcagaccaagtaaaaacctgatttgaaacataaatttaaactatgagattgaaatggaatacaagcaggctggtttgcactcaagcgcatttgttataagataaaactatgaataaagaaaggtgatacatatgactgaatttagagaaacggaacaatcggctgctgatctggacgaggagacgctgtttctagtcgcgcaaacattcaaagcgctttcagatcctacccgaatcagaattctccatttattgtcccaaggtgagcatgcagtaaacggaattgcagaaaagctgaatttactgcaatccactgtgtcccaccagcttagattttttaaaaaatctccggcttgtcaaatcgcgcagagaaggaacatcgatttattactctccggaggatgaacatgttttagatgttcttcagcaaatgatccatcatacacagcatgattgaaaaagacatccttgcttaactcgctgttagcgggcaaggatgtctttttctttattgtattcgtgctgttcaagttcgtttctgctgagcttgatgataaaagaagaaaaaccgatataataaacggctatcagaaaacagacgccaattgtcagagggtccgttccgattgactgactgtatgatccaaggcggtttagatcaggtgaggtaagataaagctccgtcactcgatacagaaatcttgatagaaataaagttaagagaatcacctctacccaaatatgagtccgaaaatagatctttcctctgcgtttttcaaaagagatgtttttcttagcgaaaaagacaaggagccatccgccaagaatgcccaaaatgagatatccatataaaaaagggtgaatggcgctgaagattgaaagtccaaaagcaaacagcgagaaaagaatgatacgggtgaacagccagcggggcttcagcggctggtatccgatggaccttttaattttttatacagaaaaaagatgatgattatggcaggataaacgctctgaagtgtaagatgcatgatgtgaaatcccctccgttgagaagtgtatgcttatccggtcggaaatagtagctgaaataaatactgaacacaaaaaagaaggggaaacccctgttttcatagcatatgcgaggtgtattccgccgcataatagatatgcccaagctttatcaaaatgttatgattgttttgttggaaaatacaagaagaaaaggtgcgcagaatgaaactggaacgtttgttagcgatggttgtgttattgatcagcaaaaaacaagtgcaggctgcagagcttgctgagctgtttgaagtatctgtcagaacaatttaccgtgatattgagacgatcaatagggctggtattccgattgtgacctcacagggttccgggggcggaattggcatcatggaaacgtatcggcttgaaagagagtggctgaaggaggaggaattgtttgcaattgcttccgctttgcaaagcgtttcatctatgtatgaacccgtttctcacagcacagcctatcaaaaaatcaaacaccttatacctgagcaatctactcaagcatttaagcaccaaacagaaaaatggtttattgacatgacggcttggggccatactgaggatcaaaagacgctgcgcgagaaaatcagcgctgccatcgatcggttgttaacgatatcttttacatatacaagcgcaagcggggaaacactacttcgggaaactgaaccttatacattggtttgcaaggcggggcactggtatttatatgcctactgcctggtaagaaatgattttcgcttttttaaactgaaccggatgaaagatctggccatcttacatcagacatttatcagaaaagacattcagctggacactttgccatgggataagagttggtaccaaaaggaccgtttaactgaattggttattcttgttcagccgtcagcacgtcagcgtataggtgaatggttcggatatgatgtccttcactgttgtgaggaagatgaaatctgccaggcggtgatttcacttccagaagatcaatggctgatcggttttttgctccagttcggaaaggatattgaggttctgcagcctcttcatataagggataaagtaaaagaaaccattcatcacatgcaaaaaatatatgaaacctgacacactgctgtcaggtttctttgtctataatcttaaaaaaaggaggagatcgtatgggcttttcacatataacacacttagacctgaaacgatttgccggactatcacaacggacaagcaacgcactggaaatgacggaagaaaggaggattccggcactgtgggatcaattatggaagcaggatatgagcgctcttttatcacaggctgaaaaagacaagagcattattgccttatattcgaattatgaacaagagacgaatgggttttatacgttttcagtcggaacgtttcaggaatacgacgacattcttccgggaccatatgaaaatattgatttgccggcttccgcttacgccgttttcacttccagaatcggtcctattgaagagattgtgcttgaaacgtggaaggaaatttggacttgggataagcggcatctgcgcacgtttacaggtgactttgagatgtatgatcaaaatgccgcagtgccacagcgagcacaagttaacatttatgtagcgataaaaaataataaactcttgaaaaactaatggtgttagttaataataaaactaacaccattagtttttgttaggaggaataaaaagatgagaattactcagtaccaaacggtttggcagctgactttttttccagcattgtttccggttaattgctatttagtagaggaagaaaacgaagtcacccttattgatgccgcactgccaggcagctataaagggattattcaagctgtgaatcagcttggaaaaccgcttcagcatattttactgactcatgcacatggggaccatgtcggatcactggatacattggcacaaacatttccgcatgcaaaggtcatgatctcggaacgggattcattcttgctccaaggtgacacatctttgcggcaagatgagccgcagacgcctataaaaggaggtattccgaaacacatacaaacaaagcctcaccaactgctgacgggcggtgaaacaattggttctctgcttgccattccaacaccgggccatacaccgggcagcatgtcatttcttgatacaagaaacggcactttaatagcaggagatgcgtttcagttgcgcggaggaatcgctgtatcaggtcagataaaatgggcgtttccttttcccgctttcgccacatggaataaggaggaggccatcaaaagtgcacaattgctcgccgataaggcgccttcctgtctcgctgtcggacatggaaaattcctgcgatcaccttcagagcggatgagacaggcgatccaaaaagcaaagaaaggatgatgagcatgtcaccgagaataggtttgacccaaaaaatgattgtagacgctgcagcagagattgccgatcaggaaggggtaaatggtgtctcacttgctgcactttctaaaaaaatgaatgttcgccccccgtcattgtataaccatatcaacgggctgcaagcgatcagagcagaacttgctgtcagaggactgacaaagctttttgatcaaatggcggactccgtaaccgaacgaaagggagattccgcgatgctttctttagctcatgcatatgttgattttgcaattgaaaatcccggatattatgaagcggctcttcttaaggttcacgacaaacggacggaaatcgtctctgaccaaattgtctgtcttgtgacgaagctgctcattgaaaacggctatgcaagtgaaaagactgccattcatgcgacaagggggctcagaagtctgctgcatggctttactgttttaatcgcaaaagaagcatttgaacgtgaggaggacattttagaaagcctgtcattttcaattcggacatttttgtcaggattattaataaacaataaaaatattatgtaaacaaataaatggatgtcttatatttctgaatattgtataatatcaagggagtatacataggggagaggcattatgcaatggatgacattcgcaagattgaacgattagcggcagcttcatggccggcttattttcaaaaaagcatagggaaatggcttctcagagcgaattttggcgtaaccaaaagggcaaatagcgtatggacgtctgcggatatgcctgaaggggattttcagctagaggccgaacttttttatcaaagtttaggcttacctgtttgttttcatattagcaacgcatcaccgaaagggcttgatgacgcattggcagacagccgttatgaaaaggtagacgagtgcttccagatgacagcgttgtgccggtcaattatgagccgaacaaatgacaacagccgatttacatacaagtgggaacaagagccatcatctgtttggatagatgaatttattcaattagaagggttttcacccgagcgtcacaaaggttacaaacacatattcgaacgcatgccgccgtgtaaaacttttttcaagatgtatgacaaagaaagcctgacagcgcttggcacggtttctgtcattgatggttatggcggacttagtaatatcgttgtagctgaggagcacagaggaaaaggggcaggaacccaagtgatcagggtgttgactgaatgggcaaaaaacaacggagcggaacgcatgtttttacaagtgatgaaagaaaatctggcggcagtttctttatatggaaaaatcggcttttcgcctatatcggaacaccattaccggattaaaagatgaccaaaggaaggggtttgctaatggactcgcttcaagagataatttgcgaaaaacggacatacacacggctatatcattcacataagcacgcgtacagccaatttctttttccgcttgaagggagtattgatcttgagactgaggggcgccaggtgaaattaaatccggatcattttttatatattccgccgcagtgcgagcatcgcttccgttctatcggaagaaatgaatgtcttgtactggatgttccgcttcatgcaatgaaaattgatgagtatcgtgcaggatcaggaattgaagctgccctcgatcctttctggtcttcgatcaggtacttgctgacagaggaagcaaaggccggaacagccaactcgcttcatatgctagtacaatacataaaagaaaagcttcaatcccatagctatgcctcaattgcatacattcacagccatttatttgagcggctgacgattaagaagctggcagaaatcgagcattatcacccagcttactattcaagctggttcaaaaaacagacagggaagtccccgcagaactatattgccgaccttcgccttgaggaagcaaaaagaatgctgatggagagaaatgaaactcttaccgtcgtgagcgaggcgctgggctttcaaaacctttcttcttttacaagatggttcacgaaaagcacaggaatgccgccccgcctgtatcgaaacaccttatattcggataaaaaatgatggctctttagttaaaagaatattgtatatctcctttacaataggagaaaaaggagttattgatatggcagttattgatgactttgagaaattggatatcagaacgggaacaattgtaaaagcggaagaatttcctgaagcaagagtaccggcaatcaagcttgtgatagattttgggactgaaatcggcataaaacaatcgagcgcacaaatcacgaagcgttacaagccggaaggtctcatcaacaagcaagtcatagcagtcgtgaactttccgccccgccggatcgccggatttaaatcggaagtcttggtcctcggcggcatacccggccagggcgacgtcgtccttttgcagccggatcagcctgtcccaaacggcacaaaaatcggataacgcaaaaaaagacgtttgcctaaggcaaacgtctttgcgtattgaggcgatgcaccacacgccacattcgtgtgtgccgtaaaggcatgtacatcggcttacacaattcagctcatcgctatatgaatatagcatggagggcgaaggaatgcaaggattacttttagtaacggtgaaatgaatttagaatggaaagggttttcattttatttgtaagaaaaaactcagtgagatttaggtgtgatcttaatgcagtttgtatcgacttacagatgataaaagaacaatacttttaataagcctcatgaaacattttcaatttgtaaatacttaaaggatatatatggtgtatttgctatagaagtctaatatgatatccatttactcatttcaatagcaactttcatgaataacgagaaggaacagctgtcaaaatttttttgattataatataagttaattacgatagtatattaggggtattttggtagatattgaaaattgataataacatacaaggaataaagaacctagaaaagagatctaattatttggataaacatatattgaactggtcggcgtatccactatttgatgacggttagagcgataccataccctttttctgatgtgtaagcagaggttattttcattactttccagcttccttcagtggcttttgttcctattccattatgtgccgtaagataatctccttgattgacagtttcgtcaatacgcacataatgttggccaaccaaccctacaacgtgccattcgtctcttgctgcccgtgaatgataatttgcctccagcgctgtatcgtagtctggattttgtttgggaacacgtatgagttcaccgctttcctcatcagtcaccgtttcataaataaatccgccgaactcatttgtcaaataacggccctgccagacgaaactggaggctcctgaaatgaaagctgaagtttctgaaataacgccaagcatataatctccaacattcgcgggcacaattttttcacctcttaaagtcacgattgtaccagtatggattaactgtccagttgaactctcaaaatactctccatatccacctaaagaagaactgattgcaccggcaaacgtcccgtttccccgaacagagtcaagaagccactttattgattgatgacctcctgccacggtgtatggttcctcaagtataatattttcagaagacagtattgttcttgacgcttggtttcctctaatatgtgcgttatttgaagaagcgattaatgcgcgagagccttcagtactggagcctccagaagagctaatgaccgcatttctttctccgcgggccgtaatgtcgccggtacctgctataactgcgcttgtttggttaacggcaaagccagaggtcgttgcaagctgtatgcctcctttcaaattgattggaacttgttggtatgtttggcctttgattgaggctgccacactataaccttctgattgtacaccgagaattgtggcctgattattgggggactgaattgcaactgtcccattgtcagtaatcatcgttccatttagaatattgacattgtagaggcctccaccgattgaaattccttttggagcagatttataaatatcaaaatttgaaattttaatataatcagttttatttgatccgcctgataaattaatatcaacaccggcttttttaaaaccgcgaattttaataccattaatggttatattttggctgcgatattgcaaggctacgacagggttttctttataatcatagtctggatcaccaatcgctgtgaatccgcttacattaacgtttttatatgccgaaataaccagcgctcttggggtcacagcatcgtaaagcgagttgaaaactggttcaactgctgaacaatcaatgagtgtgacatcgtatgctgttgtgctttcaggatctgtaatttgatggtgaccaatatgacgaagatcaaatgcacgaacatcgcgataagaaatatggcctatgatatggacgttttgagaggctggccacagttcatgggcttttacttcaactccgcggatgttgccgcttgtaaagttattcaaaagccacacatgcctagagccgtcgtcaatttctattccgttggagtttgaaacaccttcagcaaattctgttccccgcggatttcctgaatggcagtttgaaataaagatgtattcgctataatgggtggtaatgccgtcgtctcctgaaccatatgtcacacagttatcgatccaaatatatcttgatccgtcttttgtccaatcggtatcaggcaaatggtcatacgttggcgatgtaatatcaataccatgaagacctgcgttaatcgcttccacatctttgatccacccatattcaaccttagcaaaagttaaacaactggagaactgtccccctggatttctcacaccgcattgtctacttggattccagtctaatgacattccttggacaaaaatattgcgatttccattttgataatcatcatttgtaatcacccattcatgcgctggagtgtcttcatgcaatttaatcactgtgatccctttaccttgtccaacaattgttgtccaagatggaagtttaatcccttgaacgaggtattctcccgctggaacatgtactttgactcggccattcccgattgcttttcgaaaagcttcagtattgtctcttccatctggaacagcgccgaagtcagccacatttacttcccgggtgattttagataaaagcctataatattccttgtcgagacgttcttttaaaagagaggtgacctctccttcggccgtcacccttgcgtcagtaacttcgatattttggtctgtaaccgagtgcttaataaagttttgcattcttgtcttaatatgttctaattcggatgaaaattcggggtgagactgagaattggcgtttagagaaggatcagggcagtttttaaaatgaaccattctaaagacacctctttcttttaatataagcgcagttttgtctttgagataaggagttagcatttcttttggcgcttctctttccaattctgtatttgttacaaaattcctttaggatttatactggttttcaagaaatgtaagtcaatgaaaaaaagagaggacaagtaaaggataaaaagcaacattaagaatcgttatacagtgaaagaaagttcgcccgatggttaattaaaacgtttcctatggttgggtatttattaatgattatggaagaaaagggaggtccgcattcaaaacgtgtataaagataataaagaaccgaatgttgagacatcccatatttgaattaatcttttaaacaaaggagtataaattcttcacttctttttatatcaaccagttttaacaagatgtgagcatgatctaaggtaagcgattgacctcataagcaacacgtattccagattcaatcgcgccttgcatccacgcatgagtgagtgaggcgtgttctccggcgaaatgaactctgccctcagggacaggaatatagggatacagctctaattcttgtcctggttcgaaagctgtaaaacctcccgcagaatacgggtactggctccagctaaaagaagtgccagacacaaattcagaccacacaatatcaccatagatttcagataaattcagtaaagtatactggattcgctctccttctgaaagactgtcccatatcagtgcctcatcggcccatgtatagctggccagaatgacagcatgtccatttgctccaatatttctgcttggataatatgaaaaacgaatcggaagatcagtaatagatttgccgccgtgctgaccggctttttcccaaaatcggcttttaaactctatgccgatttttgttgcactgatatagtttagctcacggatggccctccgtttatagtaagagaatgaatggtatggttcgacttttacaaatcgcaatgttgaaaaaggaatggttacaatagcgagatcagctgtgaatgatgtgaattctgccgtttgttgatgctgacaatggatcgtaacacgattttcaccctgagacattttcatcattttttgatggtatagaatgtttgtttttaattgaggaagaaacgcgtgaggcagcagatccataccgccagttatctcatagaagtgagcgggggatgaaaaaaagatagattcccgcaatacttcaacaagggacatccccatatacgcttccatatccaaaagtacaccgatcatatcgatcgcgccatatgaaaaatacgtgtttaaaaaagagcttaacgaatgatttttgtattgttcttcgacaatccgccaatttcttgctggattttgattgataaaatttagaataggctgcagtaaagaaagcatcagctcttcagacgttttcccttgttcatttggtgcaactggatatctcaatattccaggagctcgttcaaaaacttggagacgtgttttgattccatttgcataaatgatgtccatcggggttctgttgataaatacatttgttggcaatttgaattttttgatatattctaaggttaacgaatggttattcggtatgcgcatcgggccagcgttgaaatacaaatcatcactaaagggagatctcaaagtgcagacacggccgcccgctctgccgctcgcttcgagaatcgttactctgtgaccggcatttttcaacaaagatgctgatacaagcccggacaatccagctcctataacaagaatgtgctttggatgctgcgatgcgctaaggccatttctaatgatctttaccatgtcatcattcattagagaattcaatttttggaggcacctctttttagaatttattgcattatattcactgaaaagagcacctatcacgatctgttcacatcttttggaatttgaaaggttattgttaaaaggaaataaaggggtgatgtatgtgactaactttgttcataagactgtaaatggcttgaaaagtcttttagacgaaaaaggagccattaaattgttttgttcagaaggtgatatcatggagttccttgttactttttcacaggacaaagcaaccctgaatgacattcaaagctttgaggctaaacaccagcttacccttccacaggattatcagaagttcatgacactacataacggtgcgaaaatttttgagattctttctgatggggagaatataggtggaggacttcagctatttagccttgaagagattgaagaggagttaaaatatgaagatttgtttgaagatatcaatggtattccaattggctacttattggaagaatgccatttaatgatcgataaagataaagtgaaccaaggtgatcccaactatctctatatatttgaaagtggtttagaatataatccattaaatttaaactttgaaaaatttttagaccggtatatattggccaatggggaacctttttgggattggcgctactataccgcagaaaattattatagaacaagatagtgtgtgatgtataagacagtcattttggctgtctttttctgttattcaattagattactgtggtaaaatttacatagaagtagtctaggaaggagaatgatatgaaggtatttgaggctgattcattactctttgaagcggataaaagaaccaaagagtataaggaactaaggtcgcaaatggtgaagctcaaaaaagcgtttaaggaagtagctaacctagatgacagtgaattttcaggcaagggtgctgacaacattaaagcattttatcatggtcatgtcggcgtaacagaccaatggattgatcttatcgatatgaagattgctttcttaagcagcatgtctgcaacacttgaagatgcgaagatgtctgatgcttacatagaagaatcctttctagaacacgagttggctaacgcttatgcaaaatcaaaatccattatgtctgaacagaaaaaagcaatgaaagacatattaaacaacatcaatgatatccttccccttgaaatattctcaacagaagacttcaaagacaaactttcttctgcagatgacaaacgtgaaaaaacaatcgataagctaaacaagcttgatgaggatttaaaaacagaatacgctgaaacagaaccaaacgaacaatttattcagcaagactttaaaaagctgcaggaatcaacaggcaaaggaaaaaacgctacaccaattcactataacgctaaagcgtacagagaaagtgacatacataagaaaaaaggcgatattgaaaagcattctgaagcttacttaagtgtgaagaaagaagaagcaaaggaacgtgaaatcaaggaattaaagaaaaacttaatgacggtgtatctgaccctgatgaatatttagagattgctaagaaagtagggtacgagaatctggagccaactcaagtgcagcttgcagtgcaaattgaacaagcgaagcagctagaaggagcaggagaaatcacctgggatatcgtaaaaggtgtaggagttggtttatacgatgtaggaaaagacactgtaaccggcatatgggacttcatcaccgatccaggagaaacactctcagcactgggtaatgcagctatgcatccagtgaaaacatacgatgccatttcagcagcaatagaagagtcatatcaaaaggatatggtgaatggagatgcctattctagatcaagatgggttacctatgctattggttcagtggctgtagctgttgttggtacaaaaggtgcaggagccattaacaaagcagatgcagcgggcaaggtaataaataaagcaagtcaagcaggtaagaaaatcaaggacgttaagattccagatttgctgccttacaaccctaagtataagcttgctctagcagataacgtgccatacaatgtggttgatagccaaaaccttaagaatgaacttttgactaatgcgaagaaaataccggatggaacaagaaaaccgtttactggccaaaagaaaagccctccttggctaaataaagaaaagtatgatgcatatgaaatagaggggaaggtaaaggcgaaggggaaagttaaagatgtaagccgtagagtgtatactatgaaagatattgatattaatcaaaaaacagaattcggtgttacaaatcttcagctaatgaaaaacgggaatgccccttatgcaaaagacggtacacagattaatttacatcacttgattcaagaagaacctggcccaatgcttgaaatcccgaacagcttacatacaaaatatagtgatgtcattcatcagcttaagtctgatggtgaaagttttagaaatgataaggttttaaaagcacaatacgagagctttagaaagagatattggaaatggagagcgaaacaatttgaaaatgagaattgaggtgtttatatgatttattcgaaggttgagaactttattaatgaaaataaacaaaatgctatatttacagaaggtgcaagtcatgaaaacattggtcgcattgaagaaaacctccaatgcgatctccccaacagttataaatggtttttagaaaaatacggtgctggtggtttattcggcgttttggttttaggctacaactttgatcatgcatcagttgtaaatagaactaatgaatataaagaacactatggccttactgatggacttgtggttattgaagatgttgattactttgcttactgtctagatacaaataaaatgaaagacggagaatgccctgtagttgaatgggatagggtaattggttatcaagatactgttgcagacagctttattgaatttttttataataagattcaggaagcgaaagatgactgggatgaggatgaagactgggacgattaagcaaaagtattgctatagcgcaatagaaggcttgagttgcacatcctcaatctaaataaaataagctctcgcaatgagagcttattttattggattaaataattaaagtgacagaagttttctagtcccgttttatatgaaaccttttttattttagcccgtattaaaagtaaattcagagagaaggggagaagcttaattggagttattagatatttggaattggatacaacaaaatggtattcttactgcagtaattacgggtatagttgcattgctattcaatcaaagacaaaaaagtatagaacgattctactctcaatcaggtgaaacattagaaaaaattttagagcctatgtattattccctaaaagaaataaagaatgaagaagatgaaaaccataaaatggtccttatagaaaaatttttcgaagaatatagtgggaaaaaggggaagctatcaaaacttagaaacatcttattgatagatcaaattttgaatacagaagattgtttcagagagtatattttaaacaagaacagcgagaataggaaaaaattattttataaaatgagaatgttagatcaagcagttaataaagaatatagaagtatatttgttactctaaacaagaattataattggtataaagttctttttagaacgaattatattttaagcgctgtttttgtttttgttagatggtttaaagaaactctagctttttttgtcggtgcttcagcatttgcttttataccccttctatatgataaatatttaggcgaacaagttttaggaaattggttagaggtaaataaacttatttttggactttcttgttcagctctttatatcttttggataatacattatttccttttaaaagatacaatgcaaaggaaagatgaaatatctttgtttcaggaatggtttgataaaactaagctagggaaatggactaacaagaatgtctggggaaagattgggaattggaatgttgaaagacgagctagaagagtaagaaatgatgaagatgtataaaggcttgtgcgctattttagatcattataacgttacaagaaacaataaaaaagctttccaagtctcttgaggtttattgtaatgcatttcacggaaaatgtgttataatcagttttacaatacattacagtgcatttctttaatgagaaatgcataaaataaaaaagaccgaggtgctaccaacaccccggctctgtacaaaaagttgcccatcaaagggcttgctcgatgtggttctaggtaggcctatcccttcaggttctgaggctcaagggaggtctattttttctatatacgtcaatagggcgattataaacgacccgattgcaagcattagcattaatgcctggaatgttgacatagcatcacccctttcattaggggatgagcaagactccctcgagtgagcaaaacttactgtacaggaaatatcatactatacataaatgcccttgtcgttaaaaattcacaatatattgacaacgtgaaaggaacttgcaaaatgcaggttcttttttgtattcaattattaaatcatttgaatgattgtcgatatttaatatgtgtaaaaatggaaaaggtgctacaattataaaaagctttgagaggattgtgattatcagtggtaaatgtaaactgaagcgatcttatttatgatccaaaattcttagcattttgcagcttggctacagaaggatacgggggaaataactcagctcccagtagatccattggttttagtgaattctgtgaaacacttgagaaaaatgaagtagttaaacccgagaacaaaaaagctcacttgacctaaataattctttagattattggaaatcaagatttaatccaggcggtaatctttcggcgttagattctcaggtattagatattatcaaaaaagcttacaacttaggcatggttaacaaagataatatgctgctgcgaaatgaagcaattaatgcttataaaaattcaatttaaatatgaaacagtcctgtaattgggcgctgtgttgtttattgatcatctttttttcagaaacttttaatgccctttcatgttacaattaatagtgaatttcaactggcgataaaggactatattagatggaagagaaatgatttgtcattgctacatactcatttatttagttctttgctccagttttattaattcgtattacacctgaaagtttagaaaggatttgtttttttgggggaaatcaaaaaaaatttgtgcagtggttagagaaacttctgattagactaaaagaacctaatgttaaggaagaaagcctttttgaagatctttctcctagcaatgatgtcgacactgatggaaaatattctaaagcactaagttgggggttagaaaataaaaaagtgaaaaatatcgccctaactggtccctacgggtctggaaaaagtagcatattaaatacctttcaaaaacaatacagcagggaatatagtttcttaaatatatccttagctacattcaacacagatacggatgatatggagaataagttagagaaaagcatcttgcaacaaatgatataccgggtacacgatagaaccattcccttttctaggtttaaaagaattaagcatataaggactaagagcataattataaatttgattttcttttttgcatttattatagttggcatctacctttttaaacctgatgcacttaaaggaatatatgctgagacgttagtttcaaggagtctcggtactgaagatcagcaacaaatacgactgactatattattagcactgttctttatagtatatcctctactcgcatataaaagaatttatcattttgtccgtgccaacttaaaattgaataaggttacaattgctaatacaacgttagaaaaaaatacaggggaagaaaactcttctatatttgataaatatttagatgaaatattatattttttgaagcctccaagtataatgttgtaatatttgaggacttagatcgctttaataatataggtatttttgaaagattaagagaattaaatgaacttataaataattcagaacaaatagatagacgtgttgtttttatatatgcgataaaagatgatatttttggagatgcagacactgaaaagttaactagagaccgcacaaaattttttgattttattatcccagtaataccaattattaatgcatctaattcaggagacatacttaaaaagaaaataaaacattcaccatattctgatttgataaacactcatttcttagaggatgtaacaatttacattgatgacatgagagtattaaagaatatttttaatgaatttgttatataccaacaaaaactaagtgcaattgatcttgatcctaacaaaatgttgggcaatgataatctacaaaaatatttatcctgtggatttttctaaattacaatataacaaagggttggtatatgaaatctttcaaaaaaaacaacttataattgaggaacaaataaaattaattaatgctaaaatacaacaattagagaggaaattagcgaatatagaagttgagtctttaaaatcaattgctgaattaaattttatatacttgagcgaattagaaatatcaaatttgaattctaattatgatattaatatagatggcgaggtatttagaggcaatacatctaataaagatcggttttttgagaagttaaaaaatgcggatactatctattgttatttaagaaatagaaatggtccagcgacaattaaagaaattgcaactgtttttggtcggaaaccgaactactttgaaagagaagatgccatcaaggctatagagaaaaatgaaatccaaaaattcaagaaagaactattggaattagagagagaaaagcaagaaataagagcgcaatctttacaagtattaattacaaaaatgaattcaaaggatgtattttctgataagctttacgagaaaaaattacttgtttacctgctacgtcatggatatattgatgaaatgtataaccattacatcacttacttctatccagaaagtttaagtctttccgatattaaatttgtatttagtattaaaaaccacgagtcattgccttacagctttgagctggataatatcggtaaaataatgagcaaattagttggtgctgaatttaagcaaatagaggtacttaattttcatctcttaaactatataatggatcattctgaataccgtaattattatgatagcataattgagcgacttgcaaatggaagtaaagaatctgttacattcatagatggttttaaagaaagggcaataaataaagctgcctttatccaatcgatatctagtaaatgggatgatttttggagttttattgaacttagatccaattatacacaacagaaaaaagaggaatacttgtcagatatacttacatatgctgatatagctgatattatccgaatgaataaagagtcggtcatgtctttcacattatccaagtacttaaatcttctcagcttagtatctgatgaggagaaaataaaagaactactattaaaactccaagttaaatttaaaagtttggatcatttgctaaattctgaaacaatatatgactttgttgttcaacgaaatctatacgaaattaatatcaaaactttatcagttattttaaatgatgctcccaatataacgtatgctgcagttaaaaactctgatcagcaggctgttatcaattacgtaaatgacaatattgatatatttgttgaaaaagttttacttactgaggagattgaggaaccagaggaaagttttctggagttattaaatcgggaggatttagataagagagtaaagcatgcaatgatcatgaaaaaaacttttgccatctcggatattggtgaattgattaaagagttatggccaattgtgatccgtgaaaataaaatggttgcatgctggtcaaacgttattacttcttatgtagaatacaataaaaaaatgcctgatttcttaatagctttcttaaacaatcctgttaatagaaaagagctctctaaaaataatatagaggcgtttgatgataaatttgacgaagcgattttagaagatatctcagaagaaatcattaatagtcgggatattacagacgaaacattcgaagtgttaattgctagtattcaaagttggatttactttccgctcggaaatgttagtgaaaaaagagcaaaattattgattgataatgatttgttatctctaacaccggaaaattttaaagagttaaaattaaattttgatacacttcatatccaactcgctttgagaaaccctgacgagtttattgataaacaaggtgatttttcccttgatgccaatgatataaagcaactcatagatagcaacgagctctctcaatttaacaaagaaatatttgtacaacatttaaattctaactgtttgacagatggaaataatgatattcttaaagatacaatttattttattaatgagcataacctgaaaatcaccaatgaactactaacctttttgcttgaatcacctacaacattggatactaggttatcgttgctagctggacaaataaagcatattgataatgaatcaattactgaatttttaactaaaataggggaaccttactctgaaattgctgaaaaaaggcagacgaataaagatctcaaataatagaactaataaagcgttggtgactgcattagagtctaaaaactacatatcctcttttaaagaagatagagagagattacgtgtgaatactaaaaaaaactaaagaataactaatgttttttaacgtccagttttaattgctgggcgttttacttattgagattattttctttcaaatattcttgatgctctttctccagcttatcagtatcatccttgaatatataaatcttatatttttccttggcttctctagacagattatcttttaaatattcacggagttttgcttcacttttggtttgatccatgcctattgtaattgccggatctgttattccaatttcaaaactaaataacccaaattcatcccaagcactttctaaaacttctacaggggtctttttgtttgattcgattaaagttataccccacataatcaaagcaggaactaagaccaaaaatccaattaacctcttcttcattcaccatcacactctccctcgtcgaaaagaatctctcctttattaatactacggatatcattattgacctttatattttattaccaacatttacatcgaacttttgttctgatctatattgaataaggaacgtttgttctgttgatattagatcaatcaaggagtgagtcgatatgtttagggatcgaggaactatcaatggacatcaatgatgctagaacaattaatacagcttaaacaagatttgattgatggatcaaaagttgaaaagccatctttagatgacaaacaaattgatgagatggatattctcgtttctgaggcattggaatttaataaagagttgaaattcaaactctttaacaagggatttgttgaaaatgttaccggcagagtacattacattaattttgaacaacaaaagcttcacgtaaaagaccagaacgacaatacagtttatatcaacatgaataacatcataagagttatatacaatgactgattactcacaatttccacgtgagaatatactctgtgtcgatatgaaatccttttatgcttctgtatcggctgtagcaatggggcttaatcctttaacatgttatcttgccgttgtagggaatacggatagacagggaagtgtagtgttagctgcatctcctgcacttaaaaaagattttggaatcaaaacaggatcgagactatttgagatacctgaagatccaagaatatacattgtaaatccacaaatgaagcttttcatcagagtttcaactgagattacaaagctgttttacagatttgttcctgaaaaatgtgtccacacgtattcaattgattaatcttttttagatgcaggaaaagagaatcctgaagaaatggccaaagcaatccaaagcagcatgtggagagaatttggtttgatgtgcacagttggaattggtgacaatatgttgcttagtaagcttgcacttgacctggagagtaagaaaacaaagagtggtattgcacgttggagatatgaagatgtgccaaatagactctggaaagttcgacctttgtctaaaatgtgggggataggagggaggatggaaagaaatctgaatcgaatgggtatatcaactgtaggtcagttagctaaatttcctttagagctgcttgaaaagaagttcggaataatgggaaaccagttgtactatcatgctcacggaattgatttatctgaaataggagctccattgatgcaggggcagattagttttggtaagagtcagattttgtttagggattatacaaagagagaagagattaaagctgtgctcttggagatttgtgaggaagtcgcaagaagggcacgtacatataataaagttggtcgaacaataagtctaggaattggatacagtaaagatgagcttggcggtggttttcatcgatccaaaacaattgattttcccacaaatatcacgatggatatttataagtgttgcttgatgttctttaataagttttactcgggcaaaaaacagtgagaagtatctcagttacgtttgcaggtactgcgctccacagagcagggctgaccggtggacataaatcataaaataaaagcccactcaaatgtttgagtagggctaaattaattaatcaaccttttttaacctccgactggcctttcagctacctggatgttagatggtgaatctgtactcaattgcgttaaagctactccacttaaaatcacagctaaaatagatacgcaaagcacaagttttttcataagattccctccacctgattcattttctgttcagcccaaattttcgcattgaaaaagctcgttgcttcttcaaaagcacctattgattcaaacctttttgcagctatgtaggacaattcatctacactttcaagttcattttgctgttttaaaaactcaatattactaatacaattattgaaattattttttaattccccacaataaaggttatacaggatgctgattttggcttcgtatactttattctccattaatatgagtctttcctgtgctttattgtaaaaattaatggctttcattttttcgtcaattttaaagagttctttaatcatcatgaataaagaatttatataataaatcgaatgtaaccaagattcatttcctattgctttttcaagagattcaatgcatttatcaggtttgttccaatcagaataaacgatactaagattgtgaaataattgagcttttaaaaattcatcttttgtttcttttgcaatatcaattgcttctaagtaatattgttctgcttcctcaaatcgtttcatatcagcatagtttgcagctgcaatcattgttgatgtagctagtttgcatttataatcagggtgtcgcttatatattgaaattgcattttttatataatgttgtgccacaatgctttgtttaacaagagtatataagtaagagactttagagtaaaattcagctgcttcaatttcatctggaatttctgcaagctttttctcagctaatccatataggttaattgctcgatcatagtttttgttgtatgcctcgtacattgcttcaaataaataaaagttgtattctaatttatcatttgtttttgttatgaagttttgattgtcttcagtaaaataggtgtgcttttgtaaaggctctcctcgtgaagaatgcagcaacattttatgtctttcttctaatagactataatacgcaagaacttcttgatcttcttccatttcatcaaaaagtttctttatctctgaataatattttattgattcatcaaccttttgttttttatagcaatgtaccagtcattcagtgtagtagcgacaacttcagaagcgatcttactcatttaaacccctctttctgaaaatttcaaaaatctctcgaaaacaatcataacatagtcattgaaaaaattgtaaaaggatgtaaagttttctgcaattttttcatttgaaaaaacgaaaaaataccctcctcaatcaagagaagggtatggggtttatctcggtgaatcataatccattgcttgttcactatcagaaataccttgagttgttggatcaacaataatgcccaatgcagttaaaaaagtcagaagagcattaaatttctctgttaaatcgtcaccaaatacagtcaagtcatatccaaaagcaaaggcaattgcttatcgtaaaaatttataatgagctaaaaagacagtaaacataagaatttttgatactttaattagtaaatagggggtaaacgatcgtaaaacataagcgggagtaggggaaagtggttgttttgggaagatatttataaaaaaagaaaattttaagaaggaaaaacgttgatactataggcttttacgatagtgattacgatgtgaaaaagggtgattttgatgtggaattaggaaaatgaaaatttggatagggtgtggaaatggaagtgctatgggtacatttgttcttgcttttgagtatttggatgttaatacacccccagataatggtagtgtaatccctatataataactcttatacctgcatttcagttacatataatggttatgatcgaatgctttatggatgcatctaaaaaagggaaaatcaagaatatttttttgaaaaagcagaataacttctgtcttaaaatgagataaattattttgtttttgatcgttatcgtaacaggaaaaattaatacgaacacttattatgtccttaataagcaaaatgttctgagtaaagtactatatattcaatgatctcgactgactaaaccttagatgcaatataagatatggactcagcggtaacagaagagaaggaattagggaaagcatttgatttcatacataaaagaccgcatagaaagaaatatcttgcttaaaaaggtgaaaaaggagctaaaaaagctccctataagtttaaacaacttttgtataaatagccgtataaaactgaattgagtaatcgaaataataacgtgtgagagtataagtatatccattgtattcaatagaaggcttgaagtttggtagggggctaagctgatatatggtgtcataatcatattcatcactttttactatcacttcagacgaagaacttgttgccaagacaggagcagcagataccagcatacctaatgataaagcagaactcaataaaatttttcgaaggttcaaatatatcaactccatttacattttatatattaattatgagttaaatggaagttgctttggaagtgactaatggatcataaatagttaaaatcgtgattttaaacaaataaattaggagggaattatggctgacagatatgtattaattgaagtgaatgaagacggagaaggaaggttaaaagatgaagctgttacttggattgacttccgattaagcattgtagattttaatgccagtgaaggactaaatcaattaatggagcaaatatcaaaagatgtgaaagatgagttagttttggttctttttaattatcgtgttaagtcctcttatgattcttggagtggagcaactgaatatgaagacttctttgatgttgaatttttcaaagtaattaaaaagaattataagaagttttaccaaggattagtgacagtagaattagatgtcggtattaatggttttgacaatattgaatctatgccaaccgactctaaccaaaactattatagaaacttaattgctgagtgggaagagttttacaatgaagattttatcccattaagtctaaataaaagatagtttttaactaaacatataaggatggatcgttatcgataaaagtacacgcatcgataacgatcgcagaaggggatgtaaatttctatagcggcgtattttctcgaaatagcctggatacttattctgctttgatctggatttaaatacagaccaaattacagcagctagtgtataatccaggactttatcaaaagtccaatttgtaaaaagatcaagaagaaaattcattagctttcacctccaagacaaaattgtcctatctctcttagatggcatgtgtatgacacgcctctataattaaaagagtgaaatccaatatgaaaatctaaaaagaattgaaaaaacataaaaaaaatataaagggtgcagtaaatgacggaaattaaagcgaactcaactgtaatgattcacgtactggctgacgaaacacttagcagcatcaagcgcgaatacgtagaggtcgatcgtaaaacggagattggcgagaagatcattattgttgataaaaatgatccagatgatgaatacgagaacggagcaatttaatatggattttcaattttcaaaattgtaaggttaacttatctacccggaggtgatgttagtgtatataggaaatggccattactgttattcaaattcaactgcaatgtttctttcatcaataggagaaaatgtatctcctcaacttgtagagatattaactggtgttgggttaggtgccatgatagaatatgaaaaaaacctttattttagtatgagagatcctgatgatggtatcaattatgctttaaacatccttggatttactgcagaagaacatcagcaagctagtgacttagatgacccatttccgttattaaaacagcaaatcaaacaaaaccctgtcattctaggccctttagatatgggggagctaacataccatccgaatcataaaaatttaaatggttctgaccattatgttctagggtaccaaatggataatgaaaatatttatgtgcaagatccagcaggctttccatttgttccattatcactggaccaatttaagaaggcttggatggcggaaaggattccgtataggaaaggaatcaataaatattggtctacagcaaaaaaggttgtcacattagacaataacgaaatatacgagagagcaattgattattttaagagaacttatcggaaattcgaaaaagtggatatagggttaattggaagggaagcaatttgtttttatgctgatcaattattaaatgcccctattacagctgatactataaggcatacaacattcttccttttccaattaagtgcaagaagggccaacgattatgcaatgtattttaaagataggcattcacatttatcagtgttgaagactgaacaggctaaggtgtttgggatatgtcattctatgtctgtaaataaagattggaaaggtatatcggagaagttaatgaagctagccgatttagaggataattttagattggaacttttaaaagtcggctattaattatagagatttccactttaacaaacggggcgtttgttcaataaaggtctcaatacatattatatatatcaactatgtatgagcccttattttaattttagtcttgataatttaagctcagtgatatagctctcgtcatcaaaaggctcttttattgaatgcaatagcattggagatacaaacaaaataccacctcctacttagaacatattagctaagaggaggtggtatataaagcgatatggcagtggtacttaatgggattcaatgagctcaggtgaattcactaatgaagatacctgatatgcttccatgtcatcagcatcataaggcagcaacaagctttgtagataatcaggatcagtatttttaggatttagccattcctttttgttctcatcagttaggataactggcatccgatcatgaatgtcttccataagctcactaggctttattgtgatgattgtgcaagtgtacaacagattgccttctagcgtgttccacttttcatataagccggcaaaagcaaagagattcgacgatttaagtttaatccgcataggaatcttagtctttggatcaaggcgtttccattcataaaaactgtcagccggtatgatacaacgtttgcttccgagcggctttcgaaagctgggtttctcggccaatgtttcagcacgagcattaatcattttataaccgatcttttcgtctttagcacaaggagggataagaccccatctaagtttacccagacggttattagatccatcgttgataattgtcaggatgttttgtgaaggagcgacattatagctagggtgatattcaccttcaggtaagaattgatctatgttgaattgctcaatgatgtcatcaaactcagaaaataaagtgaacttgccacacatgttcatcatcctttagggtttttgaatattgtacaggcttgatacacaaaaatcaaaaaggaggaatgtgatgcagcagcaaacagttgagggttaaggaagttgaatggagaaagaaaaggtcagtgatatttatacaatacattaaatagtttttctataaatagttctgatagactgtacaataataagaacgcccccatatgggggcttggatctgcttaataaccattaaatcccttgatttcaaagttttcagtatcgagatttaggctattcaattgctttaacaacacctcgaattttaagcagtcaccgtttcttaattcttctggaatatcttcaggatttgcagttttcattccattctcaatccactgttttcggtataactgaattgcagcgtcaattaaataatctggagttacaataaaacctaagcttacgtcatgatcttcactgtagccgtattcaaaatcacagcaagggcagatatcaaatgttttttgatactcaccatcattgtttaatgggttttgaattaatcctttatatccgcaaattaaacatgtatataattttggcatagcaatccctctttatatatttatagttcctattgatttttataataattataaccagcctttttatttggatgttttggcttaaagtaagttattatagtgtccttattacctgagcgttccacagataaaaattcatttgtctttttattatacttatacaaagggattgagacagttgcaaggaatggtgaaccgtacacagttttgaacgatttgctgtttgctgcaggcaatttacatattggtctggggcacgattatttaaagtgcattgccttactaatcaatgtcaaaagattttttagtttaacagagtcatatggaaatatttcagataaattagctgttgttgctatgaaaggtgtgcaatttgatcagtttgaagaagcttacaaagcttataaagaaacagttgcaataaatcaaaatagcttagtggactttttaagtgctttaattactctgataaaagcaggtgagaagctacaaaaagctggtgaaagtttagctatcatcatgaataaacttcttgaaatgagtccagaaaattcaatgaaataattgttttatgcaaaagcccttatgagggcttttttaattgttgtttgcagtaaccaacttcaaaattttccgtataggatctaatatctcaggggtaagtttatatccatcccagtgaatatctggtttttctaaaaactcttttagattttttctttccactttaggatcaggatcatctgttaatccaagtatgtaatcaactgaaacatcatatagtctagctaaaataaccaacttgtccaatggtggttttttgctttcagcttcatacccgccgtaacttgattttgcaattccaattttctcagctaactgttccattgttaatttgtgtgcctttcgtaattgccgtaatctttggcaatacattttgaataaatgcctcccaaaaccatctagttcaattatatgagctttcatttctcaataaaataaaaaatctcaaaagaatttcaaaattttcacgatttctggcggaaaatgcattataatgtgaaagcattactttaaaaatggtagcaatgaactaggaggaagtcatggtaagcaagaagaacaaaattgtagcggcattattagcatttttcttcgggggtctgggaatacataagttttatttgggaagagtaggacaaggtattctatatattttgttttgctggactggtatcccctctattatcgcatttattgaattcattatttttctttgtggtagcgaagaagggtttgatcaaaagtacaatttttattactttcagcagcaatctaaagcttaattttaaagagggatatacagtccctctttaaataaaaaagaaagttaaagatatttattttgaattggaggctcggttacatcccacagttaccctgattgtcaattctttttttctttttcagagccctttcaaataaaaatcttgcaacttctttgtaaaactgatctaagctatcatcctcaaatttggtcaataattttaattgagcagttctttcttagtataaccttaattgttttcttcttcagttcttcatattcttcataaatttgcttcccttcattagacaagcggcagctacaataatttcacaatctctaatgtatatctcctttatttgaaatggttcaatgggaattcattgcagatattactccatctgaattagaaacaagaattgtgatcctgcgaaaaaaggatcaggatatggtggaagaagaccacttataatgtgtttctaggtatttgtaattgaattacaaatacttttaatatttgctcatgaattcgtggtattatactgaaggggacgatcaaaagctttggcgttagtaattaagaatgttttaaatgtatacgagtgctacctcaaagtcggaaaaaatattataggaggtaacatatgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagtcgaagagaccaaccggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtggtaacagatcatccttaatcaggggtagctaacgggctgctgatcgttccttgagaagttttataatcaatgattattaaaatcgttagtaatggttaaaggttgttttctactaggtgaacggccttggaattgctggaggtagggtattctccatctggttttaaaactttccctataggttaatagaatggtatttaaatgagaatgctatcaattttttgtagtcagcgcttgctcacaacagacacctttacataacccttctttatcaaacataagccttattcaaaataaaaatatctagtagttaaccagatcctcataactttatactagttaaaggtgggactgttaagaacaaaaagtccaatttatgaatggggactctacgaacaaagcaagtaagttcaaaaagaacccaactttaggatttccttagaggattgaatcagctcaaaccaagttttttaatgcgactagctatggaaattaagaaaagaacctggtgaaatttcccaggttctttttatattgcacaaaaacagacacggtgatataatcacactacgtgcgctttctagttaaaaagttatagatatccatcttataattttattatatcctgctaggaagctcttgtcaatattttttttgaaggggagatgtagaatgagttctttggttctcggtttacatgaaattgaaaaaacacagctttcgctcgttggaggaaaagggttacatttaggggaattatcaaaaattcaaggtatacaagtaccagaaggattttgtgtcacaacagtaggatatcaaaaagccatcgaacaaaacgaaacgttacaagtgttgttggatcaattgaccatgctaaaagttgaggaccgagatcagattggtaacatcagccggaagattcggcaaatcattatggaagtagacattccttccgatgttgtgaaagcagtggctcaatatctctcccagtttggcgaggaacatgcctatgccgtgcgttctagtgcgactgctgaggatttaccacatgcttcttttgccggtcaacaagacacctatttaaatattaccggcgtcgatgcaatcttgcagcatatcagtaaatgctgggcgtccctatttacggatcgcgcggttatttaccgtatgcaaaatggatttgaccacagccaagtctatttatccgttatcgttcaaaggatggttttccctcaggcttcggggattttatttaccgctgatccgattacctccaaccgaaaggtgttatccatcgatgccggttttggacttggtgaagcactggtttctggcttggtatctgccgattgttttaaagtacaggatgggcaaatcatcgataagagaatagcaactaaaaaaatggctatctacggacgaaaagaaggcggaacagaaacacagcagatcgattctgatcagcaaaaggctcaaacactgactgatgaacaaattttacagctggcacgcattggaagacagatcgaagctcatttcggccagccgcaagatatcgaatggtgtttggcccgcgatactttttatattgtacagagtcgtccaatcactactttattccccatccctgaagcgagtgaccaagaaaatcacgtctatatttctgttggtcatcaacaaatgatgacggatcccataaaaccactgggattgtctttttttctgttgacgactgttgcacccatgcgtaaagccggtggaaggctatttgttgatgtcacacatcatctggcatcccctgacagcagagaagttttcttaaaaggcatggggcagcacgatcagctcttaaaagacgcacttatgaccataataaagcgacgagatttcataaagtcgataccaaatgataaaacagcaccaaatcccagcagaggcaatgcagatatgccggctcaagttgaaaacgatccgacaatcgtgtctgatttgattgagagcagtcaaacatcgatagaagagttaaaacaaaacatccaaacgaaatcaggatcagatttatttcgttttattctggaagatattcaggaattaaagaagattttatttaacccaaaaagttcggttctaattcgaactgctatgaatgcttcattatggattaacgaaaaaatgaacgagtggttaggtgaaaaaaacgcagcagatacgctttctcaatctgtaccccataatattacttcagaaatgggtcttgcgctattagacgtcgcagatgtgattcgtccttatccagaggtaattgattacttacaacatgtaaaagatgataactttttggatgaactggctaagtttgatggcggaagcaaaacccgagacgcgatctatgattatctcagcaaatacggaatgcgatgtaccggagagattgatatcacaagaactcgatggagcgaaaaaccaactacacttgtcccaatgattcttaataatattaaaaattttgagcctaatgtcggccatcggaaatttgagcaagggcgacaggaagctttgaagaaagaacaagagttattagatcgattgaagcaattaccggatggtgaacaaaaagccaaagaaacaaaacgagcgatagatatcatccggaatttcagcgggtttagggaatatccaaaatacggcatggttaatcgatacttcgtttataagcaggctttactgaaagaagccgaacaactcatagaagcgggcgttattcatgaaaaagaagatatatactatctcacttttgaagaacttcacgaagtcgtgcgcacacataaactggattatcaaatcatcagtacacgaaaagacgagtacacattatatgaaaaactatctccaccacgtgttatcacgtctgatggtgaaatcgttacaggtgagtataaacgagaaaatctcccagccggagcgattgtaggtctacctgtttcctccggagttatagaggggcgagcgcgtgtcattttaaacatggaagatgcggatttagaagatggagatatattagttacctcctttaccgatccaagctggacaccattgtttgtatccataaaaggcctagtcaccgaagttggggggctgatgacccatggagctgttatagcccgtgaatatggcttacctgcagttgttggcgttgaaaatgctgccaagctgataaaagatgggcaacgaattcgcgttcatggtacagaaggctacattgaaatcttctaatgtctgatgtgtgtagagaaccgtcagatattccgccatcagccctaactagaagttgggaggctgcatttgtaccgaatgataaagttcccgttgaactaacgaagatcgatagcacattaagaaaagctggaacctctttgaggaggtctggcttttcaatataaaattggcgtagtgtacaaaagccgtattttgcgggcggcacttctttaaagtgaattttttattaccagcatttaaaaccaaactttagattttgttcgtgtcaaagagaactggagaatgttgatgttgtatttgataggggaccacatagaaagaaataccttgcttaaaacaagagaaaaaggagctaaaaagctcctttataagtttaaacaacttttgtataaatagccgtgtaaaacccgattgagtaatcaaaataatgacgtgtaagcgtataagtataaccgttgtattctattgttggctggaagtccattggcagaggactaatgcggtatatagtgtcataatcatattcttcattttttactgcaacctcagacgaagtgccagcagccaatgcgggaaccgcggatattagcatgccaaaggataaagcagaactcaataagattttcctaatcttcaattacatcaactccatttacaatttatacatatattatgttgtaattggaagttattttggaagtgaataatggatcataaaaaagtaaaaatctcgattttaatggaagttgcgatagtaaacgacagtaaggataagtatatttatgctggaatccagaaagaagcggccttcaataatatatttgaaagcgcaaaaatgagtaagcggataatatcgagggctaccacatgcaaatatttgagaaagaataaaaagaaggttgaggaattggagaatgagtatgctgctgttatgaattgcaaaaagaagtagatgggttgggtgatatcctgttgtttattttaaagatgagtttaaagaggaggaagaaagatgcctaaaatcggagtaagcttgatagtgctcattatgctcattattttccttgcaggctgcaataaaaatgaacaaaacggagacgaaacaaagatgcagagcctagtaggctatgtcgtgcttaaagacaatgaaagggcaattctcattaccgatacaaaagctccaggaaaagaagattacaatctttctgaaggacaacttatgaacaagtttaaaaataacatagtaattgtaggattaagtgagattgataacacagatgatctcaaaagaggtgaaaaaataaaagtgtggttccatacacgaaaagagtcaaatccaccaagtgcaacgatacaaaaatatgaattattataaaaaaattgttgaattctcatatagataacctctgagacaacaaatgttgttctattgcattgaaactgccagtgaccaatatcaagttcagttatgttaattcaagtggtttgatatgttagtgtcttcgaacgagacgaaatattggaagtgagtccggatattcatgagtattacaaattggtcacagaataagagacttaagagagttgtctgcattgtatgttcacttgtatctttataatggcttgcactaaggagtatattcttggaagaaaagaaaacggattttagggtgcttagtcttaattcttgtcagattcaaactttacttgttccataaaatgaaaacttgctgttaattataataatgtttaattttgtggtgtttaaatatatgattctagaggtcttatgaaagaaccgttcatcaaaaaatgaacggtagaagttaaaaaagtaatgtcttttcctttgtggcaaaaggctaaacatattatttgagatcgttaaggacgacttttgcagcctcagcgataagagcattatcataattagcatctttcgtaaagcggtttgacagaattgccacaacaataggagctctgtttggcggccaaacgatagcaatgtcgtttcgtgtcccgtaacttccggctccggatttatcgccgacttcccatcctattggagcgcctgcccgaatcagttcgtcaccagtagcattgcctcgcatccaatcggttaagatcatgcgtttgtcagtcgtgagagtgttatctaaagtgaaggctttaagatcggttgccagtgcttttgcggtgctggtgtcacgaatatcaccaggaatcgcagagtttagatccgtctcgaatcgtttagctttcgttacatgatccccaatctgtttcagtgacttttcaaaacctttagggccgccaagctgttgcaacaagatgttcccagcggtattatcgctgtaacggatagccgcttccgagatttcttttaggctcatgcctgtatctaggtgtttctctgtgattggagaatatgtaacaagatcgtccttgctgtagtggatgacttcattaagtttttcaattgagtttttcttcaggacagcagctgcggctagaactttataggttgatgcgtaagcaaatcgttcattcggccgataggcgattgtcttgtttgaacctatatcaattgcataaacaccaagcctggcatcaaattttttctcaagttgaacaaattttttattcgttatacagcttgccatgtttgtgtcttctatggattttgcttcggcatgtgttgagttgaaaaaaggtgtgaaaccagtaatgcttaaacataaaagcccaacacatattccgaattttattgacgctttagttttcaacttcatcaggcctcctcattcaaatgattttgtattacctttgaaatgtttcccatgacagttagtgtaacaaacccctttgcgctagtaaacatagaatcaattgatcttatatttttataagttgggagaacaagggcataagaatagaatcaacaaaaaagctgacaatgactgtcagcaaagtcatctattagaaagctttatcaattgtgattggagtgttattggatgcaaacgagaaaagtttatctctacgtatttcacacaatgtcagactgggaatatggatatttaattgcggaactaaactcagggagatactttaaacaagatgcagcatctttaaaagtagttacagtaggggttaataaagaaatgataactacgttgggaggattaagcataaaaccagatatttctcttgacgaatgtactcttgggagtcaagatcttatcattttacccggaggaaacacttggggagaagatattcatcagccgatcttgaaaaaagttggcgacgctttaaagctcggcacgactattgctgcaatttgtggggcaaccttgggcctcgcgaatgaaggatacttaaattcgagaaagcacacaagcaatgacctcgactatatgaatatggtctgccctaattacaaaggagaaacattctatgaaaaggggcctgcagtatctgatgaaaatttggttactgcatcaggaattgctcctctggaatttgcggtagaagtattgaaaaaattagatgtatttgcaccagatacattgcgttcatggtataagctaaataagactcaaaagcctgaatatttctttgagctaatgaatacaataaatcgatagaaaacactttagcagttttttgtagtgctcctgaacttataggagcattttttatatgtgtctaggagctaaataaagaaatgcagaaacttttaaaaagaatatagattggtaagccttatttcgaatagaggttgatttgggttaaaactgttcttattaaggctcatttcatggtgctaaagattcatttggagaagactgtcttgatcagaaaagacccttccaatatattgaagtaaaagatatcgggaggaactcttttgaaaaagatgttgatgttagcttttacatttcttttggctttgactatccatgtaggggaagcttcggccgttatcgtgaaagatgaggagaaagtgagttttacaatgacagagaatgaaaaatggtttatgaagtctgatgacctaaattcaaaccattggacatctcactttgggtacagattcaccattttcgatactgaaggatgtacaattaacgcaagaatcatgcgaatgactttgtcaggatatgaaataaccgttagtgaaaaaaacttctcgggggatcattttgattttagtgcaactgatcgagttgagacgatgccttataagactcattatttgattttgacaaaagatccagattgcggagatgttaaagtaaaaggtctatacggttttcagtttgatcagccagaatggtaataaaaaagtatctggattctcaccagcctaaacgccagccaagctaatgtctacatgcagacattagcttttttcattgtttaataggctgtcgtcaggattctagaagactttctcgtaatagtcttctcctgtcacatgaagcccaaatgacaggggaaatgtatatcattcacactttccgtcgtgaaaatgtaaatgtattcataaaaatcccgcagcatatcagcagtgcgccgaggataatattgatggtgatctgttcgtgcaattgcagccatccaaagaatagggccaatacgggaacaaacattaatgccatggatgcttttgacgcttggatttgattgagcacccaaaaccatacgacaaaggtaaagccggtggaaagcaagccattaaacagcaatgaccacaccgcctgatatgtccactcggctgaagggaccgcctcaaatataaaggaaaacaccaataacatgacggctcccatcataaggtgccaggcattcatgtgaataatatcgatatgcttgaattgtagcttgctgaacacattcgcgattccccagctaagcgctgccacaagtacgcacagctccccaaataaagcgctttgatcgatattgagcatttcctttccaaatataaataacagtccgaagaggccgcagaccagtcccatcgttttatacacattcattttctcgtttaatgaaaaatggctgatcaccgtaacaaatataggcattgtatataccaaaacagaggttttccctgaatcgacaaactgcattccatacgtcaaaatccccatatagcccagccccatcaacaggctcatgatgatatagcttttgagatgttctttttgaattgaaagcttttttctttggatgaagagaatgagaaataaaggaactgctccgatgaacaggcgcaaacccgaaaataaaagcggggggatgtcatgaattcctactttcatcgcaacccaagtataaccccaaataagtgtgacagatatgattcccagcataacttttaccataatgaagccgcctttcttgttaaaatatcgtgctggtttctatcatatgttacatttatgtataactgaaatacatttttattattgggggtataaccaaatggttatgaacatgaaccatcttcacatatttgtaaaagttggggagaaattaaatattacagaagcggcaaaagaattgttcatctctcagccggcggtaagtaaagcgataaaaaacctggagagctcactgcagctcaaattattgatcagggataaacatcatggtttaatgctgactgacatcggaaaagaaatattgctgctggcgaggcaaatgaagggaattgaaagcaaaatatatcaagtagccaaccgggaaaacaagctgttaaacgggaaggtgaaaattggttcatttcctgcagtttcaacaaatatcatgccacaggcgattgcggcattcagatcaaactacccgctgatccgcatagaattgatcgaaggaacctctgaccaaataaaaggatgggttgaagatcggacggttgatatcgggatcgcagcatctccatttgaaccgtttgaaaatcagctattgtgtaacgactatatggtggccgtcatcccgccgcagcgtgacgaattaaaacttgaaaagcatgtcgaccttgaaacatatcaagatgacctcattttttgtaaaggcggtcatgaaatcgcgatgtcaaacgcattttcgcaatacaacatcgaattaaaggaaaacttaactgtgcaaaatgccgaaaccttgattaatatggtcaaaaataacttgggtatcggcatcatttcaaactttacactttcatccgtcccgcatcaattgattaaaaaggacatctttcctagggtcacacgcgatattggcgtcatcgcacattcatttgaagagataacgccggcggcgcatgagtttgtcaaagtgttgaaagcagttgtaatctgaatcagttatcgtgttgcgatgaaatttgaagaagatgaatactcaccggcagagttacataaaagaaaaaagcaaccatttgaacgttgcttttcactctatttgggagcttgtatgcgtatgctaagaaaaagattcatccatctctgcctttgtgggactctgctccttaacttgttttaatgatgctactataagaaagctaacaatcactagcaagagccatgaacttacctttccaaggtgtacgagactccatgtatcgatttggtttggatatttccaagctccaaaaaacgtagcgatattttccgctatccatataaaaaatccgatgagtataaaagaaagtgcgagcggcatacggtaacgagctccattcacctcgtatgtaacccatgtttgccaaaagacaatgatgacaagccctgataaccaccatcgaatgtctatagaaaaatggtgggtgaaaaaattcaaataaatcgctgcggcaagcggaacaactgcaaaaaaagacggccacttaaccagttcaaccttaagccttctccatgcctggcacaaataactggctacacttgcgtacataaagccgctatacaaaggtactccaaatattttggagtatccttcttctggataagaccaggagcccatatggactttaaaaagttccagagcaagcccaataaggtggaataatgtgatcacttttaattcatcccgtgtctcaagaccggaacgcaccatccacaattgcatgagaacgcagataatgagcagccagtcataccgcggcaagaagggcagtgggatgatttgcgtaatagccaaagaggcaaaaataacggcaggaaacaaacatgaaagggcttgttcccagccaaaatggacgatttgttttatggctctcatgatgtatgcctcctccatagttgtgttcttcgtgtgtgaaagggacgcttagtatagcagctagatggatataagtttatgtccataagctcaccgccaatcactttattttctgttgatccttcatatttttctttacgaatcctgtgtcttcatcacttcggtattccaatatatccccgggctgacattctaaagccttgcaaatcgcttctaaagttgataatcgaatagcctttgcttttccgttttttaatatcgaaagattagccatggtgatgccaactctctctgaaagctctgttacgctcattttcctcttagcaagcatcacatcaatgttgataataatcgccatgtcatcacctcagaccgttaagtcattttctgattttatatcaatcgcttcttttaacagtttttgaagaacagcagcaaagaccgcaatcaccattgaagcaaaaataataaccaatccgatcacaatgatacccggggcgtcgtctatctcggccatcagataaaagacaggcatgcctgctgcgtaaaagatactgatagtgactgcgcaatattttatattcttcaaagctcttacagacaaacccgagaaagctttgtttttgtcaatatagcttaaaagtttgaacgcttgataaagagcaaagtaaaaaggtatcgccgttacatacaaatagatgaaaacgagatattttatataagcgatatttggaaataattctgctgaatagttggctaccttaggcactaaaaaaatgcataaagcaagaattggaattccaataagaaccaaagctatctttaaaaaaattgtcgacattcgattcataacaagcacctcatttatttgttgtctaattgaatgtaacaaaaaatttatcgtttctcaataaaaaaatattgaaatggattgattttttgttgttataggagacccttttcatttttgacaagacaaaaaagcatccctcatcactgggagatgctgaactacttcaaacttgccgactgaatgaaccgtgtgcctcagtgagctcagggatcggtgtgaacataaagctaagctcttttatgaaggtttttatcaacgtctaaagattcaaacaaacgatgggaagaaatacatcaaaggataagcggctgttcatactaatgattgggaggtaaaccgacttatgatacaaattttgatcactggtctttttttattggctcagccgagtgagccgcaggacagtttaacggtcacacagcaaggacggacgattgccactgttaaccgtgaagactttacaatgcctcttcccggcactccaatggttgactatgaaaaatacagtaaattcatcaaacagcttgatcagaaagtgtaccgtgagccgataaatgctgtccttaacgatcatggaagcatcgtcccgggcagggttggctacaaactgtatcaacaggcgtttatggaaaagttttatgcgtatttttatgggcaaggtccctccaagatagaagtgccggaaatgaacatttatccgaaagttgacagcgagctgctagctcacatcagtacgcagcagcttggtcagtacgtgacgtattttaactcaagcaataaaagccgttcacacaatatttctctttctgcaaaagcaatcgacaatcacgttgttttccctaatgagacgttttcgtttaaccaagttgtgggaatgagaactcggaacaaaggatataaaagtgcacccattattgtaaaaggggagttgtctgaaggtgtaggaggaggaatttgtcaggtgtcctcaactctatttaatgcagtagatcgtgcaggactgcagatcgttcagcgctattctcatactagaagtgtaccatatgtaccgcccggacgggatgcgacggtaagctggggaggtcctgactttcgctttcaaaaccaatataaccaaccaatcttaattcgggcaaaaaggtatgggggaagtatgattattacgctatactcttctgatgtgattaacagcagattgagaaaaatccccaaagctccttctcggataccgaaagaaataaatgcagagcagtaaagacaaaacctcaggtaaggttttggttaagagagcttgtagattgctcaaaatcaattctttaaggagcggccagtgaaaggaaggagggataaatgaagtgaaaagggtattattttctgtaattgtttttacagcagttggatttacgttttgccaatcaaaagcgcatgccctgacttttacggtgttgcctattacacaaaaaacagaccagtggtcagtaaaagtaagtgaagcaaaaaatgtaaaggaatttacgagacctcataaaggagaatatcaagtatattccttggaagtcaaaaatataggggaaaaagcagctacagtggatgtgcaattgtatagaaatgaccctaattcaatcacaaggttttcgctttttggatgtcccgatgaaaattgtgtcaaaccaaaagaagattctaaaatgttagctgaaagtttaaatgatggctcaccgctgaagttcaatcattttatgctggcagataaggcctctgaattagaggttgttataatttggacacagaaggggcaagaaggacgcaatttaaaacagacctttaaattcactgaagatggcgttaattagacagtaaagatggaatggctttgatgattcgatctcttactttgcctgaggaaaaacgaaaaattgttggaaaaccaatcatagctgagtcaaatgtcaaagtgactgtgattaatgactatagagaagaaccagaggaggccttttggatactttatccgatgggagtgaaatgtttgtcgatgatcacaaagtctttattgaatacgaatagagactttgtgactgactgcgcatttcaacttaacattttactgataatgacagtgaaacctaaacaagtgcaacctgtttcatcattaaaaaccgctaatttcaaaattttctatgtcaagatttagttttttcaattgtttcaacaaaacttcaaattttaagcaattgccatttttcaattcttctggaatatcttccggatgagcaattaccatcccgctctcaagccattgtttgcgatacaattgaaatgcagcctcaattaaatgatcaggagttacaataaaacctaacctcacatcatgatcctcactgtagccaaattcaaaaccgcaacatggacaaatgtcaaacgttttttgatactcgcctttatacaaaggattttgaattaatcctttgtatccgcaaattaaacaagaataacatttttccaccaagtttaattccccttttatcacttatttactattgctgtcccgtaacaaatattacttcaaataaaaaacttcgtgtactgtatttatagcataagcagtgcatctaatcctcaaagatgaacacactttggatttgaaatgggtgatataggaatcaagataatatctgaataaaagaagggttttacagttaattggcaaaatggaaaagaaaaagtatttaagttggaacgggtatttattctattaggcatgtaaagtgtgaagttgaattccatgtaattatgttaaaggggggaaagaggagatgtgctacattgaaatcacaaaggacaatattgaagacaatcatatttgctgtgcattaggcacgaaacaatatgagcatgcagttaatgaaaagaagagatggctcaaagctcgaatggatgaaggattggtgttctatcgcttacatgaacgggcaaaagtctttattgaatacctacctgcgaatgaggcatgggtgcctatcaatgcgcctaattttatgtacattaattgtctgtgggtgtctggcagatataaaaataacggtcatgcgaaacgattgttggacaaatgtatagcagatgcgaaagcgtgcggcatggatggcattatccatatcgcaggcaagaaaaaactgccctatttaagtgataagcatttctttgagcatatggggtttactctacaagatgaagctgccccttattttcaattaatggctttgacttggaatggccttgcagattctcctgcatttaagagccaggtgaaaagtgattctatcaatgaaaaggggattacgatatactatacagctcagtgtccgtttgcagtgggcatgataaatgatttgcgggaattgactgaaaagaaaggggttcaatttcagtcaattcagttatcatcgaaagaagaggcacaaaagtcaccagctatttggacaacttttagcgttttttttgatgggagatttgtgactcacgagatcatgagtataaataaatttgaaaagttacttaatacactagcttgatttttaataataaaaagccattttaaggttcttgactcaatgaaacaaaaaatgcatttaagagctgttatacgttttaatcttgtctttagaaagcactttaatttaagtcaaaagtttagacagtcatctgttagatcattagccctttcttattttcttttcggtaacattttgatcgtattttcctactaaaaagttaggaaagtgaggaaaaacatgagaaaaaagaacaatattaagaaatggctattgatcattgctggattcttgatcatctgcatcatcacattatttgtaatggtgtcagggaacaaagtgaaatatgagggcagcgggaaaagcggactgtggatgtctaaccttgaaaaatcagacaaaacttcaattggacccaattattttctaaatctatattggcaggggagtaagaaggaagaaaagtggactgttgttgaaagaattactctgtatgtagatggcgaaaagtatcaagatgataacgtagatgagtacgacttatcggagtacacaggtgatgaaatgccgggtgggggacgcatggaggaccatatttccacctttgattatatgcctgaagatgaagtgataggtcatgatgtattagtaaaagtggagtggaggacaggccagaaaaaacagacagaagcaatcaaattacataagaagccatggtataaaaaatagtttatttgatgtatttgtgatcacattggtggtcacttttttatttgcggattcctaggcacagcaatctaagattctgcataggctgaaataaaatcttgttcatttctaaaacgaggtgcatgctgttggaacaacaaccaatcaatcatgaagacagaaacgtgccgcagcctattcgaagtgatggagctggagctattgatacaggcccgcgaaatataatacgggatattcaaaatccgaatatatttgttccgcctgttacagatgagggtatgattcctaacttgagattttcattctcagacgctcccatgaaattagatcacggcggctggtcaagagaaatcaccgtaagacagcttccgatttcgactgcgattgcaggtgtaaacatgagcttaactgcgggaggcgtccgcgagcttcattggcataagcaagcggagtgggcttatatgcttttgggacgggcacgtatcaccgctgttgaccaagacggacgaaatttcattgctgatgttggtcccggcgacctttggtacttcccggcaggaattccgcattccatacagggattggaacactgcgagtttctgctcgttttcgatgatgggaacttttctgagttttcaacgttaaccatttcagattggcttgcacacacaccaaaagatgttctgtctgcaaatttcggtgtcccggagaatgctttcaactctcttccgtctgagcaagtctatatctaccaagggaatgtgccgggatcagtcgccagtgaagacattcagtcaccatatggaaaagtccccatgacctttaaacacgagctgttaaatcaacccccaattcaaatgccaggggggagtgtacgaattgtggattcttctaacttcccaatttcaaaaacgatagccgctgcacttgttcagattgagcctggcgcgatgagagagcttcattggcatcccaatagcgatgagtggcaatattatctaacaggacagggacgaatgacggtatttatcggaaatgggactgcccgcacatttgattatagagcaggcgacgttggatacgtgccttctaatgccggacactatatacaaaacactggtacagaaacattatggtttttagaaatgttcaaaagtaaccgctatgcagatgtgtcactcaatcagtggatggcattgacgcctaaagaattagtacaaagcaacttgaatgctggatcagtcatgcttgattctctgcgcaagaagaaagtgcctgttgtgaaatatcccggtacgtaaagacgtaacagatcacacagctgcccttcatatctttttaaagtagatagagctgaattttggcctgtgttttattaaatccctatatatacgttatgtagggtttttctgcttgaatcgtattgtaatgagctttaaaatgttaatgtggaaatgaaatggtaaccattcgataatggggattcaatggccgatttctaccagtttgattggctttaaaggaggagaagaaatgaaagcactcatatttttatccagtttgactgccattgggagctctatattggggcgatggttagggatgctggatgattcttatgctgttggcgatgcttggtttataggtgttttagctggattgatttcacttctaatattgattgacagtcaaacgatgacaaagaattacatagtaagtttaagtacgatactaggcattcttggagtgggatttatatattttccagctgcattcatcaacatattattaagtattacactggataaacaaaagaaagaagaccttcatgtaagatgaaagaaatttcattaaattcttaggagggaaagtgtatggatttacctctatgggcttatatcatatttgcaatccacaggtgcggcaggtttcataagtttaatgtggttcagtttttttgctgacaaaatagaaaagtgaagcgattttataaaaatgtaaactattttatatgaaaggaataacattgcttatttaagtttacataataaaattatttcaaactgatgctaaagataactaattgatctatgtactaaatattcataattactagagggattggcacctaaggaacaaagctatttgacaagttcttgctagagaattttttcaatcactacatatgattttctgcatcaagaagctcagctgaattatttttgggtgaatttactaatgatgaaacctggtatgcttccatgtcatcagcatcataaggcagcagcaaactttgcagataatcagggcttgtatttttggggttaagccactccttttcatgatcatgggccaatataaccggcattcggtcgtgtatatctttcatgaactcattaggctcagttgttatgatggtgcaggtataaagagggtatccttgatgtgtgctccacttttcatataagccagcaaacgcaaaaagagcagatgatttcaatttgatccgcattgggattttggttttggaatcaagccgtttccattcataaaaactgtctgctggtatgatgcagcgtttgctgacaagcggtcttcgaaaggccggtttctcggtaattgtttcggctcgagcattgatcattttataaccgatcttttcatcttttgcccaaggtggaataagtccccatctaagcttgcctaagcgattatttgatccatcattgatgattgcaaggatgttttgtgatggtgcgacattatagcttggctggtattcacctttaggaaaaaattgatcgatgtcaaactggtcaataatatcatcaaatgcagagtacaaagtaaacctgccgcacatatccatcatcctttttaggggtttttaagtagtttgtgggacgatcgttcatttaatacaggttcagaacaatgatttcttttcacttgcgataaactggtataataagaaagccagttaagaagttattgtggaaaagaacatatgctttttagtttgaccgacgctggatcttgatggaattacaaggatcgcttaaaaatagcctatagtataaaaagaggcacagcgtttttaacgcagggcctcttttatatcagtagccaaataccagagttgtactttgtgatccggcatatttcgtgacaaattcttttgtatattccggcgtttggacacgatagctatagtttgacccaggattccaagaagtcagcggagaggtttgcttgttgagtgatggatagctgcctatgtctttgaaataaccagtgcccttgtcgtcaaggatgccgcctttttcactgcctttcccaaagtaattatattcggaatatatttttgcttttgtagcaattgtaatcgcctggttaaaattattgctgtaattgtttttaacatgaaagtaaccgtatctcatcagacctgggcctctaacatacaagttctcaaaataattattggcgattgtcatgtgggggtagccgtcatattgatgctgagaatcatccgggtatcctaaaatcaaaccgtatttatgattcgcaaattttgagttgctgatcgtgatataatctgcggattttccgatatacacgagtttgtccaaatcgcttccgcttgcattatagctatgacctgagaatgtgacgtgatcaatccaatagttcataccggaatctaaataaagctggatatcattatttccgttaatctgcggactgtgttcaaacgttaaattttgaaaaatgacatttccagaagctgatgaagttgttaaataaatatttttcagcgtttttttcgcgtaagagcccacgagtgttttatttgagccaatggtaactgttgttttcgcagatgcggaaagatcattttgaagcactaaaattttcggagtggatcctcctagatgggtttttaaatcatttacgctttgaatgtaaacaatctgcccgttttttccacccgttgtgcccgttttagagatgcctttttcatttttggcatttccggcaaaacctaaaaggccatttgttgaggtattcggaaaatcgactgcacctaatgcttttccaggcaagagaaccaaaaacaagctaaagacggtgaaccataaacaaagtcgtttcatcacaatatgcttcctttcaattttaatcatttccttgcggggattattattacagttaatggaaaggaataataggttctatcttcctaattaatgttgggttacttaaaaaatagagattgcgccaaaagacatactaacaattgaaatagaagaaaggattgatacaccgttgactgcagcagcttatcgaaacaccttgctatcacttttatgtttaacagctggaatcgtggatgtaatcgggtatttaagcctgggacatgtgttcacagctaatatgactggaaacattgtattattggggttagctatcggcaaatccattcaggtcactgtttttaattccttgactgcgctaatcggatttatatgcggcgtgatcattgctacattgatggtcggaaaggcggaaaataccctttggccttctgctgtgacaaaagccctcgcacttgaagcattcattttgtttgtctttgcttgtctttctttttaccgggcatttgttcctgtgcacattctaattatactcatgagcatttctatggggattcaaactacagcagcaaaaaaactggggattgcaggtatttcttcaactgtgttgaccggcactttggcttctcttttagaggatatatccggccgtttgttttttaagaagcaaaagaagactttcttaagagatactgtgttaagagcactggctattattttgtattgtgtaggggctattattgttgctctggctgagcctgatttttatcacttcattatttgggttccgattgtgctgatctttggcatcatgatgacagctaagttgaaactgagcggggaaaaatagcttttcctgtatagctgttatcaggccaacagcctgtttcatttcgttattgaaatgcgaattttgagagggaaaaataagacattcggctgaagtgcacattcgttcatttgtattggctttttcataagtacctacatttgatatatgaatgatagtgaatttgccttaaaatcaactatgaatctatttcctctttcaaaccagatggattgagtcttataatgataatgattctcatttgaagtctggtttgaggaggaccaaatatgaaaaagatcatgagtgcatttgttggtatggttttgttgacgatcttctgtttttccccgcaagcttcggcagcatatgacgacctgcatgaaggttatgcaacgtatacagggtcaggctattcaggaggagctttcctgctggatcccattccttccgatatggagattactgcaataaatccggcggatctcaattacggaggagtaaaagcggcacttgccggctcttatttggaagttgaagggccaaaagggaaaacaaccgtatatgttactgatctttatcccgaaggcgctcggggagctcttgatctgtcacctaatgccttccgtaaaatcggcaatatgaaagacggaaaaatcaatattaaatggcgtgttgtcaaagccccaatcaccggcaatttcacgtaccggatcaaagaaggcagcagcaggtggtgggcagcaatccaagtcagaaatcacaagtatcctgttatgaaaatggaatatgaaaaggatggtaagtggatcaacatggagaaaatggactataaccattttgtgagtacgaatttaggtactggctctctcaaagtcagaatgactgacatccgcggaaaagttgtgaaagacaccattccaaagctgcctgaaagcggaacgtccaaagcctatacagtaccgggccatgttcagtttcctgaataaaaaatacgaaacagcggatcttttcccgctgttttttcaatgttctgtatctgcatgtaaaaatgttttaatcatgttcaactgctcctgctttggataactggtatacagcctgcttgaaatccgaataggatctccgaaaaaatatctttcgtagtgagtttgtctagttccgaatgaactcattgttaaatcccatgccaaacggaaaattttcacacgttcttcagcatttgtattggttgcttgaagatattggtcaagatcttcccgtatctctgagtcaaatgcattttcggtaggcagtgtcaccattccgctagctccaattaattgtatgatttcagtaaatcgaggatatagcttaggaatgatcgtactgatgacttgaagaggaattaaacaggggcgcatatagccgaattcatctaactgagcatcattttccgatttgtcaatgagggctttgattgtttccaatcccacaatgatttctgagagcttttcttggatgtgctgatattcggaaacattaatggtgtcgacaagaagctgtgcaacacctaatagaaattcaatttttatcatttgcctaatgacaacctggtgaaaggtaaaggcatgaaaagagctttttgtcataaaatctttagctgcttccacattatcgtaaaaaaacacacgattccacggcactaacacatgatcaaaaaccacaattgaatccatttcttcataccttgagcttaagggatgattaaaggaagagtcgcttaatacaaatgattctcttgtgatgaattttacgccttttgtattagaagggattgaaaaagcataagcttcatctgtttcaaagaaaaatttaggcgctgaaaaaaccaagatttcatcggtcaacccgccttgtgtggcaagcagtcgtgcgccatgaatcattaaacctttttcggttctatcaatgactttagcagatatcggtttttcacttagcccaaaataggactgtgaccggttcacttgcggagtaatgaatgtatgggtaaaggaaaggtcatgcttagcagcttgttcatacatatctagtatatgttcaggaaagcaattctctttatcttttagaagctccgctgacgaagcaaagctcatcataaccgtattcatgtaatccggacttctccccatcattccatgagtatgtctagcccaatgttcaatcatggtccttctttttttcaaatcattttttgttttaggctggagataggaaaggccgattcgattatgatctccaggaaggcaataagtcatttcatgtattaactcatcctttgtttgcaattcataaagtgagctttttgttttgattattcctttaaatgcaggatgctcagaaatgttaccctttattttttcgccatcataccatatttcgttttctagtttattcaatcggtcaatgaattctttaccattgatgatccccatttaagtttcgctccttcatattatgctgcgtattgtattatattttcgagaaaacagccggttcagccaatttgaggtgggaaaagccttttttagaaaaacgaataagagtgacttacataccgcaaaagactgcaaattttacttaaggtttttctgtaagttcagagacgtaaagaatttgcttattcatataagaatatcactataaaacttgataacacgtgtcgatattatggacatgagcgtaagcgaattggattcaaacgcgcttgaacatattttatttcagccattacattgtgcggaaagggaaaacgacacatgaaagtgaaaacaaaattgctggggattatatcaatattagttgtttcaattattggaattggaggctcctcagtatttatgatttcttctactgtgaaaaagaatgaagaacttaaagacaaaatggaattccaaaaagagataaaacacatccaatatgaattgaccgggttatcaaatgatgaaagaggcttcttgattaccagagacaaagaatacgacgagggtatgaagggaaaagcagacgatgtcttaaagagccttgaccgggttaatgacttgattgatgaagagaagtatcaatccaatattgaagacattaagacaagttttactcagtatagagctttgaatcagcaagtagtaacagcctactcttcaaatcctaaaaaagcagaaaccatccattttggagaagaaagaacaataagaaaagaaggcgtagctccggctgtcaataagctgtctgatcgcctggatcaagaggtagaggatctaaaggatgaaatacagggcaatgggaaaatgagtcaatcgctcattatcattgtcacagggatatcagtaatattaggcattgttctaagcataatgctgttaaagtccattatggtgccactaagaagcataaataagcagctggaggaaattgcacacggcgaggctgatttaaccaaaaaagtcattgtgaaaaataaagatgaatttggccagcttgcccaatcttttaattcttttactcattcattaactcaaattgtgaagcagatcagcagctcatctgaacaagtcgccgcttcctctgaagaattatcggcaagcgcggaagaatcgaaatcaacatctgaacatatttcacgagccatgcagatggctgccgacagcaatgtgaagcaaagctcaatgacagaaaagagcgcagaatccatcactgaattattagacagtatatcatcagtcgcttcaaatacagggaacatagcggatctttcttcttcgatgagagacaaggctgaaataggctctaagtccgtcaacaagatgttagaccagatgaaattcattgataaatctgtagattcagccggcaatggattgcaaacattggtagcgagcacagcagaaatcagcgatatctcttcgcttatcacgacgatttcagagcagacaaatttgttggcactaaatgcagcgatcgaggcggccagagccggagagcaaggaaaaggatttgctgtggtggcagaagaagttcggaagttggcggatgaaacaaataaatctgcaaaccacatccaatcggtggtagcgaccatccaaaacgaatcgatagaaacggtaaataatattaaagttgttcaagaaaatgtgagctcaggtattgttctttctcaagagacaacaggaaatttcaatgaaatactgaacctggtggaacaggtcacttctcaaatacaagaagttgcagcagcaactcaacagcttacttcaggcgttgaagtgattcagcacacagttcatacattggctgctggtacaaaagaaacgtcagcaaatacagaagcggttgcaaattcatcacaggaacagcttcattcaatgggggaaatctcctatgccgcagaatctctatctcagttggcagaagaacttcaaaccgtcattaatcgttttaaatattaaacaggctacttacgtgcaacccccatcttattcggtgggggttggctacttttactgtggttgtttctaaaaacagagttaactgacttcttttaagttagttccgtttgtatggctagtccaaattttgatcgattgtcccttcaaaatagtcatcgctgacctgttcatgagtttcagccaatcctttttctaattgcgtgcttcctttataatctgagggctcaaagtatttcccggcaacatctgttgtgtcatttttgttttctttgttatgagtttgtgtttcagtgtttacactttctgtctcagtattgctgcgtatagattgctgaaaatcatattccttgtctaatgaagaaaatcttttataatcatcaggtctgtctgcaccgtttttttgagtcactttacttcctccagattattgatattttagtgggggtaagaacttatttcgttctttcaggatcggaaccgtgttttttaggatcatctgctttaaaagctgtttcagtctcatggtcatttcttatttgttcaatacttgaattttgaatacctttcttactcattggtttcacccctttacgaaaagtgttgaaatatcaactcttcttattctgtctgttgggcaggtattcatgcactttttttcattcgcgctttggccaatcaggagaggcgttttcagccagcgtattatctaataaaagaacgtcatttttgaaaccttttattagcgcattgcgtatagcacgttagggaagacatctcgataaaagaaatacaaaggttgtgaatttatactaacagcactgtgaataaatcaaacaaggggggtgaaaaaatgaaaaaaatcgcatcatattatttaatgacattagggctatccagccttacatttggtttgttattagggttttattctttcgttatgtatggcgatatgataattgcattgtttacggcagcaattgctttattatacggttttgtggtgtatggcctttttgctgttccgctccaaatgaagttgcagaaaaaagcgagaactttcaatgtcatgtacctattgatttacagtgtggttgcttttatcgcagctttcctgttttttgttatcaatgaacctgcgtcaatagcatggacattgcaatcgtacttttattatatgttaagtattgcggctgcagtgatttactggttatgggattctctgatcctttataaacgtacagcttccggtgtataggctaatttttaccaatcggagaaatatggaggttcaataaaaattcaggatctaaaagctttaggtttcatatttttttaaaaaaatcctccgcggataaaggcgcagtatgggggcataatgagagcacacattcaaaccgaataggttttctaagtgttttacgatacatacgttcatcaagaacatcacgtcatcaaaggaatataaaaactattgttgtggaacgggcatcttgagttgtttgaggaaagaacatagatggtggtttatcgttttatcagcgcttatagcacaaagttttggtggcaggatccatacagctaaacagaggagagcgtgacaatgaatctcgctctcctcagatttgttttattcaccctgatgtttttcaactaatgtgaatgtccaatcttttaacatatgtttctggacatatttttttccgtttatttcgatgtaaggcaggtctgccatgtctccagctaactgttttgcttcagtcgttgttattcctaaaaaaagtccaatgtaaaagtaaatatcccgttcttttattaggaagatatcattttgttcattacctttggtttggttcctctgctttaagccttcaccgataaaatatccagccaaagcaataccaattcctaaaaaaacgtccatgtgtatgcctccattatgtcgatgttatgttatacgggcttggcatactccgggtttcattatttttcaaaccttttcaatctgtacacggcctgaaaaaaaggtggcgccgccgcccatatcggacaagcgatctggggttagcgcgtttacaagctgtttttttccttgttcatccgcccataatccttggctgacaacgacacctggcagcacttgttctccaactgcagcggtcagctcgcattctccccggctgttccaaattcgtacaggtgccccatcaacgattccgtgtttttcagcatcttttgtgttgataaagagctttggcgtcttttcaagcttgatgtgtttttcattattggaaaatgttgagtttaagaaattatggtttggccccggaacatacataaacggatgttcattatcggttacaagaggtgtatatgtcggtaaagcagggaagccgtcttgtttcattttttctgaatataattctatttttccgcttggcgttggaagttcgcccggaaacagcggcttttcacgtttcgctttcataaatgaatgcttagtaagtgaatcgtaatcaatctctgccaaatgcggattatctggatggtcaagcgcctggcggattaatacttcatctgaatctttaagctcctggtctgtgaatcccatggcttcagccagtaatcggaaaacctcagtgttagacttgctttccccatatctctcaatcaccggctgctgaagctgaatgtaatggtgccagtaggaggtgtaaaaatcagtattttcaaaagcggatgttgcaggcagtacaatgtccgcatatgcagccgtttccgttaaaaacaaatcatgaaccacagtaaacaagtcttcccgcagcaagccctgtctgactttgtttgcttcgggcgcgacgacggcagggttcgttccgtaaataaatagagagcgaatcggcgggtctgtttccaaaagcaccctgccaagctgattcatattaaacgacctcggggtgcgccctttcaataagtcgggccgctgcaaggcatttgtgttatattctaaaattccgctgttatgcttaattgcgccgccccctgtgtgcagccattggccggtgatcgccggaagacaggcaatcgtccttacaatcatccccccgttatcgtgatgctggggtccgtttccgattctgataaaagaaggggaggtttccccgtacatttttgccagtcggtaaatatcttcggtactgacaccggtgatcgtcgataccttttcaggatcatattgtttcacgtgttcacggagctcttcatagccaaccgtgtactcggacagaaatgcttcatcatgaaggttttctttaaataaaatgtgcatgatgccaagagcaagtgcactgtcggttcccggttttattgggataaaccaatctgcaagacgtcctgtttgatttttatgcacatcgatcacgacaattttggcacctttttttcgcgctttttgggcgatcgtaatttggtgcatatttgtgctgaccgcgttgattccccaaaaaataaatagttttgtatgaacggtttcctcaggatcgattcccgcgcttatgcccattgtatatttatagccttcagatcccgctttgctgcaaatcgtccgttcaagctggcttgaccccatgcggtaaaaaaagcggcggtccattccttcagctgtcaatttccccatatttccgtaaaagctgtaaggaagtatgctttcagctccctcttcatcaatcagctgtttccagcgggaggtgatcgtatcgattgcctctttccaggaaatcggttcaaatatcgcttggcctttcgcacctgttcgtttgagcggtgtagtcagccgcttttcatcatagatgcgctccgtcatattccggactttgttgcatatgtttccagctgtgacaggatgatcagggtctccttgcacttttacgattttcccgtcttttttatgtattaacaatccgcactgatccgggcagtccagcgagcaaacggatttgaaaatgccgttttgttgtgtggcaaaagatctcatggcccagttcctctctctagttagatattttgtaagaattataacatttccgatgataacgtcaattctgaaaaaaagagattgacatcaatctgagtcttctttatgataaacgtattcttcattctgaaaattacatactcaatattttctatccagagaggtggagggactggccctatgaaacctcggcaacattattgtgccaattccagcaagcgctagcttgaaagataggaaagcaaggtttataccggcgtctgcctgtaacagagcgcgcctatatatgaatctctttccatcttcggaaagagattttttttatgaaaaatacgatgaaaaggatgttttgcagcatgacggttttggttacagcaccgtacaacgaagaaggacgaaaagagcttgaaaacttgtttggctcagttgcttatcaatcttggaaggaacaaggtagggcatatcgggaggatgaactcattcagctgctaaaagcaacaaatgcgacaggcttgattactgaacttgatcaggtaacagacagcgtatttgcttctgttcccgaactttcatttgtcggtgtttgcaggggaatgccctcaaatgtggatgtggcagctgcctcaaaaaggggcatacctgttttttatacaccagggcggaatgcacaagccgttgccgaaatgtttattggaaatgtgatttcctttctgcgccataccagcgcctcgaatcagtggctgaaggatggagagtgggacagtgattacctgcaggcttatgtcaaatttaaaggaaatgagctaacaggaaaaacggttggcatgattgggttcggcgcagtcgggcaaaggattgcaaaactgctgactgcgtttgactgtaagataaaatattacgatccatacattcaagacgatcatccgttgtatgaaaaagcatctcttaaaacggtgttttcagacagcgatatcgtttctgtccatctgcctcgcactgaggaaacactcggactgatagatcggcaatattttgatctgatgaaagagagtgcgattttcgttaatacttcaagagcagttgttgtaaaccgtgaagatcttttatttgtattaaaagaacataaaatcagcggtgcgatactagacgttttttatcatgaacctccagaggaatcagattatgaattgatttcattgcctaatgttctggcaacaccgcatctcgctggagcaacatttgaagtggaggatcatcacgtgacgatactgaataaagccctcaaaaagtggaagggtgaaaaaactcttaatattcagacaatgtataacaaggacgcactgaaaacagggggataagaaaggaggctaacagaatgaaaaaacaaaaaggctatctcgtttttgatattggcacaggcaatgcgagggtagcggtcgtgagtgtaactggcagtgttctaacagttgaacgggaggacatcgagtattccacagagacgctttacccggacagccgttatttttctcctcaggtgctgtggaagcaggtgatgaatttggcaaaacgtgcgctatcccgttcgtgtgatattgacatcattggtttgacatcgacgagccaaagacaggggattgttttgattgatcaaaacggcaatccttttctcgggctgccgaacatcgataatcgcggccgagagtgggaggcgggcattcccgattgggaagagatatacagcagcacaggccgcctgccaactgcacttttttctgcgctcaagctttatggattaaaacagcgccagccctctttatgggaaaagactgcaagctttacaagcatcagtgattgggtgacgtaccaactgagcggaatattaacatatgaaccatcacaggcaacagaaaccctgctatttgatgtgaagcaaaacacttggtcagaagagatgtgcgacattttcggcttttctccatctatccttccgcctcttgtaagagcgggaacagcaattggaacgatagcaaatgaatatgcatccgaattaggcctttcaataaatgctaaggttatagcagggggcggggatacacagctggctgtcaaaagcaccggagctggacttgaggacattgtcattgtatcagggacaacaacgccaataaccaaaattactgaggatcatggcgacacaaaacataaagcctggttgaactgtcatacggatcaagggcattggcttgtggaaacgaatccgggaattaccggcttgaattatcaaaaattaaaacagattttttatccgaatgaaacgtacgaagtaatggaggaggagatttctgcacttgcaaaagaagaccatgcatgtgtagcggctctcggctcttatttatcggctgaaaagaatgcgttaacgagaggcggttttctttttgatgccccgctgtcagcacatttaaagagggcacattttgtacgtgcagcgctagaagagatcgcattttcaatcaaatggaactttgacattttaacagaggttactccgtttgaacgtgattatgtttgggtgtgcggagggggattccaaagcaaagcgctcactcaatatatcgcggatcttcttcaaaaaaaggtctatgtccaagagggatatcatcaggcatctgtcgtcggtgctgcagtcatttgcaatgaaacctttcaattaacggaggagatgtcagcaaatgtccgggtgatcgaaccgaaggactgtcagatagaattggctttatatgaggaatggaagcaaacacagcgctttttttcaggatcagaaagcaaagtattaatttaagacggaatttctgctgttttgaggaatcatttaattttcaactttaataaggtaatacggtaatgaataatagcatctaaggaggagacagatatgttggataaaataggaataccgaagcggcttgcctggggatttttaggggttgttttgtttatgatgggagatggccttgaacaaggctggctcagtccttttttgatcgaaaacgggctcaccgttcagcagtccgcttccatttttagtatatacggaattgcgcttgccatagcttcctggttttcgggtgtatgtctcgaagcatttggcgcaaaacgaacgatgtttatggggctgttgttttatgtgatcggtacagctgcttttatcgtatttggatttgaacagctgaacctgccagtgatgtatgtgacttacttcgtaaaagggttaggttacccgctttttgcttattctttcttgacatgggtcatttacagaacaccgcaaagcaaactgagcactgctgtcggctggttttggattgcatattgcctcggcatgtttgtgttcggcgcttggtactcaagctacgcgatcaaagcgttcggttatttgaatacgctttggagctctattttctgggtatgtctcggtgcattctttgcattgtttatcaataaagaccgttttgaaaagaagaaaagaaaaagatcagaaacagccgaggagcttttaaaaggggttacgattctatttacaaatccgcgcgtgcttacaggcggaatcatcagaatcatcaacagcattggtacatatggttttccagtctttttgccgatgcacatggcccagcatggaatttcaaccaatgtgtggctgcaaatttggggaacgattttcctggggaacattgtgtttaaccttatcttcggtattgtcggcgataaattcggctggaaaaatactgttatttggttcggcggagtcggctgcggcattttcaccgtcttattatactacgcacctgttttctccggcggaagtttagcggttgtcagcgtgatcggctttatttggggcggtttgctggcaggctatgtgccgattggtgcaattgtgccgacggtggcaggaaaagataaaggggcagccatgtctgtattgaatttagctgcaggtttatcagcgtttgtcggccctgcactcgcttggctgttcatcggtctcgtcggcgcgcaaggtgtcgtctggatctttgcggccctttaccttgcaagtgcggtcttgacaaaatgtattcatatacctgaggaaaaagcagttaaggaggaaacatctcctcaatatgcatcttaattagaaagcgccctgtttgaggggcgctttttatctttttaaaggaaaagggatgtggcacagaccaagagaataccgtcattctcttggtttcacaatagagtacacatttgtatcatatggagtcccattttgatacatgtactgtcttaaaacgccttctttttgaaaccccatttttagaagcagacgatttgatgcttcattatcggtaaatacaactgcgccaatacgcgacagtccaagggcagaaaatccgtaagatacgacctttgaaatgacttctgatgcaaatccgtttcgccaatgctccgggatgatttcataaccgatttccgcgcgcctatgcttttgggccagagcgtgaaagccaattgttccgatcagttctttagtgtcccgtctttcaattccccaccgtataccgcgtttttcttgatagagggcagcaaacgtttgaatcattgaaatggcctgttctatagattccatgttttcaagcccataatagcgtgtcacctcatcgtttgagaaacaagcaaaaatggcttccgcatcctgatctgtgatttgcctaagtataagccgatccgtttctaatataggaaacattcaaccactccccacgtttgtgtttttgtttatcatatcccttttatttcctcttttctatagcgaaatcaaccaatgcagcaaaggaacgaatttgtctttctagttgctctttgtttttgctgaattgtttcaaacgatggccgttcgcgcctgatggatggggaaagccgttaaggcaaatcaaattctggaggctgtgctgtctgatcaatgtttcacacactgtttcggccgcttttcctaacggaatgagaagagctggtcccgtcacatggttaagctctgcagggaagtgcccaaaagcataagtgcttaggataggagaatgagtgatagccggtttgtatccggtatagtttttttgctggataaagacaggatatttaataacggaagttgtatggagcatatgccgtaattctccaaaaagctttgcggcgctttgaatgccaaaagcttgcggcagcccgcataaatccagcatggtaataaggttatgtctcatcgatccggagaaacccgctgctatttttgtgtctactgccatttgctcaagagtcccgccttgcagcaggctttcggcggctgtttcgtacgctgtcttcatctgggaaaaaccaggcgtgatcccggcaatcacaagcgaggcatcccgattgataaattcattatgaggtgaatagtagatgccaagttcgttttcttgatggagacgaaatggatcagtaagtaaatcggactttgtaagtgaagagggaagaaaatgtactttttctgcgaactcttttaagcagctgcggtttataatcatgtgtaagcctcctcgaaaaatgagatcccatttgtccattctgatcgtaacaacgggatctcattcatccttatctgctattaaaatgtcctgcctgccacacctctttgactgcttggggaacttctttcacttcagctgcggtctgctgaagcgtgtatttttttatttggacatcctgctgaatcttcttttgtttttgcgtcagcagctctgtttctgtttttaatccttcgatttgtttttgcatagcctgcgtaacagaggaaagctcctttagtgcggggtctatttttttcttgttttggatcacggtaactcctaagaagataatagaaactgctaatactgcaagactgatataaactataatcatatgttcactccttttcttatgtcattaccctgtatccgtttttttaatcagaagaaatgatatttacacagttcgtttgatttgcgtattggatgtattgtacttataatgtgatatcgtacatatgtaaacaaagaaagggtgcttcaattgcaaagtttacaacataaaactgcactaatcacaggcggaggcagaggaattggccgcgctactgctctggcgcttgccaaagaaggcgtgaatatcgggttaattggccggacttccgctaatgtagaaaaagtggctgaagaagtcaaagcgcttggtgtaaaagctgcatttgctgctgcagatgtaaaagatgccgatcaggttaaccaagctgtagctcaagtgaaggaacagctcggtgatatcgatatcctcattaataatgccggcatcagcaaatttggcggtttcttagatctgtcagctgatgagtgggaaaatattattcaagtcaacctaatgggtgtgtaccatgtcactcgcgcggtgcttccggaaatgatcgaacgcaaagccggagacatcattaatatttcatctacagcgggccaaagaggagctgctgtaacaagtgcttacagcgcttctaaatttgccgttctcgggttaacagagtctcttatgcaagaagtgagaaaacataatatcagagtcagcgcgttaacgccgagcactgtcgctagtgatatgtctatcgaattgaacttaacagacggtaatcctgaaaaagttatgcagcctgaggatcttgctgagtacatggtggcacaactgaaattagatcctcgtattttcatcaaaacagcgggattatggtcaacaaatccttaaaaatgaaaacctgtctttcgacaggtttttttatttgaatgaaatccgtaccggtaaaatgagatatgtaaaccctggcaatcgtttaaattgaagatagcagtaaatgcaggctataatagaactaagaaaactatgtaccaaatgttcagtcgaaatttattttttccgctacacctataatcagtaaacatgaaataactggactatcagtctttaatataaagaaggaaaacaataaaagaaaattgaatatttagtacatagtgttgtcagtgacagaagaaggagtgcatatgatgaaagaagaaaaaaggagttcaacaggctttttagtgaaacagcgcgcatttttgaagctttatatgataacgatgacagagcaagagagactctatgggttaaagctgcttgaagtacttcggtctgaatttaaagagattggttttaaaccaaatcatacagaagtataccggtctttgcatgagcttcttgatgacgggatactaaaacaaattaaagtaaaaaaagaaggggctaagctccaggaagtcgtcctctatcaatttaaagattacgaagctgccaagctatataaaaaacagctgaaggtagagctggatcgctgtaaaaaactgattgaaaaagctctctcagataatttttaatagaaacaaacacccggcgcagcagtgtgaaccgggtgttttctgcttttcattatacatatttgtcgaaaagaaacaatacaaatcaataatggccttcaaacttgacatcatttcctcacgtggtaacattttaaacgtgtgaaaatgcgaacaaaaaagcgaacaaaggagatgttaccgatctttgatcaaaagaaagtagcctttataggagcaggatctatggcggaaggaatgatatcaggtatcgttcgagccaacaaaatcccgaaacaaaacatctgcgttacaaaccgcagcaatacagagcgattaactgaacttgaacttcaatatggcattaaaggcgccttgccgaaccaactatgtattgaagacatggatgtgctcattttggcaatgaagccaaaagacgccgaaaacgctctgtcatcactaaaatcacgtattcaaccccatcaattaatattgtcggtccttgccggcataactacctcttttattgaacaatcattgcttaatgaacagccggttgtcagagtgatgcccaacacttccagtatgattggcgcttctgcaacagctattgcccttggcaaatatgtgtcggaagacctgaagaagctggccgaagcattgctcggatgcatgggcgaagtctatacaatccaagaaaatcaaatggatatattcaccggaattgcaggcagcggacccgcgtatttttattatttaatggaattcattgaaaagacaggcgaggaagcgggcctcgataaacagttatctcgaagcatcggcgcacagacacttttaggtgccgcaaaaatgctcatggaaacaggagaacatcctgagatcttaagagataatatcacgtcaccgaacggaacgacagcagcggggctgcaagccttgaaaaagagcggcggcggagaagcgatttctcaagcaataaagcatgcggctaagcgttcaaaggaaatcagcgaagatatcgaaaaaactgcagcgccgctatcaggagtgataaagtgacgcctgatacaagcatgaaaagagtcgttgtgaagattggaagcagttcattaacaagccttcatggagaaatcagcattcgaaaattagaagcgttggtcgaccaggtcgtcaaactcaaagacgccggttatgaagtgattttggtttcctcaggcgcagtggcggcgggatatcggaagctcggatttatccaaaggcccgagaagcttccagaaaaacaagcatcagcttcaatcggccagggattgctaatggaggcttattcaaagctgtttttggcacacggctatgtcgcatcccaaattttaattacgagaagcgatttttctgatgaatatcgatacaacaatgtcaggaatacaatgaatgtactgctcgagcgcggcatcatcccgatcataaacgaaaatgacacagttaccgtcaatcggctcaagtttggcgacaatgatacgctcgcagcaaaagtcgcaggattgattgatgcagatatgcttgtgattttatcagatatagacggattatatgacggcaatccgcgcacaaatccagaagcgaaaaagatacagcgggtgagtgaaataacacctgacatcgaagcatgcgcaggtgacactggaagcatcgttggcaccggcggcatgcgctctaagcttgatgcgtttaaaatcgtaatggcgtctggcattaaaggtttcctaggtcaggcagatgctggcgatattttataccacgccgttcatgaacaggcggaaggcacctattttgaagcagaaggaacgcttccgttgaatcaaaaggagcaatggatcgcttttaattccggtccggaaggtgaaatgattttatcagatgattgttcacgaaaaataacaaacggacaatcgagtttatacctagacggtgtacagaagattaaagggaaattcaaaagcggttcagttgttcggctgatggattcaaaagggacggaaatcggccttggaatcgtcaattactcttctgtacagcttcaagaaccggaaaagaaaaaggaactgacaaatagagctctaattgatcaagaagcatttgtttgccatgtggatttttctttacctgtaaattaatttgcagaaaaaaacccgaagcttctatatagaagctcgggttcattttttttattgatactgctccagcttagagaaaaattgaatgacaaactcataaaaatcattcgcggaaggcgcaagctctctatttttcggtttaatgattccgacagtccgttttacttgagggaactcaattggaattttcacagtaaaacgaggtgttgtttcagcaaaagtactttcaggcagaagggtaacgcccattcctgcggacactaaccctttgatcgcatccaaatcctcaccctccgtggaaacgagaggagcaaagcctgcttgtttgcaagtatcgattgccatctctctaagtacaaatccttccgggaacaatacaaattggtcgttgcgcaaatcgattaaatgaaccgttttttgtttagcaagcggatgatttaatggaacaagcgcgtaaattttttcagtaaataatatttttcccgttatgtcagagaaattcgtcggcaccggccctaataaggccagatcaatatcgcggtttctgacagcttcaatcagaaacttataggagccttggcgcagcaaaaattcgacgtgcggatattcttctttaaacgctgaaatgacagtcggcaaaagctggctggcgaggcttgtaggaaagccgatctttaccgttccgcgatgcgggtcaagatactcatcaatttgctctttcgcataatcaatggctttcatcgccgttttcacatgaattaaaaattcttttccgattggcgtgagtttgatatttctcccttcacgctcaaataaggtcacatttaattcttcttcaagattggcaatttgtctgctgattgctgattgggccacatgcaaatgatcagcggcttctgaaacgtgttctctttcagccacctccataaaataacgcagttggcgcagctccatgtttgtctcacatccatctatctcattttgagattcttttgatctaaattatatattgtttatatcgttttgaaaacctacaatgattatagagttgttagattttatgaccggtattatcggaaattgatcgggggagaggaattatgacgtacaatcaaatgccaaaagctcaaggtctctaccgtcctgaatttgaacatgatgcatgcggaatcggcctatatgcacacttaaagggcaagcagactcacgacattgtcaaacaaggacttaagatgctttgccagctagaccatagaggagggcaaggcagtgatccggatacaggagacggagccggcttactggttcaaatccctgatgctttctttagaaaagagtgcaaaaacatcaatctgccagaaaaagaacgttacggggtaggaatggtctttttctcacagaaggaagatgaaagaaaaaaaattgaaaagcaaatcaatgcactaattgaacaagaaggccaagtcgttcttggatggagaactgtacctgtaaatgtcggaaaaatcggaacagtggcgcaaaaaagctgtccgtttgtccgtcaggtatttatcggcgcaagttctgatctaaaggacaatttatcttttgaacgaaaattgtatgtcattcgtaaacaggctgaaaattggggagtaacggaaggtcttgatttttattttgccagtctttcaagccagaccattgtttacaaaggccttttaacacctgaacaggttgatgcattttattctgatctgcaagacgaagcattcgtttctgcttttgcgcttgttcattcacgcttcagtaccaatacattccctacatgggaaagagcgcatcctaaccgctatttggttcacaacggtgaaattaacacccttcgcggaaatatcaactggatgagagcacgtgagcagcaatttgtttctgaaagcttcggtgaggacttaaacaagattttgccgattctcaatgctgatggcagtgactcttccattttggataacgcatttgagttttttgtgatggctggacgcaaaccggcacatacggcaatgatgctcattccagagccttggacggaaaatacgcatatgtccaaggaaaaaagggcgttctacgagtaccatagctccctgatggagccttgggacggaccgacagctatttcatttactgacggtaaacaaatcggggcgatccttgaccggaacggtctccgtccggcccgttattatgtcacaaaagatgattatattattttctcatctgaagtaggcgttattgaagttgaacaggagaacgttttatataaaaaccgccttgagcctgggaaaatgcttttaatcgacctggaagaaggccgtattatctccgatgaggaagtcaaaacacaaattgcaactgagtatccgtaccaaaaatggcttgaagaagagcttgtacaagtaaatcctgatccggagtcaagagaagaagaacaatttagtgatcttcttactcgccagaaggcattcggatacacatatgaggatatccaaaagtatctaattcctgttattaaagaaggcaaagatccccttggttcaatggggaatgacgctccgcttgctgtactttctgaccgagcgcaatcgctgtttaactactttaaacagctgtttgcacaagtaacgaacccgccaatcgacgcgattcgtgagcagcttgtcacttcaacgatgacttggctcggtgcggaaggcgatcttcttcatccaagtgaacgaaatgttcgccggattaaactgtatacacctgttttatccaatgaacagttttacgcattgaaaacgattgttcatcctgatttaaaaagccaaaaaattgatgtgctgttttcagaggatcttgaacgcggtttaaaggacatgttcacacaggcagagaaagccatcagccaaggcgtaagtttgttaattttatcagacaaaaagatgaacgaacgactgacaccaattccgccgcttctggcagtaagcgcactgcaccagcacttaatccgcaaagggctgcgtacgaaggtcagcattattgtggaatcgggagaagcacgtgaagtgcatcactttgcagcgttaatcggttatggcgcagatgcgattaacccttatctcgcttatgcgacctacaagcaggaaattgatgaaggccgtttggatatcagctatgaagaagcggttagcaaatatggaaaaagcattactgagggcgtcgtaaaagtgatgtccaagatgggaatttcaactgtgcaaagctacagaggcgcacaaatctttgaggcggtaggaatcagccgcgatgtgatcgaccgctatttctcaggtactgcatcacagctaggcggcatcgatttacaaacaattgcagaagaggcacagcgccgccaccgggaagcgtatcaggatgattacagcaaaacgcttgaaccgggaagtgacttccaatggagaaatggcggagagcatcatgcgtttaatccgaaaacgattcatactttgcaatgggcgtgccgcagaaatgattacaatctgtttaaacagtatacaaaagcggctgatgaagaacgcatcggatttttgcggaacttgttcgcatttgacggaaaccgcaagcctttgaagttggaggaggttgaatccgctgaatcgattgtcaaacgttttaaaacgggtgcgatgtcattcgggtccttgagtaaggaagcgcacgaagctttagcaatcgcaatgaaccgtcttggaggaaaaagcaacagcggtgaaggcggagaagatcccaaacgctttgttccagatgagaacggcgatgatagaagaagtgcgatcaaacaaattgcatccggacggtttggtgtcaaaagccattacctcgtcaatgctgatgagctgcagattaaaatggctcaaggtgctaagccgggtgaaggcgggcagcttcctggcaacaaggtatatccatgggttgccgatgtccgtgggtcaacgccaggtgtcggattaatctcacctccgccacaccatgacatttattcgattgaggatttagcccagctgatccacgatttgaaaaatgccaaccgtgacgcaagaatcagcgtaaagctggtgtcaaaagcaggtgtaggaacaatcgctgcaggtgttgccaaagcgactgcagatgtcattgtgatcagcggctatgacggaggtacaggcgcttctccgaaaaccagtattaaacatacagggcttccgtgggagcttggccttgcagaagcacatcaaacactaatgctgaacggacttcgtgaccgtgttgtattagaaacagatggaaagctcatgacgggccgcgacgttgtgatggctgccttgctcggcgccgaagaatttggtttcgcaacggctccgttagttgtactcggctgtgtcatgatgcgtgcctgccatttggatacatgccctgtcggtgtagcgacacaaaatccagagcttcgcaaaaagttcatgggagatcctgaccatattgtgaactatatgctgttcattgccgaagaagttcgtgagtacatggctgcgttaggcttcaagacatttgatgaaatgatcggccgcactgatgtacttcatgtaagtgaacgggcaaaggagcactggaaagcaagccagcttgatttgtctacccttctttatcagcctgaaggggtgcggacgttccaatcgccgcaaaatcataaaattgatcaatcacttgatattacaacaattctcccggccgtacaagaagccatcgaatctggaaaagaagctgatatttcgattgaaatcaataatacaaatcgtgtagccggaacgataaccggcagtgaaatctcaaagcgttacggagaagaaggtcttcctgaagatacaatcaagctgcactttaccggatcagccggccaaagctttggagctttcgttcctaaagggatgacgctttatttggacggagactcaaatgattacgtcggaaaagggctttctggcggaaaaatcatcgtcaagtcatcagaaggattcaactctgcttcggatgacaatgtcattatcggcaacgtggctttttacggtgcgacaagcggagaagcatatattaacgggcgtgctggtgaacgctttgccgttcgaaacagcggtgtgaacgtagttgtagaaggcatcggcgaccacggctgtgaatacatgactggcggcagcgttgtcgttctcggtgatgtaggcaaaaactttgcggcaggtatgtccggcggaatcgcttatgtactgaccgaagatgtcaaagcgtttaaacgcaaatgcaaccttgagatgattttatttgaatcattagaggatgagaaagaaatccagcaaatcaaagcaatgcttgaaagacatactgcgtatacaaacagccaaaaagcagaagatctgctagatcaatgggaagacagtgtgaaaaaattcgtcaaagtcattccgaaaaactataaacaaatgctcgcaagcatcgaagagcaaaaagctgcaggtttatcagatgaagaagccatcatgttcgcttttgaggccaacacgaagccaaagcagaatacagcagcatcgggacaaaaacaagcggtagtacagtaaggaaggggagaggaacatggggaaaccaactggatttatggagatcaaacgagaaaaacctgcggagcgggaccctctcactcgcttaaaggattggaaagaatattctgctcctttttcagaagaagcatcgaaacggcaaggggcgcggtgtatggattgcggtacaccgttttgccagatcggtgcggacattaacggatttacatccggctgtccgatttacaacttaattcctgaatggaatgatcttgtctaccggggcagatggaaggaagcattggaacgtctgttgaaaacaaacaactttcctgaattcacagggcgggtatgccccgctccttgtgaaggatcatgcactttagcgatttcagatccggccgtatcaattaaaaacatcgagcggaccattatcgataaaggatttgagaacggctggattcaacctagaattccaaaaaaacgaacaggcaaaaaagtggccatcgtcgggtcaggcccagccggactggcgagtgctgaccagctgaatcaagcgggacattccgtcactgtttttgaacgagcagacagagcgggcggccttttaacatacggcattccaaacatgaagcttgagaagggcattgtagaacgccgaattaaattgctgacgcaagagggaattgattttgtcacgaacacagaaatcggtgttgacattacagctgatgagctaaaggagcaatttgatgctgtgatcttatgcacaggcgctcaaaaacagcgggacctcttaatcgaaggacgcgactcaaaaggagtccattacgcaatggactacctcacacttgcaacaaaaagctatttagattctaattttaaagacaagcaattcattgatgccaaagggaaagatgtcatcgtaatcggaggcggagatacaggagctgactgtgtggctaccgctctgcgtcaaaaagccaaaagcgtgcaccaattcggcaaacacccgaaacttccgccagcccgcacgaatgacaatatgtggcctgaacagccacacgtctttacgcttgaatatgcatacgaggaagcagaagcaaaattcggaagagatccgagagaatactccattcaaacgacaaaaatggtcgcggataaaaacggaaagctgaaagagcttcataccatccaaatggaaaaagtgaaaaatgagcatggaaaatacgagttccgcgagctgcctggaacggaaaaagtatggcctgctcagcttgtctttatcgctatcggctttgaaggcacagaacagccgctgttgaaacagttcggtgttaattcagtaaataacaaaatcagtgcagcatatggggattatcaaacaaatatcgatggtgtattcgccgcaggggatgcaagaagagggcaaagcttaatcgtatgggcgattaatgaaggccgtgaagtggcgcgtgaagtggatcgatatttgatggggagttcagttcttccgtaaataaaggggattatcatataagagaaaccggtctggctgccagccggtttcttttttattccattacgatcccgatgtttccaaactgtctgccttcctgcattcttttatatgcttcacatgctttttctaaaggatatatccggtcaattacaggccgcagcttatgtttgtcaatgaaagcgagcatagcttgaaattcctcaccgcttcccatcgaggttcccaaaacattgacctgaggaaagaataaagaacgcaccggaaaactgagattatcccctgagcttgccccaaagctgacaatacggccatttggttttacatggcggaagtattccgaaaagagggcaggtcctatgctgtcaagaacaacatctatcttttttccctgcaactgctcatcccaattgctgtagctgtcaaatgcgtaatcagcacctaatttcagcgccttttttcttttctcctcactgcgggaggtcacgcttactgttgccccaatcgccttagccataaataaagcgtaggttgctacaccgctgccgatgccgggtatcaatagatgctcgcctttttttaattgcccctttgtaaacagagcccgatatgcagttaaagcggataaaggtaaaacgcccgcttcttcccaagataaataagcaggttttttgattgcattttgtgaaggaatgatcacatattcagcaagtgttccgtccgaaggacctcccagaatctcaggtacaggtggaacattttctgtcaaatcccagttcaatgtcgggaaaatgactacttctgtctgaacagtaacatttttcacgccttcaccaatctcttcgatgatacccgcgccgtcagaacccagtatcatgtgaggatcttgttcagatttgtttttcataagaaacaagtcacgatgattcaggcctgcagattttaatttaacctttacctctccgtatccaggctttgttgatggaacgtcctgaactgataaccccagaagaccggcttttccgttgtgaattacagctttcatgctgtctgcctcctcattaattgtattttcatatctttacatattttacatagcggttttcttcgagtaaaatgaacaaatatgatagccaatatcacttttcatcatagcaagcaggtgagagcgcgtggaaagcggagatttaaagatttttcaggctgttgctcgcgaaggaagcataacgaaagcagcccaaatgctgaattatgttcagtcgaatgtgacagccagagtgcataaccttgaggaagatttgaatatcaggctttttcatcgaacgaatcggggaatgaagctgactgctgcaggagaaaatcttttacaatatgcagatcaagtattatcgctgttagaccaagctgaaaaatcgacccgaatgagcaggcaaccaaaagggcctttgcggatcggatcactggaaacaatggcggtaacgcatctgcctgagcatgcagcatccttcctcaggcgttttcctgaagtggatttatcagtgaacacagctgatacgcatcatttgattcaacaggttcttgatcataaagttgatggcgcttttgtatatgggccggttgaacacgctgcagttagacaactccatgtctcccatgatgaattagttttgatttcatcacgagaagggacggcagaagacatgcttcagcagccgatgctcttttttggggctggctgttctcatcgtgacagggtcaaaagattactagaggaagcaggcatacacaatcaaaaaatcatagagtttggcacattggaggctattataaaaggtgtttccgccgggatgggtacggcgctgctcccaaagtccgctgttgacggctccgagcatcgtacaaatgtatggattcatcagctgccaccatcatatcaagacttagagatcgtctttatatacaggaaagacttttttattacgagtgcgtttcagacatttcttgatgagataaacgaaatgaaaagatgaagatagacgtgcattagcagaataaagacgtttgtcagtttttattttaaagatctgcatgaaaaaactgtactcatttgaagcgagtacagttttttatttatttacgttttaaattaatgccgatcgccgcgccgtttctgcttgaatcagctacacctttaaaggtgccgttttcatggtcgatcgatatactttgcacgtttccgatatccaccggacttgtgccgaatttgtggcccatgccgtttagcttgctgaggacatctttaggaactccgtcttcgtaacggtaagagctcatgctgtttgtgtaaattctcggctcttcaacagctgcttttaattccataccatattcaatgtggtagagaatggtttgcaaaacggatgaaataattgtggccccgccaggagatccaaccgtgaggacaggcttgtcatccttaaataaaatcgtcggggtcatgctgcttaaaggccgtttgtttggctgtacttcgttagctccgcctggtatcgcatcaaaatccgttaattcattgtttaaaataacaccgtaatcagggaccataatacccgttccgaatagctgttcgattgttgttgtataagaaacaacatttccccaacggtcagcaactgtaaagtgggttgtttggccttctactttgtctttcggctgttcaacttgtttatagtttgctgatccttcttggtatttccaagggtcaccggctttcggttttttattcacttgatctaggttgattaattgctggcgttctttaatataatcggggtgaagcaggcctttgagaggaacatttacaaattcgggatcacctgcgtaagacgcacggtcggcatatgacaaatgcatcgtttcagcaagcagctgatatttttcccatgagcggacatcgtattgtgaaaggttaaaatgatcaaggattttcagcatttgcaataagaaaataccgccggagcttggaggaggagtagtagcgatttgatagccttgataatctccccaaatcggttcatcaattgtaatgtcgtaattttctaaatctttttctgtcattgatccgccgaaatcctggacagtgtcagaaagcgtcttggcgaattttcctttataaaaagcgtcagtgcctttggagcgaataagcttaaatgttttagccaaatccttttgaataagggtatctccttctttaagcggttcgccatttggtaaaaatacatcttttgcggcagtccgtgaaagcttttcctgataatcagaaatggcctctgccaacaccgaatcaatcggaaagcctttttcagcgagtttaatagaaggggtaattaattgcttcatcgaacgggttccccatttatccaaggcttcttccagccctttcagagtgcctggaacaccaacggcagtaccttttgttacacgttcagagaaaggaattgctttgccgttttcgtccagaaacatatcaggagttgcgcctgctggagcacgctcacggctgtcgattatcgttgtatccttcgtttttccgtcatacaccatcataaaaccgccgccgccaatacctgacatcatcggctctgttacattgagtgcaaattgaatggcaaccgctgcgtcaatagcatttcctccttttttcagcacatcagcaccgatttcagaagcaagaggatgtgcggtcgcaaccatgccgtcttttccaacatctacttgtttgtactcatcgtagcttttgggcggttttttagcttccgcgtgaaaagggacacttccagcgactaacagaacactaagcagagctgttaaacagacgttccacgttcttttcatgttctccctcctatatgaagctgtattgttacaatcttagcgtaaaaaaattacagcgttttcacaagtgacaaatggtatattatatagtgcataatgccgtttttctgtgcaaaattgattatattgatatgagccatgtgctatattagaatcagcatacggattaagaagggactgctatatgtatttaacgattgaagaaacagcagaatatacaaatctttcagaggattatattaaaagcctggtgctcgaagggaaaatcagagccgttcatgacggagagcaatttttgatttataaagagcagttcaaaacgcatctcgaacagctggagaattacaaagcacttgtgcaggaaatattaaatgaaccgatcccggaagatattgatgtaaaggatgaggattaggacacaatttgaagttgtgtcttttttttatgtttttttgcggaagctccagaaaattgggagcgtcagatttcgttttaagaggatttttgaggattagtagggggataagtatccaagagattaaaagctttataagaggctttaaagcttattttatagggtgaaggttttaagaagcttttttaaaagcttatgtaacactatgtatattatgttacattaacgccgctgcactttgacattcaacgtttttcagctataatagtaacatagacctcaaaacgttacatgacggtttttaaggagttttttgatgcatattgtacagccgattcgcagtctagagaaaatccaagaagtcaaacagtatttgcttaacaaaaacaagcgggattattttctgtttattttcggcatcaacagcgcgctccgcatttctgatattctgccgctgcaagtgaaggacgttcaaaataaagatcatttatgggcgactgaaagcaaaacgaaaaagaaaagaaagattcttattttagaatcgctgaaacaggaaatatacgagtatacgaaagacatgaaggaaaacgaatatctttttaaatcagtgcgcaccaggaagccgatttcccgcattcaggcctacagaattttaagagaggccgctgcggcgtgcggacttgaggagatagggacgcatacactccggaaaacgtttggctatcatttttatcagcgaacgaaagacatcgccgagctgcagagaatactgaatcattcatcaccatcaattacaatgcggtatatcggtattgatgaagatacaacaagagccgcatataaggtttttggagggctttaatacaaatcgcttgaaaatattgatcatcagagctactatataaataccaaaagctctagtagcacagcggatagtgcagcagtttcctaaactgcaggtcgggagttcgaatctctcctagagcgttatattcacaaaaagacaacaggcacttttcgcctgttgtctttctttatgcaaaccaaataaaaaacgcccgcttataccgggcatttttcttatataactgcgtcaaattgattgactttccattttttattttctttcacgaatgtcactttccgttttgcagaaggggatccgtctaatgtagggacggtaaattcgtatgtgattgtgctgccttttttagagatcagtttagcagttgattttttccaattcaaaagattgtctccgtcaccgattggaacagcaagttttccttttgaaacagtgaaatgataatctttaaagcctttttcgattgctgtttttgtaaaaataggagttaaataattcaccgcttttgctttagtgcctagatcgctgcacatgtatacatattgaagattttgatactcgaatgtgcctgatgggcaaactgcttttttcaccttcggattgtggccgctcatggtgttccaaaaatgttctctagcggataatgccaactgtaatgcttgtttttgtgataaatcgcctgatgtatttttcgcaaatgcatttgtgcttaatgacagaataagtgcaatggttgttagaaatagaagacattttttcattatcgctctctccttcaaaatctctttctcttatgttacaaatgttacaataattacggatagattacaatacttttgcataaattatttttttattcttttactcacaaaaaatacgccattacttgctagtttattcttcataagctaaaaagatgtgtaaaattagaagaatcgggaagggtttcatatgtgcagtgatgaataataacatgttacatatcctgtttttgtcaaaaagagggcatgtttaaaaacgatttcaaataaaggagtcctttaatatggaaacatcacaagaacctcttgtaactcaaaagaaaagcaaaccatcagtttggcggtcgatgtcactctttttagtgccgcttctgctgagcaatgtgctgcaatcagtcggccagctagtcgggatgatggctgtaggcagatggctcggtgttgatgcagtggcagctgtatcatcctttttcccgttattttttcttttaatctcatttacaattgggatcggttcaggaagttcgattctgatcggacaagcttacggagcgaaaaatgaggaacggctaaaggctgttgtcgggacgacgctcacgtttacatttttattaggcgttgtgttagccgttatcggcagtattttcaccctggatatccttcgtttaatgggaacacctgaaaatgtcattcatgtcagcgctaactatgcacgtattttattttatgctatgccatttatgtttttatattttgcatatactacctttttgcgcggaacaggagattccaagacaccgttttatacgctgattgtgagcacggtcatcaacatcgcgcttttgcctgttttaatccttggcatgtttggttttccgaaactgggcatatacggctcggcatatgcaactgtcatttccacgattgcgacttttctcgtgttaatggtgtatttacgaaagcgaaaacacccgctgcaatttgataaaacagtgcgtcgttatttgaaaatggataaggaactgctggttcttctgctgcgtcttggggtcccagcaagcatcaatatgattcttgtctcattatcagagatagcggttatttcattcgtcaatcattacggctctaatgcaacagctgcatacggagtggtcaaccaggtggccagctatgtacagatgccggccgtcagccttggtattgcggtttctattttcgctgcgcaatcgatcggagcgaacgagtttgaccgtttaaagcaggtcattcgcgtggggatttggctgaattatattattggcggcgtactgatcattctgatctatgttttttcacatcagattttatcgttatttttaaccgagcaagagacgctttacattgcgcaccgtcttttgatgattacattgtggagctatttgctgtttggaaatgcccaaattatttctgcaacgatgcgggcaagcggaacggttttatggccgaccgtcatcagtatttttgcaatctggggagtagaggtgcctgtcgctttcgtcctttctcactatacaaagcttgaaatactcggcgtctgggttggttatccagctgcgtttgccgtcagcttgctgttgatttatgggtattatcaattcgtctggaaaaagaaacaaatcacccgtctcatccaatagcctccgaatcacaccgttcataagtttgaacggtgtttttttatttgataggggaaaatataaaatggaggaaatatggtacagtacattgaattcttatactagcaatgaatcaaggagaggttgagtaaacatggcaaactttattgagaaaatcacgtatttgggaacgccggccatcaaagcgggcaacgaacatctagaaatgattgttgtccctgagtgggggagcaacgtcatttctctcgtggacaaaacaacaaaagtccagcttttgcgtgaaccggaaacagcagaaagttttcacgacacaccaacattgtatggcattccaatcctgttcccgcctaaccgcataagtgacggtacattcagtttccggggcagaacgtatcattttgatatcaacgagaaggataaacacaaccatcttcatgggtttctttaccatgaaaagtggaacgtagtgaccgcgaagaaaactgatgaagaagtgattgttgaaacagaaattgatctttctgagctcccccatgtgtataagcaatttcctcaccatgccgtcgttcggatgacatacacgatcaaggagaataccctatttaaacatgcgacggtcatgaacaaaggaaaggaagcgtttccttggggaattgggtatcatactacatttgtgtttccggcagaaagctcgttattctccctgacagcagatcagcaatgggagttggatgaacgcctgctgccgaccgggaagctgatggatgtcccgtataaagaagctttgcatgaaggaatggatttgcgccacaagcacctggatgatgtctttttatcttcttatcagaagaggggcggagaaaaccaggcagtcatttatcatcagcatgcacatatcagcattatttataaggcagatgaacagtttaaacattgggttgtatacaatgcggacggaaaacaagggtatttatgccctgaaccttacacatgggtgacaaacgcagtgaatcttgatttaccttcgtcactcactggtttacaagtgctggagccgggagaagaaacgacagctaaaagcagtatcaccattgaactgaatcatcaatagccaatgatgaagcgcagagaggcggggaaattaatgaaaaaaagcataaagctttatgttgctgttttactgcttttcgtcgttgcttcggtgccttatatgcatcaggctgcgcttgccgctgaaaaacaagatgcactttccgggcagatcgataagattttagctgatcatcctgccctcgaaggcgcaatggccggcatcaccgttcgctctgcggaaacaggtgctgttctatatgaacattcaggagacacccgaatgaggcctgcctcttctctaaagcttttgacagcggccgcggcactttctgtccttggcgagaactattcttttacaaccgaggtccggacggatggaacactgaaagggaaaaagctgaatggtaacctttatttgaaagggaaaggcgatccgacacttttaccatctgattttgacaaaatggctgagatattgaaacattccggcgtaaaagtaattaaaggcaatctgatcggtgatgatacgtggcatgatgacatgcgattatcacctgatatgccttggagcgatgaatacacatattatggcgcgccaatctccgctctaacagcgtctccaaacgaagactatgatgcaggcactgtgattgttgaggtcaccccaaatcaaaaagaaggggaagagcctgccgtgtctgtctctccgaaaaccgattatataacgataaagaacgatgctaaaacgactgctgccggttcagagaaagacctcacaatcgaaagagagcatggaacaaacacgattacaattgaagggagcgtaccggttgacgcaaacaagacaaaggaatggatttctgtctgggagcctgccggatatgccttagatttatttaagcagtcactaaaaaaacaaggtattactgtgaaaggggacatcaagacgggtgaagcacctagttcttcagatgtgctgctctctcatcgctcaatgcctttatcgaaactttttgtgccgttcatgaaattaagtaataacggacatgccgaagtgctcgtaaaagagatggggaaagtgaaaaaaggagaagggagctgggaaaaggggctcgaagtgttaaacagtacgcttccggaatttggtgttgattctaaatcactcgtcttaagggacggatcaggaatctcacatattgatgctgtatcctcagatcaactttcacagctgttatatgacattcaggatcagagttggttctcggcttatctaaattctttacctgttgcggggaatcctgacagaatggtgggcggaacgctgagaaaccgcatgaaaggcactcctgcacaaggaaaagtaagagcaaaaaccggatcgctcagtacggtaagctctctatcggggtacgcagaaacaaagagcggaaaaaaacttgttttctctattcttctaaatggattgattgatgaagaggatggaaaagatattgaggatcaaatcgctgtcattttggcaaatcaataatagcgggagacctgttttccaagagaaaacaggtttttttatgtctgtaataacgctttgtcgaaccttccaacaattagaagaatgatgcacaaaagaaaattagtccgattaaaaagtagtgtataagaccttatgtaaaacaatacttttatcactttatatccggaaatttgataaaaaaagaaacgaaaaataaagaaataatactatattcaaaaaaatgttataaaaatttaatgttttttattgtactttaaaaaatatccgttaatatagtgcatatatggattatatagtcatataatttcttttattgtcatttttctgcttttttctacattttcttatcctcttattatgagaactggagggaatccgttgagcgaacatacttattctttaacccatgcccaaaggagagtgtggtttaccgaactgctggagccagataccagcatttgcaatcttacagcttgtgtgaaatttaaaggcaatattgagcttgatactctggagggagcactgaatcattccatctcccgcaacgacgccattagatttcagctgttagaaggagaagagcttgagcctcgattgcaccttactgaatataaatattatccacttagaataattgatttttcaaatgttgaaatgatagaaatagagcaatggattcaggatcaagcgagcattccatttaaactgttcaactcgcctctttttcaattttacctccttagaattgactctcatgaagtttggctatttgcgaaattccatcatatcataatggatggaatctctttaaatgtgatgggaaatcaaattatagatctttatcaaaaaatgaaaaagaaagatcctttacctgatcagccggaaccttcttacttgagctacatcgaaaaagagagtcaatatctacaatctccacggtttgcaaaggaccgtttattttggacgcaaacctttgagcacccgttggaataccactcgttagccgaccagacgtccttacaaaaacagagcacatctgcatccagagacaccatcattctttcacctgatctagagcaaacgattcgaatcttctgcgaagaacacaagatcaatatcatttccttatttatggcttcattttacatatgcatcagccgaatcacttctaaaaaagatcttgccattggcacctactatggcaacagaggttcaaaggctgaaaaagaaatgctcggcatgttcgttagttcccttccaatcagaataacggttgatcctgacacagattttctttcctttgtccgcacaataggcagggaacagctttctgttatgcgtcatcaacggtttccttataatttgcttgtaaatgaattaagaaatgaacagaaggatttacacaaccttatcggtatatctatgcagtatcagccacttcagtggcacaatgcagatgattttgactatgaaacagcgctttatttcagcggatacaccgcgaacgaactttcagttcaaatacaagaacggatagacaatggaaccattcaattaaatttcgactatcaaaataccttgttttctcttgaggatattaaacgaatacaatctcatctgcttaccatactggaaaacgcccttaaacatccgcacagctttataagagaattagatatgacgaatacaagagaaaagcaaaaattgttgtatgagtttaacaagacggaagctgtttcgcctaaagctttcaccctgcatgggctgtttgagcgacaggcagctttcacaccggagcggctggccattcgcttttcaggcggttcgctgacatacgctgagcttgatatgtacgccagccggctggctgcgcaccttgcggcacgcggcgtcacaaacgaaagtatcgtcggtgtcctgtctgaacgctcacctgacatgctgatcgctgtccttgctgtattgaaggccggcggggcgtatttgccgcttgatcctgcgtatccaaaggagcggctgagctacatgctgaaagacagcggggcatcgctcttgctgacacagccgggatgctccgcaccaaacttttctggcgaaacgcttgaagtggacatgacatctcttgcgagcgaaaaagcagaaaaccatgagtttactcctgctgacggcggatctctcgcctatgtcatctatacatcgggctctaccgggcagccgaaaggagtggccgttgagcaccgtcaggctgtttcctttctgaccggcatgcagcaccagtttccgctttcggaagatgacattgtcatggtgaaaacctctttttcctttgatgcgtctgtgtggcagctgttttggtggtcgctttccggtgcttcggcgtatctgcttccgcccggctgggagaaagactccgcattgatcgtacaagccattcatcaggaaaacgtgacaacggctcattttattccggctatgctgaacagctttctcgatcaagcggaaatcgaaaggctgagtgacaggacaagcctaaagcgtgtattcgccggaggtgaaccgcttgcgccgcgtacggcagcccgttttgcttctgtattgccgcaggtatcattaatccatggttacgggccgacagaagcaacggtagacgcggcattttacgtattggatccagaacgggacagggatcgtttgcggattccgattgggaagcccgtacctggtgcgcgtttgtatgttttagatccgcatttagccgtacagccttccggtgtcgccggcgaactgtacattgccggagcgggtgttgccagaggttatttgaatcggccggcattaacggaggagcgttttcttgaagacccgttttacccgggggaacgcatgtacaaaaccggggatgtggcgcgctggctccctgacgggaatgttgaattcctcgggcgcacggatgatcaggtaaaaatccgcggctaccggattgagccgggagaaattgaagcggcactaagaagcatagaaggcgtaagagaggcggctgttaccgtacggacagacagcggggagccggaattatgcgcttatgtagaagggctccaaagaaacgaagtgcgtgcacagcttgagagactgttgccgggctacatggtcccagcctatatgatagagatggaacagtggccggttacgccaagcggaaagctcgaccgaaacgccctgccagctcctggcggagcggcagatgcggagacctacacggcgccgagaaacgtgactgagatgaagctttctcagctgtgggaggacgtgctgaaaaatggccctgtcgggattcacgacaacttttttgaccgcgggggacattccttaaaagcaacggcgcttgtctcacggatcgccaaagaattcgatgtacaggtgccgctaaaagatgtgtttgcccatccgacggtagaaggactggctaccgttatccgtgaaggaacggacagtccatatgaagcgattaagcccgctgaaaaacaggaaacctatccggtttcctctgcccaaaagcggatttatgtccttcagcagctggaggacggagggacaggctacaatatgccggctgtgttagagctcgaagggaagctcaaccctgaaaggatggagagagctttcaaagagctgatcaagcgccacgagtcgcttcggacctccttcgaacaggacgcaggaggcgatccggtgcagcgcatccatgacgaggtgccgtttacgttacagactacagttctcggcgaacgaaccgaacaggaggccgcagccgcatttatcaaaccgtttgatctcagccaagcgccgctgttccgtgcccaaatcgtaaagatatcagatgagcggcacctgttgctggttgatatgcatcacatcatttcagacggtgtttccgtcaacattctgattcgggaattcggcgagctgtacaataatcggaatcttccggcactgcgcattcaatataaagattatgccgtatggcgagaaggattcaaaacaggagacgcgtacaaaacgcaagaggcgtactggctgaagcagctcgagggcgagctgcctgtgctggatcttccggctgatcatgcccgcccgccggtgcgaagcttcgcgggtgacaaggtctcatttacgctggatcaagaggttgcatcaggccttcacaagctggcacgtgaaaacggaagcacactgtacatggtgcttcttgcggcttacaccgcgttcttgtcacgcttaagcggacaggaagatatcatcgtcggctcgccaattgccggccggccgcacaaggatcttgagccgatactcggcatgtttgtgaacacgctggcgcttcggacgcgcccggagggcgggaagccattcgtacagtatttgcaggaagtgcgtgagacagcattggaagcctttgagcaccaggattacccgttcgaagagcttgtcgataagcttgaattgacacgagatatgagccggaacccagtgtttgatgcgatgtttatccttcaaaatgtggaaaaacaagacatagatctgagagaaataaaagtccggcctgccaatttcgcacatcacatttccttatttgatatcacattaatagctacggaaataagtggatctatttgctgcgaaatggaatttagtacagaagtattcctgaaagctacgattgaacgctgggctgatcattttatcgaatttctgcatgaggcactttcaactcctgaaacaagccttgcacaaataaacatacttagtgataaagaaaacaaaaatagtctttgaatttaacaaaactcaagttgaatttgctcaaaaagatattccttttcatcgcatatttgaagcgaaagctgaagaaaatccagaacatatagctgttattgataacgaaacagagattagctatcgccttctaaatgaaagagccaatcgtctggcacgaacattgcaaaacagaaaaggaccgaagccaactgtggctgttttagccaagcggtccatcgatgcaattgttggagttctggcagtgatgaaagctggcggagtgtatatcccaatcgatgcacattatccaaaagctcgtattgaatacattcttcgtgatagcggggcagatattcttcttttacagagagagttgaagcatttgatttcgaactcgcctgaatctgagatgtctcacatcttccttgacgatgagggctcttttgaagaaagtaactgcaaccttaacttatctcctgctcctgaagagccggtatatatcatttatacgtcaggaacgacgggtgcgcctaaaggtgttattgtcacctatcagaactttactcatgctgctcttgcttggcgtcaaatttatgaactggatcggaagcctgtcagactgcttcaaatcgcgagcttttcattcgatgtcttctcaggagatttggcgagaacattgaccaacggcgggactctaatcgtttgcccagatgaaacacggctggaacctgctgaaatatataaaatcattaaatctcagagaatcacggtgatggagtcgacaccggctctcattatcccggtgatggagtatgtataccgtaaccagttcaagcttcctgacttagacatactgattcttggttccgacatggtgaaagctcaagatttcaaaacattgacagatcgctttggccaaagcatgcgcatcattaatagctatggtgtcacagaggcaaccattgattcgagtttctatgaaaccagtatgggtggagagtgtacgggagataacgtaccaatcggcagcccgctgccgaatgtacacatgtacgtactcagccagactgatcaaattcagccgatcggtgttgccggcgagctgtgcatcggcggggcaggtgttgcgaaaggctatcatcataaacctgacttaacgcaaatgaaatttacagaaaatccatttgtctctggagaaaggctgtacagaaccggtgatcgagcatgctggcttccaaacggaacgatccggcttcttggccgaatggattatcaagtaaagataaatggatacagaattgaaacagaagaaattgaaagtgttctgcttcaaacggggcttgtcagagaagctgctgttgccgttcagcatgataaaaatggacaggctggtttggcagcatatattgtgccttcagacgtcaatacgaatgctctccgtgctgctttaacaaaggaactgccagcgtatatgattcctgcatatctgattcctttagtaaacatgccgctgaccctaaacggaaagctggacagaaatgccttgccggctccaaataatgtgttatcgcgtccatataccgcaccagttaacgacttacaaaaaacgatggcgtatatatgggaagatgtactgagcatgtcacgagtcggcattcacgattccttttttgagcttggcggagactcaattaaagcattacaagtggcagcacgtctggcagctgaaggctggagcatgacaatacgcgacttattccgttattcaacgattcaggaactatgcggacatatcacaccattggcatctcaagcggaccagggacctgcggaaggtgaagctgaactcaccccgattcagcgaagatttttcggacaggtacatgcttttcactatcattacaaccagtccgtcatgcttttcagtgaaaaaggattcaatgctaacgcgcttcatctagcgctgcgtaaaataaccgagcatcatgatgccattcgcatgattttccaacgtgaccaaaacggccatgtcattcagtttaatcgcggaatcaatcacaaggatcatgaactgtttggcctttatatttcagattggacaaaagcatcgctggaaagggctcatcttgatgaaaaacttgccgctgaggaaaccgtcattcaaagcaaaatgaatgtagaaaaagggcccttactgcaagcaggtttgtttaaaacggcagaaggggatcatttgctgattgcacttcatcatcttgtgatagatggcgtttcttggagaattctgcttgaggatttagctgcagcatatcaacaggctttagaaaagaaagaaatccaattaccgccaaaaacggattcttatttatcctacgccgatggtcttacccaaatagctgaaagtaaacaattgctttcagagaaaacgtattggcaaacgattttagacgctcacactgcttttcttcctaaggacatagaaaatgtgccagacaaactccaaatgaacagcgacgcagcagcgtttgtactatccggggactggactgaaaaattgctgtttgaaacccagcaagcctatggtactgatgccaacgaacttttgcttacggctttaggaatggcgctttctgaatggactgggcatgaccaaatcgtgatcagcactgagggacacggtagagaagggcatgtgccaaacattgatatttcaaggacagttggatggtttacctccatttatcctattctgctagacatgggtattcccgagcctttcgaggatcagctcgcataccgaattaagacgacaaaagatatgctgagaagagtaccgaacaaaggaactggatacggattgttaacacacataggagaactgcggcataaagagcctgaggtcagctttaattatctcggtcaatttagcgaagagaaggaagttgaaacgtttcaattatcatattaccagccccgttacgaaatagcgggtgagagagaacgagagtatgagctggacatcaatgctctcattacggacggacggcttcacgtaaaagcggtatacacccaagtgttcagcaaacactcaattgagtgctttatggatcgttttcacaggcatcttatcgagacgattgagcattgttcgcagaaaaaagcacgcgaaaaaacattgagcgatttcagcaataaagaattaacgttgtctgcattatctagcatcgaagatctcgtgaaagatctttaacttttgaaaaggtgtgtggaattgatggcacaatcggcacaaattcaagatatttatccgttatcgcacatgcaggaaggaatgctgtttcattcactaatggatttcagctcgaaagcatatatcgaacagacctcgtttacgatcacagggaatctatgcgtcgactcgtttcaaaagagcttaaaccttcttgtttctagatatgatattttcagaacgattttcattaaagaagtaccagatcttacaggtccgcagcaggtagttctatcaaaccgtgaattgacagtatatagagaagatatttctcgcctggctgatcaagaacagcagacgctgattgatgcttttatgactaaggatcgggaaaaaggatttgatttgcaaaaagatcctttaatgcgtcttgccctttttgatagaggagacagccaatatacatgtgtctggacacatcaccatatcatcatggatgggtggtgtctcggcattattcttaaagagtttttcagcatgtatgattcgctcaaaaataactcacctgtacagcttggcagcacggtgccgtacagccgttatattgaatggctcggagaacaagatcaagaagagactgctgcctactggagcgaatatttgaaggagtacggcaatactgcttctattccccgaataaagcgccgcacggcagacgggaattataaagccgaccaggtcagcttttcattagcgccggatatggttgagaaactgacagaggctgcccaaaactggggagtgacattaaacacgctgtttatgagtatttggggcgtgctgctccatcgatataatgctgcagatgatgccgtttttggctccgtcatttcgggacgcccgtcagcgattgacgggattgaatcaatggtcggtttgtttatcaatactgttccagtgcgaatccgatctgcggaaggcataacattttcttcgctggtcaaagccgtgcaggaggatattttatcatctgaacagcatgggtattatccgctttatgagattcaaaaccatagtccattgaagcaagggttgatcgatcatatttttgtttttgaaaattaccctgtacagcttcatcaggcattaagcgtggagagtgaaaatgacgaaggcgctctgaagctgagtgacatttcaatgtcggaacaaaccaattacgactttaatatcgttatcgttccgggagaatcattttatatcaaattcagctacaacgcagacgtttacgagcgggaggagatgctgaggattcaggggcatctaaagcaagcactggattgcattttgacaaatcccgatgttgccgtcagtgacatcaatatcgtgccgccggaggagcaacaggttatccaattgtttaacgaaactgagcgtccttatgtgaacaaaacgataccccaattgtttgaggaacaagctcacaaaacacctgaagctgctgcattgaaaatgggaaacgagtgctggacctatcgccagttacaagtaagagccaatcagattgcgcacgccctgatagaaaaaggcgttggatctggggatatcgttgctgtaatgatgggccggtcaatggaaatgcctgcagctctgcttgggatttggaaagcaggcggcgcttatatgccgcttgatccacattttccagcagaacgtctttcttttcttctgaaggacagtcaagcggctcaattgctgatagaagaagaccttatttccttgatccctccgtcctatgaaggaaatacgataacgatagaacatacagaaagttaccaaacagaagcgccaaatatgccgccaggtgatctagcctacttgatctatacgtcgggaacgacggggcgccctaaaggggttttagttgatcatcacggtattgccaatacattgcaatggagacgggaagagtatagcatgaccgaacaggatatatccctccatttgttttcgtacgtgtttgacggctgtgtaacgagcttatttaccccgcttttatctggtgcgtgcgtactgctgacaacagatgacgaagcgaaggatgtgctggcccttaagcgaaaaatagcccgttataaggtcagccacatgatcattgttccttccctgtacagggtgttattggaagtgatgactgctgacgatgcaaaaagtcttcgtattgtgacatttgcgggtgaagcggtcacgcctgatctgcttgagttgaatcaaataatttgtccttctgctgaactggcaaatgaatacgggcccacagaaaacagtgtggcaacaacaatattgcggcatctgaataaaaaagagaggatcacgatcggacacccgatcagaaacacaaaagtatttgttttgcacggaaatcaaatgcagccgatcggcgcggcgggtgaactgtgtatttccggcgcgggtcttgcgagaggatactacaaacagcaagagctgacacagaaagcattctccgatcatccattccttgaaggggagcgtttataccgaacaggtgatgcaggccgctttttgcctgatggaacgattgaatatattggacgttttgatgatcaagtgaaaattaggggttatcgtattgaactgagagagattgaaacagttcttcgacaagcaccgggggtaaaagaagcagcggtactggcccgtgatgtttctgctgaggaaaaggagctcgttgcttatatcgttccggaaaagggaaacagcctcccagatttgtatcagcatcttgccgggacattgccgtcctatatgatcccagcaagtattatcaacatcagccagatgccattaacatccagcggcaagcttgacaggtttgcgcttcctgaaccagaaaacaatacgagtgtcacatatatggcgccccgaaccttaatcgaagctgatctcgcacatatttgggaagatgtgctgaataaacagcacatcggcattcgtgatgatttctttcagttaggcggacagtccttaaaagcggccgcactggtatcaagaatacataaaaagcttaatgtcgagctgccgctcagtgaggtgttttcttatccgacggttgaaagcatggcggtcaaattgatgagcttaaaagaacacgcttttacacagattgaacctgcggatcaaagagatgtctatccgctgtctttctcgcaaaaacgattatatgctcttcatcagctggcagatgacagcacaggctacaacatgccagctgtacttgaattacgcggaaatctgaatcgccagcggttgagaagcgttctcacagaacttgtgaatcggcatgaagcattacggactgtttttgtgcttgacagagacgagcctgtgcagatcatttatccagagatggcttttgatctaaaagagcttgaaatggaatcagaacaaatgcttgagtctgcaatcgagacctttatcaaaccgttttatctatcatccggtccgctttttagagcatgtgtcattacaatgggcaataatcgcggctttttgctgctcgatatgcaccatattattgccgacggtgtctcgatgagcactcttgtccaagaatttactgacttatattgcggaaaagagttgccagctttaaacctgcattataaggattttgctgtttggcagcaagagaagcacccgaaagagctatacaaaaaacaggaggcctactggctcggtcagcttggcgggagtcttcctacactagaattaccgcttgataaaacaaggccgcgtctccctgatttcaggggtggaacaattgaagtcaacattgataaagacatggctgatgaactgcaccgtttaatggctgaaacgggaacaacattgtatatgattcttctggctgtctattctattttgttatctaagctaagcgggcaagaggatattgttgtcggttcgcctgctgccggaagaccgcacgctgatctggagcgcgtcatcggaatgttcgtcaatacattggcgatgcgcagcaagcccgagggccacaaaacgttcagctcctatttgcatgacattcgccacctggctctgaccgcttacgagcatcaggattatccttttgaggagctggcagataagctcgatacaaatcgagaggtaaatcgcaacccgctgttcgatgcgatgcttgtgcttcaaagcagtgaagatttccggttcgaagtgcctggtctgtcgatttcgtctgtcactcctaaacatgatatatctaaattcgatttaacattacatgctgaggagcatctgagtggaatacgctgccgttttgaatacagcactgctctttttgaagaagaaaccattacgcagtgggcatcctattttattgaattggtaaaaggggtaacggcggatactgagatgagaatttcgaacatgcaattgcttcctgctgcagagcgtaggttactccttgaaaaaatggggcagtatgcagcttatccgagaaatgaaaacatagtaagcttatttgaaaagcaagtagctcagtatccggagcatatcgcagtggtgtgcggccattctcagcttacgtatcgagacctgaatgaaaaagccgagcgggcagctgctatgctgatcaaacaaggggtcagaactggcgatatcgtcggtctgatgctcgatcggtcacctgatatgatcattggcgttttatcgattttaaaagctggcggggcctatttgccgattgatcctgaatatcccaaggagcgtattagctttatgctcaatgacagcggagcaaaactgctgctgacagagcgcggtctaaacaaacctgcagactacaccgggcatattttgtatatcgatgaatgtgaaaacaactcaattccggctgatgtaaacattgaagaaatagtaacggatcagcccgcatacgtgatatacacatctggaacgactggtcagccaaagggagtcattgtcgagcaccgcaatgtgatcagtctcttgaagcatcaaaacctgccttttgaatttaaccatgaagacgtctggacgttatttcattcttattgctttgatttctctgtatgggagatgttcggtgcgttattgaacggaagtacattagtcgtggtctctaaagaaacagcccgtgacccccaagcattccgattattgttaaaaaaagagcgcgtcactgtactcaatcagaccccgactgctttttacggcttgatgcttgaagaccaaaatcatacagatcatttaaacatccgctatgtgatttttggcggcgaagccttacagcccggattgcttcaaagctggaatgaaaaatatcctcatactgatttgattaatatgtacggtattacagaaacaacggtccatgtaacattcaaaaaattgtcctcagctgacattgcaaaaaataaaagcaatatcggccggcctctttctactctgcaggctcatgtgatggatgcccatatgaacctgcagccgaccggagttccaggggagctgtatataggcggcgaaggtgtggcacggggatatctcaacagagatgagctgaccgctgaccgttttgtatccaatccttatcttccgggagacagattataccgaacaggagatcttgctaagcgcctgtcaaatggcgagctggaatacttaggccgcattgatgagcaggtgaaagtcagagggcaccgtattgagttaggcgaaatccaagcggcacttcttcagtatccaatgattaaagaggcggctgtcattaccagagcagacgagcaagggcaaacagctatatatgcatatatggtgataaaagatcaacaggctgcgaatatatcagacatccgaacttacctaaaaaacgccttgcctgactttatgctgcctgcccgtatgatacaaattgacagcatcccggtgactgttaatggaaagctcgatcagaaagccctgccagagcctgaaaaacaagcttatacagctgatgatatcagtcctagaaatgagattgaaacggtgatggctgaaatttgggaagagcttcttaatgtagatgagctgggtgtaagcgccaatttctttaagcttggcggagactctattaaagcgctgcaggtttgtgccagactgaagcagcgcggatttgaaacgacagtacgtgagatgtttgaacatcagactcttggtgaactgtccgcccgggttcgaaaagacgtacgcgccattgaccaaggcccggtcgaaggcgagattacttggacacctatccagcagtggtttttctcgcaatctctggaaagccatcattttaaccaatccgttatgatctaccgggctgaacgatttgatgaggctgcgcttagaaaagtactaaaaagccttgtgactcatcatgatgcactgagaatcgtatgccggcatgaagatggcaggcaagtgcagataaacagagggatagatctttcagatgaggagctatatgcacttgaactgtttgatgtaaaggatagcctaacagaagcccggaacacgattgaggaagcagccagccggatgcaagaacatattcgtttggaaaccggccccttacttcacgctggattgtttagaaccgagaatggtgaccatttatttctaacgattcatcacttagttgttgatgcggtttcttggcgcattttgtttgaggatttttcaacagcttacaaacaggcagtctcaggagaatctattaaactgccgcaaaaaacagattcatatttaacgtattcacaaagaatagctgactactctataagccgccaggtgcagcgcgaagcagcgtactgggatgagtgcgagaaccgtcacatccagcctattccaaaagacaatgacgcagcatctaacacattcaaagatacagaagtgattgattttgagctatctcgccatcacacagaattactattaacggctgcacataaagcttacagcacggagatgaatgatatccttctgacagctttaggtcttgctttgcagaaatggacgggaaataaccaatttaaaatcagcatggagggccatggaagggaatcatatcttgaggacatcgatattagcagaactgttggctggttcacctccatttatcctgtgtggcttgatatgagagattccgatcataaggacaaagaagagcggctgggccaccttattaaacagacaaaagatatgctgcaccgtataccgcataaaggcgcgggctacggcgtgctgaaatatatcagcaaaagatggggctctcagaaaaacagcccagaaatcagctttaattatttaggccagtttgatcaggatattcaatcaaatgcctttgaggtgtctgacatcaagccaggaaatgagatcagcccgaactgggagcgtccttatgcactggatatcagcggcgccgtttcttcggggtgcctgaacatgcacatcatctataacaggtttcaatttgaggaaaaaacaatccaaacattttccaggcattttaaacagactctggaaaacatcattgagcattgtaccggcaaagaaaaccaagagtggagcgcatctgatttcactgatgaagacttaacgcttgatgaattgagtgagatcatgggagccgtcaacaaactataggagaggagattcactgatgccgcagcaacctgaaatacaggatatataccctttgtcatttatgcaggaagggatgctttttcactcactgtatgatgaacagtcgagagcttattttgaacaggcttcttttacgatccatggacagcttgacttggagcgtttccaaaaaagtatggatgctgtttttgacaggtacgatatctttcgaacagcattcatctataaaaatgtagccaaacctcgtcaagtcgtgctcaagcaacgtcattgccctattcatattgaagatatttcccatctcaatgaaagggataaagaacattgtaccgaggcattcaaagagcaggacaaatccaaaggctttgatctccaaacggatgtactgatgagaatatctattttaaaatgggcgcctgatcattatgtctgtatctggagccaccatcatattttaatggatggctggtgtttaggcatcgtcattaaagactttctccatatttatcaagcgctgggtaaaggccagcttcctgatttgcctcccgtacagccgtacgggacgtatattaaatggctgatgcagcaagatcgtgaagaagcagctgagtactggaaaaagaggcttcagcatttcgaaaaatctacacccctgccgaaaagaacagatcaaattccgaatgggacactacagcagatcacgtttgccattcccgaaaaagaaaccgccgaattacagaaaatcgcagcagcttctggtgcgacactaaacactgttttccaagctttatgggggattatgcttcaaaaggtcaatcgcagcagcgatgctgtgttcggttcagttatatcaggcagaccttctgagctaaaagatgtggaaaacatggtcgggctttttatcaataccattcctattcgagcccaaagtgattctctgtctttttctgacctagtcaggagaatgcaaaaggacatgaatgaggcagaagcctatagttactttcccttgtatgatattcaggcgcagagtgctctaaagcaagagttgatcgatcatattatcgtctttgaaaatacacctacccagcaagagatcgaagagctgaatcaagcggggtcatttgatttctccgtcaaagattttgagatggaagaggtgaccaattatagttgcagtgtcaaagtgatcccaggccgtaccttgtacgttcggattcattttcagaccagcgcttatcaaccaagcatgatgtccgaaataaaagattatttgctgcacatggtctctgacgtcatctctgatccatctcttcctgtgtcaaagatgacgttgctagatgaggacaaaacacggaaaatcgtttctcaaaataacaggacagtatctgtttcacctgaagccccaaccctgcatgggctgtttgaacgacaggcggcagtcacaccggagcggctggccattcgcttttcaggcggttcgctgacatacgctgagcttgatatgtacgccagccggctggctgcgcaccttgcggcacgcggcgtcacaaacgaaagtatcgtcggtgtcctgtctgaacgctcacctgacatgctgatcgctgtccttgctgtattgaaggccggaggggcgtatttgccgcttgatcctgcgtatccaaaggagcggctgagctacatgctgaaagacagcggggcatcgctcttgctgacacagccgggatgctccgcaccaaacttttctggcgaaacgcttgaagtggacatgacatctcttgagtgtgaagaagtaaaacgtcatgtgtctgcttctgttagcgacggatctctcgcctatgtcatctatacatcgggctctaccgggcagccgaaaggagtggccgttgagcaccgccaggctgtttcctttctgaccggcatgcagcaccagtttcggctttcggaagatgacattgtcatggtgaaaacctctttttcctttgatgcgtctgtgtggcagctgttttggtgggctctttccggtgcttcggcgtatctgcttccgcccggctgggaaaaagactccgcattgatcgtacaagccattcatcaggaaaacgtgacaacggctcattttattccggctatgctgaacagctttctcgatcaagcggaaatcgaaaggctgagtgacaggacaagcctaaagcgtgtattcgccggaggtgaaccgcttgcgccgcgtacggcagcccgttttgcttctgtattgccgcaggtatcattaatccatggctacgggccgacagaagccacggtagacgcggcattttacgtgttagatccagaacgggacagagaccgtttgcggattccgattgggaagcccgtacctggtgcgcgtttgtatgttttagatccgcatttagccgtacagccttccggtgtcgccggcgaactatacattgccggagcgggtgttgccagaggttatttgaatcggccggcattaacggaggagcgttttcttgaagacccgttttacctgggggaacgcatgtacaaaaccggggatgtggcgcgctggctccctgacgggaatgttgaattcctcgggcgcacggatgatcaggtgaaaatccgcggctaccggattgagccgggagagattgaagcggcactaagaagcatagaaggcgtaagggaggcggccgttaccgtacggacagacagcggcgagccggaattatgcgcttatgtagaagggctccaaagaaacgaagtgcgtgcacagcttcagagactgttgccgggctacatggtcccagcctatatgatagaaatggaacagtggccggttacaccaagcggaaagctcgaccgaaacgccctgccagctcctggcggagcggcagatgcggagacctacacggcgccgagaaacgtgactgagatgaagctttctcagctgtgggaggacgtgctgaaaaatggccctgtcgggattcacgacaacttttttgaccgcgggggacattccttaaaagcaacggcgcttgtctcacggatcgccaaagaattcgatgtacaggtgccgctaaaagatgtgtttgcccatccgacggtagaaggactggctaccgttatccgtgaaggaacggacagtccatatgaagcgattaagcccgctgaaaaacaggaaacctatccggtttcctctgcccaaaagcggatttatgtccttcagcagctggaggacggagggacaggctacaatatgccggctgtgttagagctcgaagggaagctcaaccttgaaaggatggacagagctttcaaagagctgatcaagcgccacgagtcgcttcggaccgccttcgaacaggacgcaggaggcgacccggtgcagcgcatccatgacgaggtgccgtttacgttacagactacagttctcggcgcacgaaccgaagaggaggccgcagccgcatttatcaaaccgtttgatctcagccaagcgccgctgttccgtgcccaaatcgtaaaggtatcagatgagcggcacctgttgctggttgatatgcatcacatcatttcagacggtgtttccgtcaacattctgattcgggaattcggcgaactgtacaataatcggaagcttccggcactgcgcattcaatataaagattatgccgtatggcaagaaggattcaaaacaggagacgcgtacaaaacgcagggggcgtactggctgaagcagctcgagggcgagctgcctgtgctggatcttccggctgatcatgcccgcccgccgatgcgaagcttcgcgggtgacaaggtctcatttacgctggatcaagaggttacatcaggcctttacaagctggcacgagaaaacggaagcacactgtacatggtgctccttgcagcttacaccgcgttcttgtcacgcttaagcggacaggaagatatcatcgtcggctcgccaattgccggccggccgcacaaggatcttgagccgatactcggcatgtttgtgaacacgctggcgcttcggacgcgcccggagggcgggaagccgtttgtacagtacttgcaggaagtgcgcgagacagcaatggaagcctttgagcaccaagattacccgttcgaagagcttgttgataagcttgaattgacacgagatatgagcagaaatccgctgtttgacgtaatgtttgttcttcaaaatatggatcaggaatcgttggagctggatgaactttgtctcaaacctgcagcaaacaatgggcatcaaacgtccaaatttgatttaaccctatatgcccaggaacagccccgcggtttgctgacgttccaaatggagtttagtactgacttatataagaaaaaacgatagaaaagtggcttcaatacttcaacaatatgttactctccatcatcaaagacaacaaagccgctctcggaacaataaatatcctgaatgaggatgaggcccattaccttatccacgagctcaatcgtacaaaaatagattatccaagaaatgaaaccatcagcagactctttgaaatgcaggcagaacaaacacctaatgctgtagcaattgtcagcgacacccaagtattcacttacgaggacctgaacagctgggcaaatcaaattgcctcagttctacagataaagggcgtagggcctgatagtgttgtagccttgttgacaggcagaacaccagaactcattgcaggaatgctgggcattctaaaagccgggggagcctatctgcctatcgattctaatctgcctgttgaacgcatagcttatatgctgtctgacagcagggcagcattactccttcaatctgaaaaaacagaaaaacggctattaggcattgaatgtgaacaaatcataatcgaagatattcaaaagcaaggagaggcgaagaacgttgaatcttcagcagggccccattcacttgcatatatcatttatacctctggatcaaccggtaaaccaaagggtgtcatgattgagcagcgaagtgtaattcgtcttgttaaaaacagcaattatattacatttacacctgaagaccgccttctgatgacatcatcaatcggtttcgacgttgggtcatttgaaattttcggaccgctgctaaatggtgccgctttgcatctgtccgatcaacaaacatttctcgattcccatcagcttaagaggtacatagaacatcaaggaatcacaacgatttggctgacatcttctctattcaatcatttgacagagcaaaatgaacaaacattttcacagctgaaacatttgattattggcggagaagctttgtcgccgagccacgtcaatcgaatcagaaatgtctgccctgaagtatctatatggaatggatatggccctaccgaaaatacaactttttcgacatgccttcacattcaaaaaacatatgaactttccattccgatcgggcggccggttggtaattccaccgcttttatcttaaatcaatggggagtgctgcagccggtcggagctgtcggtgaactttgtgtcggcggagatggcgtcgccagaggatatttgggccgtcctgatttaacgaaagagaaatttgtcccacatccatttgcacctggcgatcgactgtatcgcacaggtgatctggcgcgctggctttccgatggcacaattgagtacgttggccgtattgatgatcaagtaaaagtcagaggctatcgggtggagctgggtgaaatcgaaacagcacttcgtcaaatagacggggtcaaagaagccgcagtgttagcacgtacagcccagaccgggagcaaagagctgtttggctatatcagcgtaaaagcaggcacgaatgctgaacaagtgcgttctcttctcgcgcgttcgctgccaaactatatgatcccggcgtatatcattgaaatggagactcttccgctcacatcaaacggcaaattgaaccggaaagcactgcctgaaccagatgtcgcatctaaacaaacatacatcccgccacgcaacgaacttgaagagcagctggcattgatctggcaggaggttctaggcatccagaggatcggaatagaggattcgttttttgaattgggcggagattcaatcaaagcccttcaagtttctgcacgccttgggcgctatggactaagcttgcaggtaagtgatttattccgtcatccaaagataaaggacttatcaccatttatccgtaagtcagagagaatcatagagcaaggacccattcagggtgacgttccttggacgcctgttcagcaatggtttttttcacaagatattgaagaaagacaccatttcaatcagtctgtcatgctattccattctggacgtttgtctgaaaacgcccttagaccagccttgaaaaaactggcggagcatcatgatgcgcttcggatggtttatcgcaacgatgacaggcgatggattcaaatcaaccaaggcattcatgagtcacagctatacagcttaagaatctctgatctttcacagtcagaaagcggctgggagacgaaaatcaaacaagaagttgccgatcttcagcaaagcatcaatttgcaggaaggaccattgttgcacgccgctttgtttaaaacactgaccggagattacttgttccttgcgatccatcaccttgtcgttgatggtgtctcatggcggattttgctggaggatttgtcagccggatatcaacaagctgctgcaggccagacgatccagcttccgcctaaaacggattcctaccaggaatacgcaagacgcatacaggaatatgcccaaagcagtaagctgattcgcgaagaggcgtattggcgaagtgtagaagaacagcaagccgcagaactgccctatgaaataccgcatcatgtgaacatcgacttcagcaaaagggactcattaagcttttcactgactgaagcagacaccgccgtcttgctgcaaaacgtcaatcacgcctatggcacagatacacaagatattctgttaaccgcagcatccttggcgatttgtgaatggacaggaggaagcaagctccgtatcgctatggaaggacacgggagagaacacattctgccagagttagatataagcaggacggtcggctggtttacatccatgtacccggccctcataagctttgaaaatcatagggatgagctcggaacctcagtaaaaaccgttaaagatacactgggccggataccaaacaaaggggtaggttacggtatgctgaaataccttacacaccctgaaaataaaagcattacgttttcaaaaacacctgaaatcagctttaactatttgggccagttcaacgacatcgaaagacaggacaccttccgcccatcaagccttggtagcggaaaggatatcactcatacatggaagcgcgagcaaatcatcgagatgagtgcaatggcagcagacaaaaagctccatttcaatcttagttatccgccagcccgctttcacagaaacacaatggaacagcttattaacaggattgaacactttttgctggacattatgaaacactgcgccggtcaacagaaagcagaaaagacactgagcgatttcagcagtcaatcattaacggcagaggacttggacagcataaccagcttggtggaagaattgtagaaaatcgtgacaggagacatgaacatgacaaaagcgaattcaattcaggatatttatccgctgtcttacatgcaggaagggatgcttttccattccctcctgcaaaaagattcacaggcgtatgttgagcaagcttcttttacaatagaaggaaaagtcaacccgcagttttttcataacagcatcaacgctcttgtagaaagacatgatattttcagaacgatttttatcagccaaaatgtttcctccccccagcaggttgttctgagagaacgaaatgtcatcgtactggaagaagacattactcatttaaacgaggcggagcaatcacagtttatcgagcaatggaaagaaaaggaccgggaccgggggtttcatttgcaaaaggatgtgctcatgcgcatcgctctgattcaaacaggagagagccagtacacttgtatttggacctttcatcacatcatgatggacggttggtgcctcagcattgtgctaaaggagtttctgcatatttacgcatcttatgtaaatgcatcccctataacattggagccggtccagccatacggaaagtatatcaaatggctgatggagcaagacaaagagcaggcggtttcttattgggaccattatctttccggccacgaacagcaaaccgtgctcccgaagcagaaaaaacaaagggaaaaagcaggcaggaacacgttacattttcattctctaaggaagaaagcagcaggctttcagagcttgctgcaagagaagaagtgacactcagtacgatttttcataccatttggggcattctgctacaaaaatataataataacgatgacgccgtattcggttctgtcatttcaggaagacccgcagaaatcgaaggcattgaacatatggtaggtcttttcattaatacgatgccggttcgggtgcagggggcaaaaacgccatttcttcaacttataaaagatatgcaaaaagaccgtcttgccgctgaagcgtacagctaccaccctttatatgagattcaatcccgctcagctgttaaacaagggctgattgatcatattctcgtatttgaaaactatccggtgcagcaagagattcaaatgctgaacaaacaggaacatgcttctgatctttttcagattcataatttcactgtcgcagatgaaaccaactacagcttttatcttatggtggcgccaggggaagaaattcatatcaaaatgaactatgatgcggagcagcacgatcggtcttttgtgctctctgtcaaagagcatcttctgaatgctgtatcacaaatcttaaataatccgaatcttccacctgaagaaatcgatatcacgacagatactgaaaagcggcagctgattggagaaatcacagatcaaacaccagtttacgaaaccatccatgccatgtttgaaaagcaagcggaaaagacaccagatgcttatgctgtaattgatcaagcctgctcattaacatacagagaactgaataaagcggctaacagattggcacggcatttacgaatgaaaggcgttgtgagacaggaacccgttgcgattatgatggaacgctcagcggcgtttatcacaggtgttcttggtatcttaaaggcaggcggcgccattgttccggttgatccgcattacccggctgacagaatccgttatattctgcatgattgcggctgttcgcatgttgtttcacaagcgcatctttcctcatcgttagaagacaattacattatcactcatccagaagatatcgaaagcaaagtagacggcagtaacataaagtcagtcaacaatgctgacgatctgctgtatatgatttatacatcaggcacaacaggtaaaccaaagggtgttcaatttgagcatcgaaacatggctaacttgctgaaattcgaatatactcactccggcattgactttgaagcagatgttctgcaatttgcgacgccttccttcgacgtctgctatcaagaaattttttctgcgcttctgaaaggcggcacactgcacatcgtgccagaagccataaaaagagatgtgcctcagctgtttgcatttataaacaagcatcagacgaatattgtgtttctcccaactgcttttatcaaaatgattttcagcgagcgagaacttgcgaactcgtttcctgatggcgtcaaacacctgatcgcagccggggaacaattaatgatttcagaccttttccaagatgtgttgcgtaaacgcggcatacacctgcacaatcattacggaccttcagaaactcatgtggtatctacgtataccattcatcctggagaccctattcctgagcttccgccaatcggtaaaccgataggctgtactgatctatatattttgaatcatcaaaaacagcttcagccatgcggcgtaccaggcgaactctatatttccggcgcaagtgttgccagaggatatgtcaatcacgataaactgacaagcgacaaattttcatccgatccattcaagcctgatgtgatcatgtaccggacaggtgatttggccagacggcttgaagacggcaacatcgaatatatcggacgggcagacaatcaagtgaaaatcagaggttatcgaattgagccgcaagaaatcgaagtcacgctaatgaatcatccggacattagtgaggctgccattctcatctggcaagatcaaaacggtgaacatgaattatgcgcttactattgcagtgtacaaaagctgaacgcaatagatttacgcagttatatggctagtgagctcccagaatacatgattccggcgaaatggatatgggttgacagcatacctcttaccccaaacggaaaagtagatcgcgcagcacttccggagccagatgcttcaatcagcggaaacccatataccgcccctcgaaatctgttagaggcaaagctttcacaactatttgaagatgtactgaataatggccatataggcatccaagacaacttttttgaccatggcggccactcgttaaaagcaacagtgcttatgtcacggatcgctaaggagtttcatgtgcaagttccgctaaaggacatctttgcccatccgactgttgaaggattagcttcaatcattcgagaggcagaacaaaatccgtatgcagcaattgaaccagcagaagaaagggatacatatcctgtatcttcggcccaaaaacgaatgtatgtgcttcaacagcttgatgagggtgtcgcctataacatgcctgcggtcttagaactggaaggtgcactggatgtcgccaaactgtctgctgtatgtaaagaactgatcaatcggcatgagccgcttcgaacttcctttgtatccggagctgatgacgagccggttcagcgtatccacaccgaagtgccgtttacgttaagtaaagagaccactatcgagggatttgtccgtccctttgatctcagccaggcgccattatttagagcaggccttatagaagtgtcaaacgagaagcatgtattgctggtggatatgcaccatatcatttcagatggcgtatccgttcagctcctaatccgagaatttaccgatctttatgcaaaccggcagcttaagccattgcggatccaatataaagattacgccgtatggcaacagaaatttaaaaagggagactcgtaccaaaagcaggagacttactggcagcagcagtttagcggggaccttcctatactggagcttccaacagataaacgacgtccggcagaacggcaattcataggcgggaaagtaacctttcaattggacaaagagatcacggcccgcataaagcggctcgcccataaaaacagaagcacgctttatatgacgcttctcgctttgtattcagcctttttgtctcggttaagcggtcaggatgatatcgtgattggttcacctatcgccggacggccccatgccgaccttgaagctgttcttgggatgttcgtcaatacattggctctccgcacacgcccggcgggtaataagacatttgaggaatttctgaaagaagtcagacagacggcactagaagcgtatgagcatcaggattacccgtttgaagagcttgtggacaaactcggtgtgcagcgggaaatgagccggaatcctttgtttgacacaacgctagtccttcagaatatggaacagcaaaagctaaaaatgaatgatgtacagcttcagtggaacgacttggagcacccaatatcaaaatttgatatttccctatacgttacagagcatgattccgagcttttctgtcagtttgaatacagtacagctttgtttgagaaagaaaccatccaaaggtgggccagccttttcaccacgcttgtggaacatacagctgccagtcctgaaacagaattggacaatattccaatcttaacaaaagaagaagagcgagatttcattgaatcatgccatctgtttgaggagacgggctattcaatgaatcaaacgctccactatgcactcgaacagcaggcagaaaaaacgcctgatcaggcggccgttatcttcgaagatggagtgatgacctataaagaattgaacgaacaggctaaccgtatcgcctgggagctgatcggacggggggtaaaacccgaaacgactgttgccattataggaaagcgttcacctgaaatgctgcttggcatttatggcattcttaaagctggcggcgcttatctgcccatcgacccggattatccggaagaacgaatcagctttctgctggaggacagcggtacaaacattctcctgcttcagtctgccggccttcatgttccggaatttacaggagagattgtctatctcaatcagacaaatagcggactggcacatcgtttgtccaatccgaatgtggatgttctcccgcaatctttagcctatgtcatctatacatccggctctaccgggatgcctaagggtgttgaaattgaacatcgatcagcggtgaattttttgaattccctacagtcccgctatcagctaaagcattcagatatgattatgcacaaaacatcatattcattcgatgcttcaatatgggagctgttttggtggccttatgccggagcttctgtttatctgcttcctcagggaggcgaaaaagaacctgaagtgatcgcgaaggccatagaagaacaaaagatcacagctatgcattttgtgccttcaatgctccatgcatttttagaacatataaaatatcgctctgtaccgattaagacaaacagactcaagcgagtgttttctgggggagaacagctggggacccatcttgtctcccgattttacgagttgcttccaaatgtttcaataaccaattcctatgggccaacggaagcaaccgtagaagctgcattctttgattgtccgccgcatgaaaaacttgaacggatcccaattggaaaacctgttcatcatgtcagattatatctcctgaatcagaatcagcggatgctgcctgttggatgtatcggcgaactgtacatagccggagcgggtgttgccagaggttatttgaatcggccggcattaacggaggagcgttttcttgaagacccgttttacccgggtgaacgcatgtacaaaaccggggatgtggcgcgctggctccctgacgggaatgttgaattcctcgggcgcacggatgatcaggtgaaaatccgcggctaccggattgagccgggagaaattgaagcggcactaagaagtatagaaggtgtaagagaggcggccgttaccgtacggacagacagcggggagccggaattatgcgcttatgtagaagggctccaaagaaacgaagtccgagcgcagcttgagagactgttgccgggctacatggtcccagcctatatgatagagatggaacagtggccggttacgccaagcggaaagctcgaccgaaacgccctgccagctcctggcggagcggcagatgcggagacctacacggcgccgagaaacgtgactgagatgaagctttctcagctgtgggaggacgtgctgaaaaatggccctgtcgggattcacgacaacttttttgaccgcgggggacattccttaaaagcaacggcgcttgtctcacggatcgccaaagaattcgatgtacaggtgccgctaaaagatgtgtttgcccatccgacggtagaaggactggctaccgttatccgtgaaggaacggacagtccatatgaagcgattaagcccgctgaaaaacaggaaacctatccggtttcctctgcccaaaagcggatttatgtccttcagcagctggaggacggagggacaggctacaatatgccggctgtgttagagctcgaagggaagctcaaccctgaaaggatggacagagctttccaagagctgatcaagcgccacgagtcgcttcgaacctccttcgaacaggacgaaggaggcgatccggtgcagcgcatccatgacgaggtgccgtttacgttacagactacagttctcggcgcacgaaccgaacaggaggccgcagccgcatttatcaaaccgtttgatctcagccaagcgccgctgttccgtgcccaaatcgtaaaggtatcagatgagcggcacctattgctggttgatatgcatcacatcatttcagacggtgtttccgtcaacattctgattcaagaattcggcgagctgtacaataatcggaagcttccggcgctgcgcattcaatataaagattatgccgtatggcaagaaggattcaaaacaggagacgcgtacaaaatgcaggaggcgtactggctgaagcagctcgagggcgagctgcctgtgctggatctccccgctgatcatgcccgcccgccggtgcgaagcttcgcgggtgacaaggtctcatttacgctggaaccagaggttgcatcaggccttcacaagctggcacgagaaaacggaagcacactgtacatggtgctccttgcggcttacaccgcgttcttgtcacgcttaagcggacaggaagatatcatcgtcggctcgccaatcgccggccggccgcacaaggatcttgagccgatactcggcatgtttgtgaacacgctggcgcttcggacgcgcccggagggcgggaagccattcgtacagtatttgcaggaagtgcgtgagacagcattggaagcctttgagcaccagaattacccgttcgaagagcttgtcgataagcttgaattgacacgagatatgagccggaacccagtgtttgatgcgatgttagttgttcaaaataatgattacgagccattgcatcttcatgatttgcaaatgaagccggcacaagtttctcatctcgtttctaaattcgatttgacactacaggcatctgagggcgacggaaacattcatttcctttttgaatattcaaccgcattgttcgagaaaaccaccattgaacgctgggcatcgcatttaacaaatgtacttagcatcatcggcaaaaacccgaaggtgacactcaaccatatcgacatcctgacccaagaagagcggcaccagctgcttaatgagtttaacaccgggcaagcgaatcaatacggagttcaaacaatcagtcaattgtttgagcagcaagctgcacgaacaccaaaagcttctgcacttgtcagcggagacaaaacactcacttatcaggagcttgacgagtggtccaatggaatcgcacgtgcattgcgcagccgaggtgttaagccggacacaccagtaggcatcatgatgcatcgttcgttcagtatgatagcatccatacttggtgtgtggaaagccggaggctgttacgttcccattgatcctgaatacccgaaagaacggaaacgctatatcctcagcgacagcggaacgaaactgctgatgacaataaatgaagcggatctgggagtacttgctgactttgaaggagagatcttgacgatagaaagcgtagaggaagacgacaaatcgccgctgccgcaaatgtcgtctgcccatcatttggcttatatcatttatacttcaggaacgacgggccgtccaaaaggggtaatggtcgagcataaagggattgctaacactcttcagtggcggcgaaacgcttatgcattcaacgagacagataccattctgcagctcttttctttctcatttgacggctttataactagtatgtttacaccgcttttgtcaggtgcaaaagccgttttgcttcatgaagaggaagcgaaggatattctggccattaagcatcagctgtctcgtcaacggattacacatatgattattgtgcctgttttatatcgagcgcttttggacgtagtgcagccggaagatgtaaagacgcttagagtcgtcacactggcgggagaagcggctgaccgcgaattgatcgcccgcagcttagctatatgtccgcataccgaactcgccaacgaatatggaccgacagaaaacagcgtggcgactaccgtcatgagacatatggaaaagcaggcatacgtaagcatcggccagccgattgacggaactcaagtgctgattttaaatagcaatcatcagcttcagccaatcggtgttgcgggagagctttgtatagcaggaacagggcttgcaagagggtacgttaatcttccagaactgacagagagagcattcacgcagaatccatttaaacccgaagcacgaatgtaccgaacaggagacgccgccagatggatggccgacggtacactcgaatatctcggaagaatcgatgatcaagtcaaaatcagaggataccgtgtagaaacgaaagaaattgaatcggtcatccggtgtataaagggtgtaaaagacgccgcagtagttgctcatgtaacagcgtcaggacaaaccgaattaagcgcttatgtggtgacaaaaccagggttgagcacaaatgctgtacgctcagaattacaaaacaagctgccggtgtttatgcaccctgcgtttattgaaaaactggactcacttccattgtcaccaaacggcaagctggatcgcggagcacttccaaaacctgtatacaaccacgaaggtgaacgtccattcctcccgccatccagcaaaatggaacaaatactggcagatatatggaaagaagtactgggggcagaaaagatcggaacagctgattcgttctttgaacttggcggagattcaatcaaagcgttacaggtatctgcgcggcttcaccggataggcaagcaaatggcagtgaaagatttgtttagccatccgaccattcaagaattggcagcttatatccgtgattcagatacaagttccagccaagctgcggttgagggagacgtacaatggtcgcctgttcaaaaatggtttctttctcaagatataaaagaaaaacaccattttaatcagtccgtaatgctgcatcgaagcacctctgtacaagaagacgcactgcgaaaaacgttaaaagcaataacgtgtcatcatgatgcgctgcgaatggtgtttacacagaatgaacaaggaaagtgggatcaatataatcggccgctcagtcattcggacgacgcgttgtacggccttcagatgattgatttgtcagctccggacggcactgatggaaatagaccgtatgaacctcttatcaagcgccatgtacttgatattcagcagaaaatggatttgaagaatggtccgctgctgcaagccggtcttttccacacaattgacggtgatttcttatttttatctgctcatcacctcgtcgttgacggcatctcatggcgggttctgcttgaagatttggctttagggtatcgccaagctgctggcggggaggatatcaaactgccgcctaaaacaagctcgtttaaagcgtatgcgaaaaagctctctgactacgctgaaagccagcagctaatgaaacagctcaagtattggcgcgaagccgaagagtatcaaacagaggcattgccttttgatcaaatcgatggaactagagcacacgagggacaacggtccacaatttcgtttaccttaaacgataaagagacagcagcactcttaaaagacgccaacagcgcatataacactgatacgcaggacatgctgctcgcttctgtcattcttgcgctgcgccattggaccaatcaatccgccttcaaactatcattagagggccacgggcgagaggatgtattaaaaggaatagatgtgagccggacgattggatggtttaccgccatttatccgttattgattaaactgaacgcagacttgccagattcggaagaaagcatggttcatgtgctaaaaacaacaaaagatacactgagacgtgtacctgacaaaggattcggctacggtgtcatcaaatatttgactccgcctggcaaaaaagacatcaatttcacaggtgcaccagaaatcagctttaattatcttggtcaatttgaaagcggccgcacagctgaagtacctgaggaggacgccttctcattctctccgctgggtgccggaggtgatatcagcacaacatggaaccgtgaacagtcgctggatatcagcgcaatcgctgcagaaggaaaattgactgtcaatatgacttatgacaatgcccgctttcagcgcaaaaccatcgaacagcttagcgaaacatgccgtcaatttttattacagctgatcgaacactgccagaacaaaagcgaaacagaaaagacgatcagtgattttgatgatcaagaactgaccgaggacgccctgcaagagatcgctgatatgctcagttttcactaatgaatccgtgaagaaaggtgcagacactatgaataccattaaaaaaatcaagaacatttatcctctgagtcatatgcaggaagggatgctgtttcattccttcctccgtaaagaggagggggcgtatgttgagcagtcgctcttcaccattaaaggaagcctcagctatgactggttccagcgcagcattcaagccattatcgaccgccatgatattttcagaaccgtgtttttgccgcacgtcccgcatttgtcgggacctcggcaagtcgtgatgacagaacgtgaattccatttgaacagcgaagacatttctcatctgccgacaaacgaccagaatgagtatattgaacgctttaaagagaaggacaagcaaaaaggctttgatctgcaaaaagacatgctgatgcggatttctctattcaaaacagctaaagatgagcatgtctgtatctggagtcaccatcacattttaatggacggatggtgcctaggtatcgttatgcaggaatttatgcaaatttatcaatcgattcatgcaggaaaaccgctttcattagaccctgtccgtccgtacagcacctatatttcatggctgacaaaccgagacaaagaaaaagcagcggcctactgggatacctatttaaaaaactacagcgctccatcacctctgcctcgtgtgtctgataaagaaacaaaagaaggttatcaccgtgaagatttgatattttcattaaataaaccactgacagacaagctgaaagagactgccaaacaacacggcgtcacgctcgctacccttattcaggcagtctggggtgtgatgctgcagcaatataaccgcacagacgacgttgtgtttggcgcagttgtatcaggaagaccgtcagaaatcccaggcgtggagcaaatgatagggttgtttatcaataccataccgattcgaattaaaacacaccaagacgaaacgtttcacgagctgctcatacgctgccagaaagaaatgctggaagctgagccgtttacctgccagcctttatttgatattcaggcaaacaccgcattaaaacaggaactgattgatcacattatcgtctttgaaaactatccgttacagcagaaaatcgccgattccgctgatcaaaccgattcaccgctgcaaatcgatcaagttcaagtatccgagcaatcaggatataactttaatcttgtcgttgctcctggcgaagagcttgtcatcaagttcagctataatgcattcgtttacgatgctgcctggatcagctgtatcaagaggcaatttacgcaagcgcttagcacagctgcacagcaccctcatatgccaattgctgatttttcttttcttgatgcaacagaaaaagagcagattgtcacacagttcaacaatacaaaaacggagtatccaaagaatcatacaattatcgatttatttcgcgaacaagcagaaaagacgccagaccataccgcacttgtgtatggcaatatgtctatttcgtataaagagcttgataaacgctctaatgcgctcgccagagagttaattcaaaagggatttcggaaaaacgagacagccggaatattggctgcacattctcccgaattcatgatcagtgtgcttgccgtattaaaagcagggggagcatacctcccgcttgatgcggagcttccgcctgaacgagtcagctttatgcttgaggaaacgcaggcaaaaatgctgattgttcaaaagggattggagcaaaacgctgcgttctcaggaacatgtatcatttcagatgcgcagggattgatggaagagaacgatatccctattaatatcagctccagcccggatgatcttgcgtacatcatgtatacctcaggatcaacaggccggccgaaaggggtcatgatcacgaatcgcaatgtcgtgtcccttgtcagaaacagcaattacacgtctgcgtccggtgatgaccggtttattatgactggatctatcagctttgacgccgtcacctttgaaatgttcggggcacttttaaatggcgcaagccttcatatcattgataaatcgacaatgctgacacctgatcggtttggagcgtatttgcttgaaaatgacattacagtgctatttttaacgacagctctttttaatcagctggcacaggtacgagctgacatgtttcgcggactccatacgttatatgtcggaggagaagcactctctcctgccctgatgaatgccgtcagacacgcctgtccagatctcgcgcttcataatatttacgggccaacggaaaacacgactttttcaaccttttttgaaatgaagagagactatgcggggccgattccgattggaaaaccaatcagtaatagcaccgcttacatcttagatacaaaaggacgtcttttgccaataggcgttcccggcgagctttgtgttggcggtgatggagtcgctaaaggctatttgaacagagtagatctgacaaatgctgtgttttctcctcatcctttcttgcctggagaaagaatataccgtaccggtgatttggcgcgctggctgcctgatggaaacttagaatacatcagcagaattgacaggcaaatgaaaatccgcggaaaacgaattgagcctgccgaaatagaagcgcgcctgttagaaatggaaggcgttcaagaagcagcagtgacattgagagaaaaagatggagaggcgcagctgtacactcattacgtcggtgatcacaaaaaacagatacggattttcgcgccgatttggcgcgtgtgcttccagactatatgatcccgcagcactgggtgcgtgtggagcggatgccgcttaccggaaacggaaaaatagaccgcagcgcgctgcctattccagaaaataagcctgccaaacgacagaacatcatattgccaagaaacttggttgaagaagaattggcgaacatttggaagcaagtcctcggtgttaacacaatcagtattgatgatgacttctttgctattggcggacattcactaaaagcactgcaagtcatacatacactaaaacatcagcagaacattgacataccgattgatttcttgttcgaacatccgacaatcgctcagcttgccgaaaaactttattctaaacagctgacagcagcaaatgaacagcatgtgatcaaactgaaccagcacggcgcgcaaaatcttttctgcttcccgccgatatcgggatttggcatttattttaaagaccttgctttattgctgaatgagaaggcagccgtatacgggtttcactttattgaacaagacacccgcattgaacaatatgttaattgcatgacggacatacagcctgagggcccatacgttttattaggctactctgcaggcggaaacctggcttttgaagtggcacaggctatggagcgcaaaggattagaagtcagcgacttcattatcgtggacgcttatctaaaagaacagcctttgcctatcgataccggtaatgacgaatctgcagcatatctgcctgaagcagtcagagaaaaggtgatgaagaaaaaaagaaactatcaggaatattgggcacaattgctgaatgaagggcacatcaaagcaagcattcatttcatcgaagctggaatccatcccgaaaccagcaagaatacaggcttaacgaaatgggaaggcgcctgcggaaactatagtgagtacacgggttttggcgctcataaagacatgctggaaggaacatatgctgaaaagaatgccgacatcatcctcgacattttagaaaagatcacttcaaatcaagtaatactgcacaaacgataaagcggattagcggacagaggccattctctgtccgtctttctttttgtatcaagaatggataagggacacttgggaatgataacatcatcctttttcttggaggcttctcaatggaccgtctttcttttctaacttttatcatgctgattctagccagttacaggctgacacatttgattgtatttgacaaaatcacagaatttatccgaaaaccttttatgaaaaagaaaaggattgttgatcaaaacgggcatgtagatgaaaaaagcgtgccggcttctaactttggatacatgctcaattgctactggtgtgccggtgtttggtgtgccatcttgatcggacttggctatctttttttgcctcgtattgcaataccgctgatctttattttagccattgccggagcacaagcgatccttgaaacggctgtcggtgtcggcgtaaaacttattgatgtgttaaaaagtctgcaaaccatgatgaatgataaaaagtcctaaaagcggttcacaacatgctttaggacttttttcgtttatttagtgagatagacattctgttaatcacccttttatagcccgggaataccgtaatagcgaatagtgaaagtgatgtaatgggggagaagaaacagaatgaaggtttgccaaaagtcgattgtccgtttccttgtcagcttgatcatcggaacgtttgtcatttccgttccgtttatggccaatgcgcagtctgacagggagctgagagccgtatggattgcttccgtattaaatattgattggccgtccaaaaaagggttatctgtgaaagagcaaaaacaggagtatatcaaactgctggacgatgtgcaaaaaatgggaatgaatgccgttatcgttcagattaaaccgacggctgatgccttttatccgtcagcttacgggccttggtcggaatacttaaccggtgtccaagggaaggaccccggctatgatcctcttgcatttatgattgaagaaacccataaacgaaatttggaatttcacgcgtggtttaatccttaccgtattacaatgaatcatacagatcttaataaattgtctgaggatcacccggcaagaaaacatccagattgggttgccgcctatggaaaccagctgtattatcatccaggcattccagaagcgagagattttatcgtcaaaggcattgaagaagtcgtaaaacattatgatatcgatgctgttcatatggatgattatttttacccttataaaatagcgggacaggaatttcctgatcaagcacagtacgaacaatacggaaaagacgctttttctaatatcgatgactggcggcgggacaatgtgaaccagcttgtcaaacaaatcaaccaaacaattaaagctgcaaaaccgtatgtcaaattcggcatcagtccctttggagtatggagaaacgccgcagatgacccgaccggatcgaatacaaaagcaggcgtcagaaattatgacgatctatatgcagacacaaggcattggatccaagaaggcgacatcgattatattgctccgcaaatttattggagtatcggctttaacgcagcggcttacgacgtgctggctgattggtggagcaatgaagtcaaaaataggcctgttcacttatatattggccaggcagcatataaaatcaataacaattttgatccgccttggtccgatcctgaggaatatgtgcggcaaatcactttgaaccgccagcttgaactggtgaaaggaagcatgcatttcagcctcaaggacctcaacaaaaatccgcttggcatcaaagacagtctcagcaccgatctttacagcaagccggcactggttccgcaaatgccttggcttgacaataccgcccaaaaaaaccgaagcttacgaaagtcaccgaagacaaaaacggcaatcttctgcagattaaagatcacccatcaaatcaaaaaacgaaagaaacagcctattatgcgatatacagagccgaagggaaaaagcagagaacattgctggcaacgcaaagaaaaacacatgagcagcaaaccttcttagataacacggcagatcccaacaagaaatatacgtattatgtcacttcagcagaccggcttcataacgaaagcaaagcttccaaacgaacaacaaaataagaaatgagaaggacggctttctaagtcgtctttttttaaaaagtgattttgggacaggaaacgatggtaaaccgctgaattttttaaaaaacaaaggtgagattcacatgaatatggaggcggtgtttggacatttaccattattggaatctgagaaactagtactaaataaaaataaaatcgaagagaaacacgtacaggacgtgttttacgttttcatttctagtctggttaggtgccacattattttttgtgctgttcggagatgctgtgttgactgatccggctgaagaagcctttttgccgaacttctcttgggagcgggcactgctcttgttttatgccttgtgttctttctctatcaaaaactcgatcaatcacagttcgcggtgatcaagctaggtatatggggatcagcggtcggtttattgatggatacgatttccctttggaatcttcccctcatcttcccggctttatcaaagggccaagttattgcgtttacgatatggatggtatgcgcctactgcatgtatttgctcatcccgctgatattatcacataaaaaatgattcagttttaattttcagacttttcttgtcagggaatgattatagaactcgcctaataggatgttacaaagatgtgaaggaggaaacgatgtgaattttgagctgacaaaagaacaacaaatggtgcgtgaaatggtaaaagattttgcgaaaaaagaaattgctcctcacgctgaacatgtagatcaaacaggcgagttcccgatgcaaacatttaaaaaaatgggtgaactcggtctgatgggtattccatttccagaagaatacggcggatctggcggtgatacgatttcatatgccttagcggttgaagaagtcggcaaagcctgcggcagtactggattaagctatgctgcagcggtctcgctaggcgcaagccctctttactacttcggaacagaagagcaaaaacagacgcatttgacgccgctggcttcaggcacagcactcggatcattcggcctgacggagccaaatgccggctcagatgcaggaggcactcaaacaaaagcgatttcaaatggtgacgagtatgtaatcaacggcgaaaagtgctggatcactaatgcaagctacgcacgcacagttattgtaaccgccgtaacaggcaaaaacaaagacggaaaaaacatcatctccgcattaatcgtgccaactgacacaccaggacttacgattacgagcccgtacgataaaatgggcgtccgcggttcgaatacagcggaaatcttgcttgaagatgtaagagtgcctgcggccaacttacttggcgatccaacaaaagggtttaaacagtttctatatacgctggatggtggtcgaatctccatcgctgctcttgcagtcggcattgcccaagcggcccttgacgcatcattggcatatgcgaaagagcgaaagcagtttggacagccgatttcttcctttcaagcgattcaatttaagcttgctgacatggcgatggaaattgatctggcacggcaaatggtgttaaaagccgcctggctgaaagatcataaccgcccgttcaccaaagaagcggcgtacgccaagctattcgcatctgaaatggcgacaagagcttgcaatcaagccattcaaatccatggaggttcaggctatatgaaagagtatggggtggaacggatgctgcgggacgcaaaattaatggaaatcggtgaaggcacatctgaaattcagcgtctcgtgatcgccagacagcttttaaaataaaaatgtaaacgctttcctatcattaagaaaggaggaacaatgaatggctgaactcatccattccacaatcggcaggctgctggaacaaacagctgatgcgtatcccgatcgagatgctgttgtgtatccagaccgaaatatccgctatacgtacgctcaatttgacagtctgtgccgtcaaaccgctaaaggtctcatgcggatggggattggaaaaggagaccacgtcgccatatgggcttctaatatctctgaatggcttgccgtccagttcgcaactgcgaagatcggagccgtgctcgtgaccgtcaataccaattatcaagcacatgagcttgattacttgttaaagcaatcggatgccgcggcgcttattatcatggattcatacaggggcacttcttatccagacatcgtgaacagtttaattccagaactgcaagaagcaaagcccggccaactgaaatctgaacgctatccctttttaaaaacgctgatctatattggcaataaacgattgtctggcatgtatcattgggacgatacagagatattggcgaaaacagtgacagatgctgagcttgaagagagaatgaacagcctggataaagacaatgtgattaatatgcaatacacatcaggaacgacagggtttccaaaaggcgtgatgctgacccatttcaatgtcatcaataacgctgctaatatcgctgaatgtatggctttaacctctcaagaccgcatgtgcatccctgttccgttttttcactgctttggatgcgtccttggggttttggcatgtgtatccgtcggggcagccatgatacccgtgcaagaatttgatcccgttaccgtccttaaaacggtgaaaaagagaaatgcacagtgctccatggtgtgcctaccatgtttatcgccgagctgcatcatccggattttgatgcatatgatctatcgacgctccgaacaggaatcatggccggctctccctgtccaagtgaagtgatgaaagctgtgattgaaaggatgggcatgaaagacattacgatcgcctatggacaaaccgaagcctcgccagtcattacacaaacgagagcaaatgattccttcataagaagagtcgaaacaaccggccgtgccctgccacatactgaggtgaaaattgtagaacccgggacatgtcaagaagttcaaagaggcatgcagggagaactgtgcacccgtggctatcacgtcatgaaaggctattataaagacaaagatgcgaccagaaaagcaatcaatcatgacggatggctgtttaccggagatcttgctgtcatggatgaagacgggtactgccgcatcaccggaagattaaaagatatgctcatcagaggcggcgagaacatttatccgcgggaaattgaagaatttttataccagcatcccgctgttttagatgtacaggtggttggtgtgcctgacgccaaattcggggaggaagctgcagcctggattaaactgaaagacggtaaaagcgtttcacctgatgagcttaaagcctattgcaaagggaaaatcgcccgccacaaaattccgcgttatgttatttttacggatgactatccgatgacggcctcaggcaaaattcaaaaatataaactgcgagaaaaaacgattgaaatgttcaacttatcatcaagtcaatgaggtgaaatcatgtttacaaaagtactgatcgccaaccgcggtgaaattgcaatgagaattatccgaacatgcagccgtctcggcattaaaacggtcgctgtttattcagaagcagacaaggacgcgccccatacaaaagccgctacagaggcatatttgatcggggaatcgagagtcagtgaaagttatttaaatatagagagaatcataaagacggcgaaaaaagcaaaagccgacgcgatccacccgggatatggattgttatcagaaaacagccggttcgctgaacgctgcaagcaagaaaacatcgtgtttatcggaccttcccctgatatcatcgcaaagatgggcagcaaaattgaagcgcgaaaagcaatggaggctgcaggtgtccctgtggtgccgggcgtttctgaatccctcggagatatagaggcagcctgccgcaccgcaagtcaaatcggctatcctgtcatgctgaaagcttcagcgggcggaggcggcatcggaatgcagcgtgttgaaaatgaagaagcattaaaaaaagcgtacgagggaaacaaaaagcgcgcagcagattttttcggtgacgggtctatgtatatagaaaaagttattgaacatgcgcgccacatcgaggttcagcttttggccgatcaacacggccatacagtacatctgtttgaacgtgattgctctgttcagaggcgccaccaaaaagtcattgaagaagcaccgtctccatttgtagacgatgaactaagaatgaagatcggtcaaacagcggtaaaagcagcgaaggcaatcggctatacgaacgcaggcaccatcgaatttatagttgaccagaaacaaaatttttatttcctcgaaatgaatacgagactgcaagttgaacaccccgtgactgaagaaataacaggcctggacttagttgagcagcagctgcggattgctgcgggccatacactcacattctcccaaaaagacatccaacggaacgggcatgcgatagaggttcgaatatacgcggaagatcccaagaccttcttcccgtcaccaggtacgatcactgcgttttcacttcctgaccaaaaaggagtcagacacgaatgtgcggtagcaaaagacagcaccgttacccctttttatgacccgatgatcgctaagatgattgtcaaaggccaaaccagaacagaagcaattgaaaaactagagacagcgcttcgcgactatcgtgtagagggaatcaaaacaaaccttccgctcctcatacaggctgcggcaacaaaggcatttaaagaaggggatgtcacgactgactttttgaaacagcacctataaaggaggcagttgtcatgacggttagcatacaaatggcaggaaacctgtggaaagtccacgtcaaagccggcgaccaaatcgaaaagggccaggaggtagccattttggaatcgatgaaaatggaaatcccgatcgttgcagatagaagcggaatcgtaaaagaagtcaaaaaaaggaaggcgactttgtaaatgaaggagacgtactgctcgaactgagcaattccactcaataatttggaggaagaccatgccatatcctaaaaaagtgacaatcaaagaagtcggcccgcgtgatggcttacaaaacgagcccgtttggatcgcaacagaggataaaataacctggatcaaccagctttcccggacagggctgtcgtatattgaaatcacatccttcgttcacccgaaatggattccggcgcttcgagatgctatcgatgtagcaaaaggcatcgaccgagaaaaaggggtaacgtacgcggcacttgtcccgaatcaaagaggactggagaatgcacttgaaggaggcattaacgaggcttgcgtttttatgtccgccagcgagacgcacaacagaaaaaacatcaataaatccacttctgaatccctccatatactcaaacaagtaaacaacgacgcacaaaaagcaaacctcacaacaagagcctacctctcgactgttttcggctgtccgtacgaaaaagatgtccccattgaacaagtcattcgcctttcagaagctctatttgaatttgggatttctgaactgtcgcttggagatacgattggagcagctaatcccgcccaagtggaaactgtacttgaagctcttttggcacgattcccggctaatcaaattgccctgcattttcatgatacgagaggaaccgctctggccaacatggtcacagcactccaaatgggcatcacggtgttcgacggctcggcaggcgggcttgggggatgcccatatgcgccaggttcatcaggaaacgccgcaactgaggatatcgtgtacatgcttgaacagatggatatcaaaacaaatgtaaagctagaaaaactgctatctgcggccaaatggattgaagaaaaaatgggcaaaccgctgccgagcagaaatttacaggtgtttaaatcatcttgataaaagggaggacgcatacaatgggagattctattctttttactgttaaaaatgaacatatggcgttgatcaccttaaacaggcctcaggcagcaaatgctctttcagcggaaatgcttagaaacctgcaaatgattatccaggaaattgaatttaactcaaacatccgttgcgtcatcctcacaggcaccggtgaaaaagcgttttgtgcaggggcagacctgaaggaacggataaaactgaaagaagatcaggttctggaaagtgtatctctcattcaaagaacggcggctttacttgatgccttgccgcagccggtcatagctgcgataaatggaagcgcattaggcggcggactagaattggcattggcatgcgaccttcgaatcgcaactgaagcagctgtgctgggacttccggaaacagggttagctattatcccgggcgctggagggacccaaaggctgccccggctgattggcagaggaaaagcaaaagaattcatttatacaggcagacgcgtgaccgcacacgaagcaaaagaaatcggccttgtagagcatgtcacggctccttgtgaccttatgccaaaagcagaggaactggccgcagccatttctgccaacggaccgatcgctgtccgtcaggctaaatttgcaatcaataaaggattggagacagatcttgctacaggccttgcgattgaacaaaaagcgtatgaacaaaccatcccgacaaaagacaggagagaagggcttcaggcctttcaagaaaaaagacgggccgtatacaagggaatataaaagggaggcaatgctgatggattatgaaaaggaacgaacagaacgggctgaacggattcgaaaaggcggagcggaaaagtatcatcaaagcaatcgggaaaaaggcaagctctttgtcagagagcggctttcccttctctttgacgatgacattgagctagaagacgctttttttgcggaatgtatgtcagacgggcttcccgctgacggagttgtaaccgctatcggcaaaatcggcggccaaaccgtttgcgtcatggcgaatgattcaacagtgaaagcggggtcatggggagcaaaaacagttgaaaaaatcatcagaattcaagaaatcgccgaaaaattaaactgtccgctcatttatttagtcgattcggcaggcgcccgaattaccgaccaaatcaatgtctttccagggagacgcggtgcaggaagaattttttacaatcaagtcaaattatcgggacgcattccgcaaatctgtctgcttttcggaccatctgcggcaggaggcgcttatattccggccttctgtgatatcgtcgttatggtagacggtaacgcctccatgtatttaggttcgccaaggatggcggaaatggttattggagaaaaagtgtctctcgaagaaatgggtggcgcccgtatgcattgctcaatctccggctgcggagatattcttgcagaaactgaagaagaagccatacagctggtgcgggcttatttgtcttactttccggcaaattttcaagaaaaagcgcccattcatgagaaacgcccgccaaaacacttcgaaactccgcttgccgacgtcattccgcaaaatcaaaacgcaccttttgatatgcatgagctcattgagcgggtcatagatgaagactcattttttgagatcaaagccttatttgcaccggaattattgacgggcctcgcacgaatccacggacagcctgtcggcattgttgcaaaccagccgaaggtaaaaggaggcgtcttattccacgattcagcagacaaagcggctaagtttattaccttatgtgacgcttttcatatcccattgctgttcttagccgatatccccggttttatgattggcacaaaagtagaacaggctgggattatcagacacggagcgaaaatgatttctgcgatgtcggaggcaactgttccaaaactctctgtcattgtccgaaaagcttacggggcggggttgtatgcaatggcagggccggcatttgaaccggattgctgtctagcgctcccaaccgcccaaatcgccgtcatgggccctgaggccgctgtaaacgctgtctacgctaaaaaaatcgccgagctgccagaagaagagagagccgcatttatcagcagcaaacgggaggaatacaaagaggacatcaatatctaccgtctggcttcagaaatgatcattgatgctgttatcccagccaattcgctgcgtgatgagctggccaaacggctcaaggcatacatgacaaaggaaatgacatttaccaatcgaaagcatccggtttatccggtgtaaaagcaagaacttaggagcgcaaaaaaagcgctcctttatatatttacaataacaacattatgtcaactaattaccattgcataaaacgcttggttttttagaatagtaaataaaggctgccgcacctctagcggcaattgtcagtttatcataaaaaggggcctacattatgtatcatttatattcacataacgacttggacggagtaggatgcggaatcgtagcaaaattggcgttcggaaaagacgtagagatccggtataactctgtcaacggcttaaacgcacaggtgcagtactttttagaaaaagcgaaggagagcaacagacaggacgcgttattcatcaccgatctcgccgtcaatgaagaaaacgaagagagattgaatgagtatgttcatgcagggggcaaagtgaagctcattgaccatcataaaacagcccttcatttgaatgagcatgaatggggatttgtccaggtggaatacgatgatggaaggctcacatccgcgacatcgcttttatatggctatctcattgaaaatggcttcatgaaaccgacaaacgccttagatcaattcacagagctcgtccgccaatacgatacatgggagtgggagcggtacgatcaaaaacaggcgaagcggcttaatgatcttttctttttgctgtcaatcgatgaatttgaagcaaaaatgatccagcgcctttccacgcatgacgaatttttcttcgatgattttgaagaaaaactgcttgatttagaagacgaaaaaatcgagcgctacctccgcagaaagaaaagggaaatggtacaaacctttgttcacgaacactgtgtaggcatcgttcacgctgaatcgtaccattcagagctggggaacaggctagggaaagataacccgcacctcgattacattgcgattttgagcatggggtcaaaacgagtcagtctccgcaccattcatgattacatcgatgtgtcagaaatcgccggccgatatggcggcggagggcatgcaaaagcgtccggctgttcaataaccgatgaagtatacgagttgtttgtagctgaagctttccgtattgatcctgtacggccggatgccttccgtaacatctataatctaaagggatctgcgaatggatcattatatgaaaatcgcgcacaaatgagattttttcttttccctttagacaacgaatggaatattcaaattaacggagaaacccaagacgaaacattcgcagcgtttgaagaggcagaatggtttattaagagaaattatgccgcatcgctcgtgcgggatgaagtgtttgtcgcatttttagcggagaatctgaagctggcaaatcaacatcgcaagtaaaaaaatatgcataggggagcgtcagtcacccctatgcatatccgctagctatcgtttaaatatggctgtacgtttcttaatcacaaaataaagggctatcacgacaacagccaatatcataatcggtgttgtataagtgcctgctatattctcaacatcatcccactggcttcctagctgtatgcctaaataaacaaacaggatagaccatggaatgatagcaagcacagtcagtaccacaaatttgagaaaaggcattctggcaatacctgccggaatggatatggcatgtctgacaaccggtataaaacgagccgagaagacaactccggcgccgtatttctgaaaccagttttccgacatatcgatatgatgctttttaatcaataaatacttcccgtatttgtccagaaatggcctgccgccatagcgaccgatccagtaaataaagatctgggcaatggtgcccccgataacacccgcaataattgcgccaataaatccaatcgtgccctccgataccatatagccgccataagctaatacaatctcactcggaatgatttcaatcattaacccaatcgcaatacccgcatatcccatgttcgtcagccatgttaaaatttcgcttatcaaactgcccacattcttcacaacctgtcctaatctttttcactattatatgactgattgacgagcaagatggttacaatttttttaccgcagcatttctttcgtttcccgtttgatcacatcttctaaataggccaaaagctgagatctcatttcgggacgcattaagccgatttcggtgctcgctttaaaacagcccagcttatcgccaatgtcatatcgatttccttccagcagccgggcatggatcggctccttacggcaaacctcacgaagcgcatctgtcagctgaatttcgttgcccgcgcctctgccaattgtcttcaaaacggagaagatcgaagaattcagcacataacgtcccattactgcgatttccgaaggtgcttcttcaggagaaggcttttccactaaatcgttcacttcatatacatgcccttgagaccctgatgtatttataataccatatttgctgacatcctcagggagaactgactgtacaccgacaacctctgtgccataaacgtcatatacatccattaattgccgaagagccggtgtttcagacaccataatatcatcacctaagagaacagcaaaaggctcatctccgataaaatgctccgcacacagcaccgcatggcctaatccgagcggttctttctggcggatgtaatgaatgttggccaaatcggcaatctgctgcatttccttaagtgtctccgtcttgcctttttcccggagattgaattccaattccgccgaccgatcaaaatgatcttcaatcgagcgtttgtttctccctgtaataatcagtatatcttcaattcctgactctgcggcctcttctacaatatattggattgctggtttgtcgacgattggaagcatttctttaggctgcgcctttgtcgccggcagaaatctcgttcctaaacccgctgcgggtataaccgcttttctcactttttttctcattcatcttcactcctgatcctgtatgtttttcagcgaatctccaaatacccagattcggtttccgataaaattcatcatcattccgccgatagtggcggcgagcttactcaccaaaagcgagcagccgcaattttgaaacaaataaagcagcaaaaaggtgatccctgacgcggcaatattaatcatgagaaaacgcacgatctctttcccgtcagccttacgtttcacacaaaacgtccaattccggttccacacatagctgttgacgatacctgcagtataggagcagatctgcgccggcagataagagacatgacaagcggtaagaagaaagaagacaccaaaatctatcagcgtattgccgacgcctacggtgcaaaaacggcctaatgtctttattttttctttcagcgtaacgaacctcccttcataaaagatgcgagtggcagtcatatttgttgatatggattactatagcggacagtgttgaataaacaattaataaaatatgaacaaaacatgaaaaagcgggtataccgctcaatagtcttatactcttgaaaaaaacagccgcattgaacggctgttttttgtgtctgaaaacatacaaatataaacggagtgttagccccatcttatcaatgaataaatgtatccagttcctttgtagaatcgaacactaactcctccaaaagtttctatacacaatttttttaatgatgtaggatgttagataaagggatatcttggataatgatgtaatctccgttcaatgtgattagtgggaggccatgaacaatcctgtctttttattttctggacaatggtcgctaggaatggggaagtttttttgaacaattttgaaggagtggtgcgatctcctcgaagaaaagagagaatggagacacatgaagatgagctttcagaacaactgggaacattgctaaacagcttccggctactttatgcgtgcaatcttcgtgacctgttgttatcaaattccaaaagaaaatcccccattttaaggaaaaaggaggatgtgaagtgatgaggaaaaagtgtagcgtatgtttatggattctagttttattattgagctgcttatctgggaagtctgcgtatgctgccactagtactacaattgcaaaacatatagggaattcaaatccgcttatcgaccatcatttgggagcggatccggttgcgctgacctataacggaagagtctacatctatatgtcaagtgatgactatgaatataatagcaacggaacaattaaagataattcatttgccaatttgaatagagtattcgtcatatcttcagcggatatggtgaactggacagaccacggagccattccggtagcaggtgccaatggagctaatggaggccgtggaattgcaaaatgggcaggtgcgtcatgggcaccgtcaatcgcagttaaaaaaattaatggcaaggataaattcttcctttatttcgcaaacagcggcggaggtatcggggttctcaccgcagacagcccgattggtccatggaccgacccaatcggaaaaccgctcgtaacgccaagtacgccaggaatgtctggtgttgtatggctttttgatccggcagtatttgtagatgacgacggaaccggttacctgtatgccggcggaggcgttcctggcgtttcaaatccaacgcagggacaatgggccaatcctaaaacggctagagtcataaaattggggcctgatatgacgagtgttgttggaagtgcatctacaattgatgcgcctttcatgtttgaagattcgggattgcacaagtataacggaacatattattactcctattgcatcaatttcggcggcacgcacccggccgataaacccccgggtgagatcggctacatgaccagttcaagtcccatgggtccctttacatatagagggcacttcctgaaaaatccgggtgcatttttcggaggtggcggaaacaaccatcatgctgttttcaattttaaaaacgagtggtatgtggtgtaccatgcgcaaactgtcagttccgctctgttcggggccggcaaaggataccgctctccccatattaataagctggtgcataatgcagatggatctattcaagaggtagcggcaaattatgcaggtgtaacacaaatttccaatttaaacccatataaccgggtagaagctgaaacgtttgcttggaatggacgcattttgacagagaagtccacagcacccggcgggccagtaaataatcagcatgtaacaagcattcaaaatggagactggattgctgtaggaaatgcagacttcggagcgggcggtgccaggtcatttaaagcaaatgtagcatccactttaggcgggaaaatagaagtgcgcctcgacagtgcagacggtaagcttgttggaactctgaatgtgccttcaacaggcggagcgcaaacgtggagggaaatagaaactgcggtaagcggggcaaccggtgtgcacaaagtattctttgtatttaccggaacaggtacaggaaacttgtttaattttgattactggcagtttacgcaaagatagtactcgtaatgggaccgcttaaaaacgaggcgggtgaagtacgggccagcaccggaacagcccgccattatggatatgccatgcagattttttaataccgtaaaagacacatgacgaaggagaggaataaatgattccacgcataaaaaaaaccaatttgtgtactattagtatgtttcactatgctgtcagtcatgttagggccaggcgctactgaagttttggcagcaagtgatgtaacagttaatgtatctgcagagaaacaagtgattcgcggttttggagggatgaatcatccggcttgggctggggatcttacagcagctcaaagagaaactgcttttggcaatggacagaaccagttaggattttcaatcttaagaattcatgtagatgaaaatcgaaataattggtataaagaggtggagactgcaaagagtgcggtcaaacacggagcaatcgtttttgcttctccttggaatcctccaagtgatatggttgagacctttaatcggaatggtgacacatcggctaaacggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataccaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgccatcaataaaagcaacacaggagtcaaccaaaactttgttttgcagaatggatctgcttcaaacgtatctagatggatcacgagcagcagcagcaatctacaacctggaacgaatctcactgtatcaggcaatcatttttgggctcatcttccagctcaaagcgtgacaacatttgttgtaaatcgttaagagcacaaagacacacataaataatagagtgtctgaattggcgattttccgattgggaaatcgcttttttattttgttgctgaattacaggaagaagaaaggatgtacataaaaacagcaaagctttattcttcatcttttctagtttacataatatatattctaggaagtaaacaaaataaataaatttctgtctcaatatcaaagtatacttaagttagtgagacagaaattgaaattttactgctgaatgacaaatcaaaaaaatggtgttgtcaatccataataaacggcttctaaatcttccagcgtcatatcgccatatgcgcatttgataacagaatcagcaaacacatcatagtcataatctgtagaaaatccttgctgcagctgtttttcgtaaacttcgatctgatctttttgatgctggatgtctttttccttacctggatagtcgggaccatttatcatattactcatttttttatacagcaccatatactgtttcagtatttcatccacaacgcaaacctcctattagatgataaaaacggacatcgttactgatgtccgccaaaaaaagcttaactaatttggttctgttccccaaatcagttttccttgatcatataatgtgatttttttcgttgttttaaacgtatttgatttgaaaaaggaataatcgccgctttgtgcataattgctccagtcatcattgtgaagacggagctgaatattccctgtgcttgctcccggtgccaacgttccgtttttaaatccaagttccagataggtatctgcaccttgctttggtttatgcaacgtcacaaacttgtgtgtcacattgccgcatccaatctgcgcgtagtcacagtcaaagttttggcctttgtttttcgctttataccagtaacgggcagtgacatcttttaaatcaaccgtggtattgccgttattttttatttgaagctgcggacggatttggttgctgttcatactcccatcccctgctctgtactgtacagaaataccattttcctgtgtgggtttatcttttgatggcgtttcaggaatgtccttcgtcgaatctttggtgccgagaatgttttctctaacgaatgttcctgaagcagataaatctgacaaccgccagccgcctgttttagatgcccccggctttaaagctgaggatgattcctgcttatcagaaagattccagttcacccagctaatggtcttgctgtcgagatatttcagccattccctcgattgatcaaggaatacaccgccattgccagacgcgtcgcttgttccccactctgtcacaaaaataggtgctcctttgctgagtgcatagtttgctttatcccgtaaaaattggccgtgtgtgccggcataaaaatgaagtgcgtacataacgtttgcatcttttagctggtcatcggcagcatcattcacatcctggctccatgtaccggttccgacaatgatgatgttgtctggatcatttttgcggataactgaaatcacttcttccgcatatggtttaatatcacgcttccagttcacatcaccgtttggttcgtttgcaatttcataaatgacgtttggcgtgtttccgtaaaggcttgacatttccttgaagaattcttttgccttctctttattttggtttggattaccgtcatttaagatatgccagtcaatgatgacatatatcccaagctcttttgccgcttcaaccgcttcttttactttatttttcacggacgggttgtcaatataaccgccatctgccgtatacatcgctgcacggaaaacggtgataccccaatcatctctcagccattttaagctgtctttattgacatattctccataccattgcaatccgtgtgaactgatccccttcagctgtaccgctttaccgtctcggttaacgagctgtgtaccttttatgctaagctggccattcttggctactggcgtttttgtccctgctgctgatgccggcgaagctatcatgccgcccattgtcaataacgtaatcaataaacacgtaataaaaatagagattgaccgtttcatatctgatcttttcctccttcgcatcattttggctctacacttcttatgagcacgaactcattgtaaaaatctttctcatgattgtctatcaacctaatttcttgttttggggaggtttaaaagcctgtcaatttgctctacctccaatgaataagacacacatgacacatatagaacaaagaaaactggactgaattgggactttacacgtcatttttcattcgagtcgaaaaattaaatttatttccaataatgaaaaagctgcattcaactattgaatgcagctttgttttatatttatattatgcttcttgtttctcatcttcccatgtttcagcgtttttcagccctgggatgtttttcgctttaaacacaggatcaagtccttgcttacgctgtttcgcgtaatctttatacactttgtaagcaacgtttgacagcagcgcaatcacaattaagttgatcagcgccatgatacccataaagaggtccgccatatcccaaacgatttggaagcctgataaagatccatacacaaccatagcaataacagcgatacggtaaatgttcagccatgttttgcttgttttaataaattcaatgtttgtctcgccataataatagttgccgacaactgaactgaatgcaaacaagaacattgcgactgcgatgaaagtcggcgcccagcctccaatgtgatggttaagagcagcctgtgtgacttggatgccgtcgccttttggcgttacactgtacagcaaaataataaatgctgtggacgtacatatgataaatgtatcgaaaaatacgcctaatgtttgaataaagccttgctttgccggatgggatacatgagccgtcgcagccgcgtttggtgcgctccccattcctgcttcgtttgaaaaaagtccgcgttgcgcaccgataacgatgatgccgcctattccgccgccgacgacttgttcaaaacctaaagcatttttaacaattgtagcgataacgccagggaaagccgtaatattcgtgatgacaacaaataaagcgataagaatataaatgcctgccataaccggcacaattagctgtgaaacagcgacaacacgttttaaaccgccgaaaatgataaacgcagttaaaaccgccagaactatggctacaactattttatttacatggaatgcgccatccaatgctccagcaattgtatttgtttgaacagcgttaaaaatcaagccgaatgagacggtaattaagattgcaaaaacgatgccaagccatctggcaccaagacccttttgaatatagtaggccggccctccgcggaaatcctccccgtctcttaccttataaagctgtgctaatgtactttcgacaaagcttgaagccatgcctactgcagccactacccacatccaaaatacagcgcctggtccgcctgtcgcaattgctaaggctacaccagtcaaattccctgtgccgactcgggatgcggccgaaataaagaatgcctgcatagatgaaacacctttatttccttccggcttctcccctactattctgaacatttcaataaaataacggaattggataaaaccaaaacgtatggtaaaaaataatccaagccctattaaaatataaaataggtatttccagatgaaatcacttggaatattaatcaaactattgaaaaaagactccatatttacctcccgttttcatcaattcaatacgaattcgattttgatgttagattttttaacataacgagttttattatatcacaatatgacgaattaggaagttttttcgagaagaatattgtcatagccagatgttactctgtcgaccccttctctattattttcctacgaataaaaacattccttgcaaactggctttaaaaaaagagtaccctattaacaatgtaatcatttcttcccattctcttgcctttctctttgatttacacataaataaagtaataaatcctaaacaacatatcatttaaaatatgtttttattcacaccataaaccgggtatacatacgctaataaaagaagttttctctttcaaaaataagcaaaaagatatatacttaacaaagttaaatttatttttaaatttaataaatcaggtttacttttaggatggattggggtattattataaaaatattcagtaatattaaaggagggggagatcatttgaaaaaagtaacgatattgaaagcatccatcttattcttggcgattgccagttttcatttgttctcaattccccacgcctttgatatcggccatcattataaagccgtagccgaccagcaggaaatgcatgagatgaaagccggccaaaatgctgatgatgagaagaaatccatcacaggggcatttacgctgaccgctttatgggcaatggctgttctgctgctgaccgctgaaagcaaaagtacgggatactcccgcagacgtcagcggaaaaaaagctttatactggccaaattttatcaatcgtcttatttcggcaaacttcatgttcaacatcacccgattatgtaacgaaaatatgaggaggctgttaaacatgttgtttatcttaagaatggtgattttaggcttattttctttcacagcgctgaatttatttgtatggcaggggattgaagtcattcatgctgtaacagatctattcaccaaccatgaaagctgataaaaaacaaacgaaacccgctcatatagtatgagcgggttttttattattgttctgtatgaaggcgccaaacagctgtaaccttgcctgattcctcttcatcaaaaaagaaagagccattgctgtatctgtcgtttgtccgcaactcttttgtctgcagttcttttctgtcgcctttttctgtttctgccattagtcgctgttcaagaccgcaagcgaacagtgctacaacacggtgaggattctttttcagttcccttagcattacgacaccgcgttttgcacgggatgtcttctcgaactcagaaagactcatgcgtttaaccgctccccgctgtgtgaacaagacaattgaatcagattgctgaagaatctcaccggagacaacaaagtcatcctcttttaagttaatccctttgacacctgccgcacgcgcgccaactacattcacttcgtcttctccaaaccatagaccataccctaagtgagtggccataaagatctggctttccccatttgttacatgtacatcaatcagttcatcttcacccttcagatttaaggctacaagtgccttagaataacgctgtgctttataatgagtgagctctgtctttttcaccataccgtttttcgtaaagaatagaagatatgccgacggatcaaattcttttatcggtatagcctttacaatcgtttcatcacggtcaatagtgattagatttgaaaaatgctggcccatgtccttccatctgatatcaggcagctggtgaacaggacaatagatgtagcttcctttgttcgtaaagagcagcagcacgtctgtcgtattcatttcaaactgatgcagcatcctgtccgtatctttcattccgaagtcctgaccgttggaagcggcaaatgagcgctggctcgtccgttttaggtaaccatccttcgtaacggttacatatacatcctcagatgcaaccatgacttcgagattgattttaatttcttcaattttttcttcaatcacggagcgtctcgtatctgcatatttctttttcagtgcttttaagctgtttgtaatcacttttagcagttttttatcattgctcagaatagattcgagctcttcaatttttttaccgagctcttctgcctcttccttaagcgctgtgatatcggtattggttaaacgatatagctgcaatgacacgatggcttcagcctgaggctctgtaaattcatatttcgcgatcaaattgtttttagcgtcacgtttatcgctagaagaacggattgttgcaatcacttcatccaaaatagacaaagctttcatgagcccttctacgatatgatgtctgtcttttgctttttgaagctcgtaaacggaccggtttgtgacaacttccttttggtgtccgatatatgcatccaaaatagacggcaggctcatcagcatcggacggcggttatggatagccaccatattgaagttatatgtgatctgcaaatcagtatttttatataagaaattcaaaatgcctttggcatcagcttcttttttcagttcaatgaccactctcagccctgttcgatccgtttcatcacgaacctctgagatgccttcaacctttttatcaatacggaactcgtccatttttttacaaggtttgctttatttacttcaaatggaatttcagtaatgacaatttgttctcgtccgcctctgattgtttcaatttcagcctttccgcggataatgatttttccttttccggtttcgtaagcttttcttatcccgtcaacgccctgaataataccgcctgtcggaaaatcaggccctttaataacttccatgagttcgtcaacagagcaagaaggcatttgaatacgcttaatgacagcatcaatgacttctcccagatgatgagggggaatgtcggtcgcgtatcctgctgaaatcccggtagatccgttgaccaataggttaggaaacatcgccgggagtacgacaggctccttgcttgtatcatcgaagttcggcacaaattcaaccgtgtttttgtcaatatcccgaagaagctcagatgctatcggagataatcgtgcctctgtataacgcatggctgccgggggatctccgtcgatgcttccattgtttccatgcatttcgattaacacattacgaactttccaatcctggctcatccgcaccattgcttcataaaccgagctgtcaccgtgcggatgatagttaccgatgacgttaccgaccgttttggccgcttttctgaagtttttatcaaacgtgtttccatctgtatgcattgcatacagaattctgcgctgtaccggctttaatccgtctctcgcatcgggcagcgccctgtcttgaataatatatttactgtagcgtccaaaacggtcgccgatcacctcttctaatggtaaatcatgaaataattctggctgtgacaatcattaaacctcctcagcgaccgataagttttcattttctaaaatattgctttcttcatctaagccgaaagcgacgtttttctcaatccactttctgcgcggctctactttgtctcccattaacgtcgtcacacgtctctctacacgtgccgcatcgtcaattttgaccctaacaagtgtgcgggactccggattcatcgtcgtttcccacagctggtctgcgttcatctctccaagacccttatatcgttgaatggtatagcctttgccgacttttttcaggacatcccccatctcttcatcagaccatgcatattcaatgatttcctttttcccgcttcctttactgaccttatataaaggtggcagcgcaatgaacaccttgccatgctcaatgagcggtttcatatagcgatagaaaaaggtaagaagcagcacttgaatatgggcgccgtcagtatcggcatcggtcataatgatgattttgtcgtagttgatgtcatcgattgagaaatctgccccgactcccccgccgatcgcatgaatgatcgtattgatctcttcatttttaaagatatcagcaagcttagctttttctgtattaatgactttaccgcgtaaaggcagaaccgcctggaatctgcggtctcgtccctgcttggctgacccgcctgctgaatctccctcaacgagatacaattcattttttgccgggtttcttgaacccgcaggcgtcagctttccgcttaaagtcgcttctgattttttcgttttttgccgcttcttgcttcttcacgggctttgcgtgccgcttcgcgcgcctggctcgccttgattgcttttttgacaagaagcgttgcggtgtcccgattttcctctaaaaagtaagcaagctgctctgaaacaatcgcatccaccgctgatcttgcttcactggtaccgagctttccttttgtttgtccctcaaattgaagaagctcctcaggaatgcggacagaaataatggctgaaagcccttcccttatatcggtgccttcaaggttcttatccttttctttcagcaaagccacttttcgcgcatattcattaaaagcacgcgtcatcgcagtttttgcacctgactcatgcgtcccgccgtcttttgttctgacattgttgacaaacgacaaaatattttcagaataaccatcgttaaactggaacgcaaagtccacttctatagaatgatgctcaccctcaaacgagaccacttcagacaagacgtctttttcttcatttaagtaagcaacaaacgcttctatgccgttttcataataaaagacctcacgctggtcattgcgttcatcaatcagctcaattttcagtccttttaacaaaaacgcagactctcttaagcgctcagagagcgtttcaaaattataagtggttgtgctgaacatcgttggatctggcttaaagtgtgtaagagttcccgtcttttttgttttgccgatcttttcgagagatgtaaccggttttcctccattttcaaatcgctgctgatagacaaaaccgtcccgctcaatggtaaccgtcagccattcagataaagcattcacgactgatgcaccaactccgtggagcccgccgcttgtcttatagccgccttggccgaatttccctccggcatgaagcaccgttaaaatcacttcaggggttggtttgccgagcttatgcattccggtcggcatgccgcggcctctatcctgtacagaaatactattgtctttatgtattttgacgattatgtgatctccatggccggcaagcacctcgtcgacagagttatctacaatttcataaaccaagtggtgcaaaccccgcgcgtcagtagagccaatatacatacccggccttttcctgacagcctcaaggccttcgagcacctgtatggcatcttcgttgtaatcaaattgctgttttctagccaaacgtacaaacccctttcaaaaactaacattgtctttctcttttcagtgttacacatcatttgtatataagatattttttataaacctcgcctcgagccagtactgccttggactcctcattataaccaatatgtttgcaatcgcaacatagagctaacgaatcagttcttctcaaaacatcggctagtgctgtttttacactatgagaacgtatgtttgtttattatatataaagcagcagaccttcgcaaatcgaacggccgaaacccagctggacaaggtattcaaaaaaagctgttcaagctttattgtatctgtttcaccgtaatacgcaaacaatatcttaaaattaaaaagcaaaaatccttgaatttacaaggatttttgcagttctgcacctattttgttacagcgtgtgccacttttatgcacagatccatgataaccgttctgcctttttcttttagcatctggtatgcttcctcattaactagcccttgctgtgcccaaaatactggcgcatctgtctctaaaaactcttccgccactccaggaagctgttctgagcgccggaatacatttacgatgtcaatcggaccgtctatctcttttaaagatgaaacggctttgacacctagcgcctcatcaattgtagggttcacagggataatttcataacccgcgtcctgcattgcttttgaaaccatatgtgacgttctatccggacggtctgaaagccctactaccgctatacgtttgcttctttgaagaatctctttaatttccgctttagaagggttttgcatcgtgtgtcactcctttttcacttattttacacgatcaaaacaggagaaatcaaaatatgatgcatgtttgatttgatttgtaagcaaactttacaaaaaaacttatcatcagatcatgacatctcatgttaaaataaaaagaagggaatttgaaaaaggagaaatgtagatgttaattgctttattgattattttggcctacttgataggcagcattccatctggcttaattgtgggcaagcttgccaaaggaattgatattcgggagcacggaagcggcaacttaggcgctaccaatgcattccgtacattgggtgtaaaagctggttcggtcgtcatagccggagatattttgaaagggacactggcaactgcattgccttttctcatgcatgttgatattcacccgcttcttgcaggagtctttgcggttttaggccacgtgtttcccatcttcgccaaatttaaaggcggtaaagccgtggcgacatcaggaggcgttttgctattttacgcacccctgttatttatcacgatggttgcggtattcttcatctttttatacttgactaaatttgtttctctctcatcgatgttaacagggatctatactgttatatatagtttctttgtccatgatacgtatttattgattgtcgttaccctgctcactatttttgtgatatacagacaccgagcgaacattaaacgaattatcaataaaacagaacctaaagtaaaatggttataagcttaaaaaacttctcttttgacacagaatagcctaatacgtttataatagagaaaattcaaatgaagaacaaaggggtgttctgttatgaatatgacaattaacgaagacgcattgaactggtataaagaagaactcgatttggaaagcggagaccaggttcgctttttcgtccgctatggaggctgcagcaacgttcaaaagggtttttctctcggtgtagcgaaagatgccccacaagaggctggagtcactgcagaagctgatggcattaccttctttattgaagaaagtgatttatggtactttgataaccacgaccttctcgtcagctattcagaagacgctgatgaaccggtttttgaataccaataaaaaagaacgcacttcatgtgcgttctttttttacaaatgaaatcgtataagatgatcggttaggttttcttgttccaaaatatatttttgtgtttcccccagcagatcaaagtggggaaattcacttttcttatggatccattctttttttaacccgtacgccgctccccactgaaccagcttatcaatgtctgcacagccggcttttgtcacggtctttgcttctggaaatcggtcatccagccagtaatgtgttaaaaatgcgatttctcctcttttcactgcttgtttccaccggttaagttcctcccgtttcacaccaaacgccatatcccgttcacttccctattttttggccttttcatatgctgtgtgccaatcaggaaaagctttgcggaattgaattggcttaaagctttctttatccacacaaatatgagatgaggtggctttgatggaaagctcaccggccggattataaatgtggtaaccatagacggttttaaatccgttatagtcctctatccatgtatgtacaaccgcggtttctccgtaatgaagcggctttttataggaaatattgatatcaacgactggggacagaacgccttttttttccatatcactatataaaaagcctaagtccttaatcaaggccgttctgccgacctccatccacacaagataatttgcgtgatagacaatccccatttgatctgtttctgcataacgcacttctatttctttttttgatacatgcaagattactctgctcccttaacgtcaatttagccccattttaccataatcaaatcagaaagaaaaaaaccaggtttccctggttttttaagaacggtatccgttttgtctcgctgcagattcgtcctgtatttcattacgaaacgcttcaatgctctgttcgcgccttgcatttttttctttgatacgctgtttatcttctcctgaagcaaactccattgatgcttctgcttcttctatattttcaattgtattttgaaccatatcctgcaatttttccacattgtcagaacgatcatcaggattaggctgctgatattgattttggttctttgtcattcggatgtacctcctagaaataaactcgaattttcgctactcgccttttgtctgcatgataatcggccgctgtcctgaagtatcatgcattttttcccctttattggctttatattttacaggctttgtacccaagtggcttggagcatattgaggctgaccgtttttcttgttgtttcccatgtttatccctcctcaacagataggtttctcaaaaggaggggtaaacatgaatacaaattaaaggttatttttgcttaaatcgctgttcaagcttttcctcaagctgatttaaatactctgtattggtcatcagctcttttttgttttccatgacgagctcatgaaaagaacgttttctcatcttcttcacgcttctcacctccgcatattcttttattttttccaattctgaaaacttgtaagcatatttgagtataaaaaaaacctgaatctaatcaagatccagtttttgttccatttctttttttgtcatggtgccaacatgtatgtcttggataacacctttttcatctaagatatatgtcgttggatatgacatcacgttatagtcagcattgatcccttttttatcaatcagaatggggaacgttaagtcataagtatcagcaaacgctcggacctgtttctcacttttctcagctgaagtgaaatttaccgcaacaaccgcaagtttgtcggcgtactctttttgcagcttttccatcgcaggcatttcctgacggcacggcttacaccaagttgcccaaaaattgagcagcacttttttgccttttgcatcctgtaaagagcttttctctcctgatagcgttttcaaagaaaaatcaggtgcttgttgcccctcttgaattccgacttcttttttgctgtatgtttgatataaattccatcccgtataaccgactagcatgataagcaggatccctgcgagccattttttcagcatatgccacctccgcagcacattgtgtcataaaaagaagagaaagcgaaatgccttctcttcctattgattcatcaggactgcttcattttttcacgaagcaccatttgaaggatgccgccatggcggtagtaatcaatttcaacttcactatcaaagcggacgactgcttcaaaagttgttacattgccgtcttcattgattgctcttacagtcacaaggtcacgaggacgaactgtttcatcaacatctacctcgatgacttctttacccgttaagccgagtgtatccgcattttcaccttgtttaaactgaagcggcagcacacccatgaatacaagattgcttctgtgaattctttcgaagctctctgcaatgaccgttctgatgccgagaaggtttgttccttttgcagcccagtcacgtgaagatcccataccatagtcttttcctgctaatacgacaagaccggttttatcttctttgtatttcatgcatgcatcatagatggatgttacttcaccagtcggccagtacgtcgtaaatccgccttctgtacccggtgcgatttggtttttgatgcgaatgttggcaaatgttcctctcatcatgacttcatggtttccacggcgggagccgtaggagttaaagtcacgaggtgaaacacctttttcttgcaaatactttccggcaggcgtatcttttccgattgcccccgcaggagaaatatggtcagttgtgactgaatcgccgaatttaccgacaacacgcagtccttttaatggctcaaccttgcctggctcaacagacatctcttcaaagaatggtgggttttggatgtaagttgaatcgttatcccatttatataaagcttcatctgttgtttcaatttcgttccagcgcttgttgtcatcaaatactgtttcatactctttgcggaatagctctggcgtaacagtttgcttaacaagtgcattgatttcgtccattgacggccaaatatcattaaagtatacgttttgaccatccttgcccacaccgattggatcggtttttaagttaatgtttaccgttccagccagcgcatatgccacaacaagcggcggtgaagcaagatagttgcctttaacaagcgggtgaatacgtccttcaaagttacggtttccggaaaggacagacgtaatcagaagatcatttttcgcaaccgcttcttcgatttccggtgaaagcggacctgagttcccgatacatgttgtacagccgtacccaacgaggttaaagccaagctctttcatgtatggaagaaggcctgaattcacaagatatcctgtaacaactttagaacccggtgcaagtgacgttttcacgtaattaggcaccttaagccctaactcaaccgcttttttcgctaccagtccggcgccgatcagcacgtatgggtttgatgtatttgtacagcttgtaatcgcagcaatggcgatcgcacccgttttcataactgtttcttcgccgttaaggagtttaaacttaatttctttattttcttcctcagcatttaaaccgaatccttggttacctgcagggctgactaattgctttttaaacgtttcctgcatagcagatagcgggatcaaatcctgaggacgctttggacccgataagtttgcttcaatttgagacaggtcaatttcaaccacatcagtaaattgagggtcttccgcatctggagtgtagaacaagccattgcttctgcagtatgcttcaacaacatcaatatgttcaggatcacggccagtcaggcgcaggtagttaagcgcttcttcatctactgggaagaatccgcatgtagcaccgtattccggagccatattcgcaattgttgcgcgatctgcaagcggcagttcagcaattcccggtccgaagaattcaacaaatttaccgacaacgcctttttcacgcagcacttgtgttacttttaacgccaagtcagtagctgttgttccgtttggaagcttgccgacaagtttcgcgccgattacctctggaactgggaagtaagaaggctgtccaagcattcccgcttcagcttcaattccaccgacaccccagccgagaacaccgataccgttaatcattgttgtgtgtgagtctgttccgacaagcgtatcaggatacgttacaagctcgccgtcttcttcaatggcatggacaacacttgccaagaactcaaggttgacctggtgcacaatacctgttgcaggcggtactgcctgataattgttaaacgctttctttgcccagcttaaaaatttgtagcgctctgcatttctttcgaattccaagtccatatttactgctaatgcatcttctgtacccgctttatctacctgtacagagtgatcgataacgagatcaacaggaatttcagggttgattttatcaggatctccgccgacagctgccattgctttacgcagtgaagccagatctactactgccggaacccctgtgaagtcttgtaaaataacacgagacggtttgaacggaacgtcgatatcctttaattcggcagttccccattttgccaaattttccacgtgttcttttttgataacgaagccgtcaacttgacgcaatactgattctaaaagaactttgatggaataaggaagcttcgaaacctttcctatacctgaatcttctaacgcttttaaagagtagtaatgatatgttttcccatttgtagtaaacgtttttctcgcttggaaaacgtcttttgctgcagttttttgctcgtttgccattctccaaaatcccccttcagatcagatcattctcagatgaacattacattccatcacaattttctcacaatttcatattaaaacaaaatcatacataagtaaatatcaatgtttttattaaatacaataagttcgacttatgagaaaaatgtaccggtaatttttactgtttacgctctctcatataacacaataaaagaagccatattatgattgaggtgataatgatggtcaaaagaaaagcgaatcacgtcattaacggaatgaatgacgcaaaaagccaaggcaaaggcgccggctatattgaaaacgaccagcttgtactgactgaagcagaacgccaaaataacaaaaaagaaaaaccaatcaataacaccgaactcttttaaggaggttctcattttatgaccaataagaatacaagtgaagatatgcataaaaacgcccctaaaggacacaatcccggccaacccgagcctctaagcggaagcaaaaaagtaaaaaccgaaaccatacaagacaaaagcacaactcaagccatgatatgtaagaaaagcagaccttagtgtctgtttttttatgcgttcacccatttataatccaccgcatatgatgtaaagcaaggttgatatgtggaggaatgcttccatgaaccattcaaaacgcaacgatgcgaatgatttcgatagtatggatgaatggcttcggcaattttttgaagaccccttcgcctggtacgacgaaacattgcctattgatttatatgaaacaagtcagcagtatattatagaagcggatctgacttttttacagcctacacaagtaacagttaccctttctggatgcgagttcatcttaactgtcaaatcgtcaggacagacttttgaaaaacaaatgatgcttcctttttattttaatgacaaaaacattcaagtcgaatgcgaaaatcaaatactcacagtcgccgtcaataaagaaacagaagatggctcttctttttctcttcaatttcctctcagctaaacataaaaagtcactttcatcccctattatgaaagtgacttttttccgtccatttatcgtcaaataccctctagtgactctcccatggccaaatagcagattcactatacaatagaatatgatctactatctcttttgactagacgtctatcacttttttctattctttttttactgtgttcttctaatctctcttcgtatacaatatggttagaataagggggaatgattgatgctggaaggatggtttttatggtttattctgttttgggtaatcatgatggtagtcttattatcaatcggcggttttttcatgtttcgaaagtttttaaagcgtttaccaaaagaggacggcagatcagagcttgattggcaggattactatattgaaaacagcagacatttatggaacgatgaaaacaaacagtttctagatgaattgactgcgcccgtgccagagctgttcagagatgcagcaaaagctaaaatcgcaggcaaaatcggtgagcttgcattaaaagaaaaggtagcaaagattgatcagcaacttatgatcaaaggctatattctcgcaactcctaaaagagaccataccttcttaaaaaggcatctgcgggacaaaaaaatcgatttggaaccttatcagacccttctcaaataaaaaacctttcctgacaagaggaaaggttttttaattcatttgaatattagatgactgcagctcgttatgaagttttcgatatgataaatacatggcgattctccaaggcacaatcataccgaaagccagaatccaaaacattccgctcagtgcaccataatcaattgatgtgctcaagatcgatttcatcacgattctgatcaccaaaagaccgactaatataaaaacaaatgctttagagcgtttcatgtaaatttcattatttttaatttcgaacttagaagttttgattagaaaaatagagaaaatcacacctaaagtgaatgcttccaaaaactctgctccagttacccaaaataccggaaataaaaacattaacgctcccgtactcataaaaatcggcggaagaatgattttttttggtgaaacaggcttgtcagaggactttattctgaccaccatcacagctacagccattaacacagcaataattgatgaaactataatcatcatacttatcattcctttgtttctcggagtgttgatactatatactatactccaaaacaataaaaaaaaccattttgaaaagaaatgactttaatgtcccataacgcggcttacagcttccagcacttttgtttcctcaaacggcttaacaataaaatcctttgcccccagctcaattgcttccgttacaattctttgctggcgcatggcggtgcacatgatgaccttcgctttaggatcaaaggttaagatatcacgaagcgcttttatgccgtttttcaccggcattgtaatatccattgtcacaaggtccgggcgcagttttttatacaggtcagctgcttgttcaccgtccgccgcttcgcctgcgattatgtaatttgcctcttccaagatctctctgattttcactctcatgaacttggcgtcgtctacaactaaaactcttgtcatattcccctccaacaatcgatttccacagataatagtcttattgtaccaaaaacaaaaggattagtagtagtacgaaagtaatttaccgtcaaaaaccagtaaagcctccaaaaagatctgacagcaaaataatgatcaggctcatccaattaaagaataacagcacaccaatcacaatcatcaaaacgccaccagctttcataatgaaaagctggttcttccttatccacttcagctttgtgataaaaaaagacaataaaagaaacggtaccgcaaaaccgagtacatataacatcatgtatggcaccgctgagcccggattggtgcctgcaagtgtgataacagcagctaatatcggaccggtacatggtgtccatccagctgcaaatgccattccgattaagaccgaccctaaaaacccgcttggtttatgcttaaaatggattctccgctctttcatcatagcctcaggccggaacacaccgagtgtaatgaaaccgaacaaaataataagcaacgcgccaatttgccgaatcgcatcgtgataatccctaaacaggctgccaataaaagatgttccatagcctaaagcaataaaaatgactgaaaagccaagcaaaaaacacaaagtatgaaacaagcttcttttctgcagcagcagcttttcagtttttacatcgtccatgctgacccctgtaatatatgacaaaaaagctgggtaaagcggcaggcagcaaggcgaaataaaggataaaaaccccgctccgaatgtcaaaaaataattcacgtctcccatgtcatcatcccttcatgatttgacattccttcaagttatgacaaaatcatttcatttttttaacactttcacttgaaggatttctattttcagaaaaaacttatataatttaatttgacattgagacattatactccttctcatttgaaaattagtataaatatggatataatataaacattcactttgaagatctaatgtatgaaaggatacatccctgtgattagagagcatctattaaaagaaattgaaaaaaaaagagcagagctgctgcaaattgtcatggcgaacggaatgacatctcatattacgatagagctcagtcaggagcttgaccatcttctcatacaatatcaaaagcagcgccttcgagcagtagcgggtgatgaatgattgcaaaataaaaaacccgtataagggtttttattttataaccatgtttctctatatcataatctttacgtattatttcgtttgattattcatggctttcatcatttgattgattttcttttgagaaggtttcattcccatttgcatcatcatcatgcgtaacatttgttcattaataggcggattctttttcaggtagctcatcatatatttacgagcaataaaaaacccgagtgcaacacctatgagcaatgcaacaacgcccactaggatgccaacccataaagtcattttatttcctccttcatgttgtctagtttaaagtgtactaaaccaaaagctattatacaacatttacatctctttttcttcggttttagacaaaatttctttctttcaccggatttagccatccgtaacgcttcgaattgaaatccattgctaaaaagcaagggcttacttttcttaacacttcaaagaatatcgtttctgcctcgtaatctcccgaagccacaatttctatcatgtgctccttcatcataaacgtcgcgtggccttttgctttcggcaaagctattctataaatataatccagctgcctgtaatccgtcttgtttaaattcatttttaaccgctgatgcatatgtaaaatcgggattggttgtgtaatatattgaatctgtttctctgtcatttcatactgctgcttttcaaggcttgtccaatgatagtcttgaaacagctcaaacataaccgattcccggccgaaatagtgattggcaaattcctctttgatcaggtacgtatagtagtgacgttccatcttttcatccccttttccagcagcatttcatttgctctctattatacaaaagaagaaaagaaagaattgtctattactgttaaacagccaatactatttttgtcggataaacaagaaaaagaggatgatttgactcatcctctttcaaaagcttacttattgattaatgccttaactcgattcactacgttcggaactgagaagccgtattcgttaatgatggtttcaccaggagcagatgcaccgaatcggtctatgccgagaacgtcaccttcaagccccgtgtatttgccccatccaaatgatgagcccatttcaattgcaagacgttttttcacatctgcaggaaggacttcgtttttgtattcatcagattgtttctcaaaacggtccattgaaggcatgctgacaacagaaacatcgatattttcttttgccaattcagcctgcgcttcaattgcaagacctacctctgatccggaagcgatgagaagagcgtcaggtgtttcgtttttagatttagaaacgacatatgcacctttttctactcctgccaatgcttcttcagatgtttgatcgatggtaggaaggttttgacgtgtaagcactagcgctgttgggtggtcagtgctttgcactgcaagcttccatgctgctgctgtctcattgccgtctgctggacggatcaaagaaaggttaggcatcgcacggagtgaagcaagctgttcaacaggctcgtgcgtcggaccgtcttcaccaaccgcaatactgtcatgtgtgaagacatatgtcacaggaaggcccattaacgctgcaaggcgaatcgcaggacgcaggtaatcagagaagacaaagaaagttccgccgaatacacgaagaccgccatgaagcgccataccgtttaaggccgcacccatcgcaaattcacgtacaccaaaccagaagtttttgcctgagtaatcaaccgctgtaaaatcaccggcatttttaatagtcgttttgttcgatcccgctaggtcagcagaacctccgacaaagaaaggaatttttttcgcaagtccgttgagaacttcaccggaagatgcacgggatgccaaactgcttcctttttcatacacaggaacctcttgatcccagtccttcggaagctctcctttgattgccagttcaagctgttcagcaagttcaggataaacttctttatatttagcgaattgagcattccattcttgttcttttttctcacctgattctttaacagctacagcgaaatgctcataaacttctgacggaacgtagaagtcttcttcatatgtccacgcgtaagcttcttttgttaatttgctttcttctttaccaagcggcgcaccgtgaacaccggatgtaccggcacggttaggtgaaccgaatccgattgtcgttttcacttcaattaatgtaggtttcttttcattttggcgtgctttttcgatagccgctgttaattcttcaatattgtttccatcctcaacataaagaacttcccaattcattgcttcaaaacgctgtttcacgttttcagagaatgaacggtcgaggtctccatcaagagagatgtcattagaatcgtatagtacgatcagacggccaagctgaagatggcctgcgagtgaagcggcttcagaagaaataccttccattaaatcaccatcaccgcaaatactgtatgtataatgatcgactacgttaaatgaatcgcggttgtatgtttccgctaaatggcgttcagcaattgccataccgactgccatggcaattccttggccaagcggacctgttgtagcatcaacaccggcagtatgtccgaattccggatgtcctggtgttttgctgccccactggcggaatcccttaagatcttcaatactaagatcaaacccgcttaaatgaagcatgctgtataatagtgctgacccgtgtccagcagataaaacaaaacggtcacggttaaaccagccagggtttgccggacttacgttcataaattttgtccacagcgtgtatgccattggagcggctcccatcggcatccctgggtgaccagaatttgctttttcaatagcgtctattgacagtgtgcgaatggtagcaactgatttcttttcaattgtatccataaaaatccccttccttatgtgttgtacccttacatcataaatgtctgacgactttttctcaactgtttcagcttaaatttgagagaaacttgttgaattttgtcacataagagttttgattatagtatatgcaaaagaggaatacgatattgccgtattcctcttatattagtgaagtttgttatttctttgttctctttttagcttttctggtgtaacatcattgccttctgggtcaatgattttcacactttttaacgtgttcttcatagaagaacgaaaacctttcaagtactcttgacggagcttttgctgttcggctttttcttcttctgtaataacgccagctttagctttggcagcaagttcattaattctggcaattttcgcgtttgaaatcatgttaaactcctttattgcattttgtctatatagtactagatcaaaaaaagttttacaactgattcactctgcagtctcttcattctctatgtattcctgaaaacgccggtgaacggttgctttagagacatcatagccaaaccctcttagggtagccgcgatttcagcaaacgtcagtttattcgctctcaggcggacgatctctgagattggcacctctattttttcttttccactgttcccatgttggtttttaagttttttgcggtttaaaaccgtttttactgcacgtttcattccccgtctgattttcatgttgtgaatctttcgctgatactcttccacaatgctgacgatttccaagaccattgagtcagcctccgataactccagttcacctctatgagccgttgtatagactttcacaccttctctataaatacaatgaagcagtgcgatttttgcgtttccccgtccgagccttgtctcatcctgaaccaaaatgacatcaatatcagcgttcttaatctcatcgagcagctcaaatacaccatcccgatccatttcatatccgctggctttttctgaaatcactttgaccacttccatgccgttctccgctgcaatggccgtaagctcctcctcctgccgctttaatgacgtttcctgctgttctttatttgtgcttacacgggcataaatgagtgctttcattttatctctctttcctctctatcttacagttgctaattcatatgcatcctgatgcttctttttcaatgggatcactaactcatcacccggctggatatcagaggtttgaagttgatttttatcagctacccattcaataaaatcatttttgtttatcttttttgtatcggctacctgatcagcaattgaccagagtgtgtcgccttgctggacttctattttaacatactgattaagctcttggccgctgcttgtatatgacagcataaggataaccgcgctcaaaatcactgtaaacagaccgacaaaaataatagattctttactcatgatcataacctccaacaggaatgtttgttcgcatttttataatttcagtatatacgaacaaacgtttctgtcaattgttttttcgaacctatgtttgtactgtaaggaaaatcatgctataatcttcttaaaatcgacgttttgaggtgcgaaaaatgacgaagctatcaaaaaggcaacttgatatcctccgttttattaaagcagaggttaaatcaaaaggatatccgccttccgtgagagagatcggagaggctgtcgggcttgcgtccagttctactgtccacggccatttggcccgtttggaaacaaaagggctgatcagacgagatccgacaaaaccaagagcaatagaaattcttgatgaagaagtagacattccgcaaagccaggtcgttaatgtaccggtcatcgggaaagtcacggcgggatctcctattacagcagtagaaaatattgaagaatattttccgctccctgaccgcatggttcctccagacgagcatgtatttatgctggagattatgggagacagtatgatagatgctggtattctcgataaggactatgtcatcgttaaacagcaaaacacagcgaacaatggggaaattgtagttgcgatgacagaagatgatgaagcaactgtaaaacgattctataaagaggatacccacattcgcttgcagcctgagaacccaacgatggaacctatcattttgcagaatgtcagcattctagggaaagtgattggcgtgttcagaaccgtccattaatctattgatctatcagatgcataaaataaccccctcttcctttacggagagggggtttgttgttcaaaaaaagcaggctcgccctgacttttgggtgcgagcccgaataggaggaaaaagaacatcatgtttacaccataattatccaccaaaagattgttgaagtcaagaaattttctttcctttaggaaacttttatcaaaatatgaacatttagaatattagacgccatcttcttaaaaacgtttcattttttaggtcgtggaaggatgcggttttatatttattaaggggcaaagcaattgaaatatactgaaaatttagtacatagtttaattagttcaacatttgataaaacagctcgctttcttcatataaaatgtaatgtaatgtgtatttcaatttcaccttcacccaatcacttgtgcagttcaaaagatatggcatcgttgaacaagtcgggtagaaaccttccccaaacataaagtctccaccaacacccttctttaaatttaaccttatatgaaatatggttgtgctatcaaaaggccgtttcatcataaaagtgcatatgcgttttttcttgtttgtaatatcgaagcctgtcttgaagggttccggtatgaaattcaaatttgtggccgtcagggtcggtaaaataaattgattttcgatcgcgttcatctcgttctctgccaggcagaatattgacatgaagtctttttaatttagctgacatctcctcaaattcatgatcttcaattgtaaaagcaatatgggtataagaaagcttaatgtcatttctcgggatgtctggttcttcattaagcgctagccagatgccgttcatatcaaaatatgcagttgttcttccctttaccaaaagctttgcaccaaacactttttgataaaaatcaatcgatgtatccaaatgcgaaactgaaaatagcaagtgattgattccttttatctccacaaatcattccccccttgaaagctgatcatccacatatacgacttttttcataagaaagtttcatacagctgaaaaaaataccagtgtaaacaaaaacggactgtttaaaatagtaacatgaccattatgaatggttttgaattgcattatttatcatttgtttacgcccaagaattttcttcaaaaaataacaatttaggtggtcaaatgaaacatatcattgcgcttgcttcaaagattgctttcactctcgcccttttatatgtgattttggacagagtctatcacgcatcctttttaagtgtgatgtttattgcacttttcttaggttttgtttcctatctttctggtgacatgctcgtcttacccagaacaaacaatattacagcttcattggctgactttggcctttcattcgttattctttgggtatttgttttaacccaaacaagaaacgatttctcaccatttggagcggctctcctttccgctgcctgtcttactgtttttgaatacttttttcatcggtatttactgaaaaatgtgcttgatgaaaatttccgaaatgaactgtcagcgagagataacacgttgcagtatcaaacggaagccgcggacgagctgtttcccgaaacgaaagagaagcataaggaataggaggctgtcttatcgcctcctatttttcagtagctatttttgagaaaacggaacatcacttctgtaaactcataaaacctctcattttgagtaacagctctgctttttaaagaaaagatgccgaacaaagactttcgaaaccctgtgctcatttctatctgaatacttaaacctgtttttgatttatttgcaatgttattcggactaacgcccgcatgcggatggtccatattgagcaatacagcaggaaaaccggcatgctgcaatttctcaactaaatctgccgctcttacgcgatctgtaccgccgacttcgatctgctgatcttcttctgcgtacccgtgtaatgaaatgacatattcatgatttcccgtcattttaagggcccgaggttcatcaaagtgtgtgctcgtaatgtgcaggactgagtttcctgccgattttaagccttcaaataaatacatcgagtactctttgctgagctctctcgctacttcacttgtcccgccttcaatacctcctccgtgaatagctaaaacaagaacagggcttccggtttctttcgtaacaacgccataatcagaaggatcttcattgttttttaattcctcaaaattctgatatacatcttcagcataaattgaagaaatcggagtaaacaccataaaaatcatcaataattttacaattttaatagttgatggaaaacgtttggctatgttacaatcaacatgcttcaaggaatggagcaaacggcggagcagggatactttggccggtttcatctactccgcctctaagtccaaatcaacagaatgtaggtctctttgaggctttagcacgaattctctcgtcctccttgttaaatttttgttaaattcacaatattatataccattagcccgggcgctgttcttctcatttttgaatttatgaaaagtaagctggcaccacctcccccattttccatacaaaacaaaaatgcacctgccctttggcctgtgcactttttattttctcttcattcttcgtttttttgcttgatttaatttcatgatgtttttttcaatttttcttatgtttcgcctttgcgggattgttttcatttcataataaacagaaataaacccgcttactgtcactgctgcaatataaaggacgcgctgtttgatcatccggtcagcatgtccatgatcattcgcttctttttccagtctttcgatcacagctttatcaaacagctgatcgacatacacttgtttcattcccactgcaaacccagcagccagccaaagaatcagaaataaactgatataaaacaccataaacccttcctttcctgtcttgatgcggtgcagaattttaaaacagttcatctcattacaactggcagacgaagcttcttctttgtgttaggttctttcaataggctggttaatatgtgtaatgctgtaatgaacagttagaaattttattccaaacagccacatatgatgaacagcggttaatttgttgtcatgtacagcttctatcagaaaggtttcagataaaggaagcggacaagttcccgctcttgtttgcagataaatcccctcatcccccgctctgctttttctccgcctgcttgttaaaaccagcttctcctgatgatgatatggttttaaaatacctgtcatgctgctgaatggaagcggtaaagaaatattcatatacccctctccatttgaacgatacactgaataaagagcggtaaaaatggtttcgtttttttcatttgttctaatccaggcacgtactctttcccttccgtcttttttcgaatgaacaccttttatcttgctgtacatcctataccagtcagggttcgtcgaaagatgtatttggccgattcttctgctgaaccattcgtaaataattgcaagcggccgaaaccacgtgctccatgttacttttgctttaatattgtattcgatggtttgttcataaaacgaaagaatgagcggcgccagtttttctggtgaaaaatcttttgaacgcaggctgcccatatcatccacaagtccgctgtaccgagcgttattttcagcttgaatgttagctaaaaattcttctccaatctttctttttccgtagatacggctgaatgtctttacactgtctgcatcaaaaggtttcgcatcctctattctccaccctatgagagcgggcaagataacaccaaacgcgttgacaaaaccgtgaatccaaatcatctgattgatggtcaatgtaacttcttgccgaaagacaccaaatgaataaatcatcgagaaagcaatcgttatcattaaaacagcggaagaaagccgaataagaaatgtccccgtcttggtgcgaaaagctgccgtgaacaccaaaaatgcatgaagataaatcgccgccatataaatgctaaccgcaatgacatcaagtgtttttgaatatgtgatgcccagtgcgataagaaggggcgaaagcaaaatcacccatgttatccaactgtacaacatccgatgttttctaatggttctgccgagtaaaccgttgaagatcgggatcagaaaagcagaatagtgaaagtggacagcagtcagcaaaatgatgagagggccaaattgcatgatctgcaaatgggcagcataagcaaaaaaccaaaatcctcctcccgccaaataaataagaccgaacaaaactgatgtctcttcgattctatgtatctttgtttcccaaaggcggaggatcgcatacaatgcattaaaaactgtgtacatccaccagataagtgcgaaacccccaacctccgtcactagagccagcaccgcaaagaatgcggctacaggatagcactggattagcccgttttccataaactgagcagcacgaaccggagattgacgaaaaacaaaaggaaaaattcccggcacgaaaaatagaatggataacaaaacgagtgcctctgccactgaaatatccggtgcttctgctgcaagaaatccaataaaacaaagcgcactgactatgccatttcgtttcatgattctctctcttcctcctgaaacgttcccttataaaagaaaagagtgccaagaattgtattttgcacatgcacttcaatggtgaaacaattctttttttcatcaaacgtttcgcaaacttcggatgtaccggtcagccatttcggcagcgggattctttttccgcatatcaatagccattgctttcccgatgtgatcgtaagagagccgtcaagagatgcctcgaacgtcaaaacagacagcagcagatgaggtttgccgaagaaatcaagtattctattttctttctcgtcatatatcattaacgcatcaaagaaacgttttttgcctttaaagaaaaatgtacgattccattctattcctgtatgttgcgatttcaaaagacaagttctattttgtattgtaaatggaatgtctttgcctctttctgaaaagaagcatctgaaaaaaacacccagctttaacagcattctaaccagaaaagagcctccgcttatttctgacatcgttcccgtcccgctgaatgtatgagacccgtctaattggtaccgtttctgcagcttgggatgcagcaaatgatagttaataattgatttttcataaatcgaactcacaatgtcacttctttctctttcgttttgtgcgcctggcactggggagctgcaggctaagagcgccgcttgcagcggaaaacacactcaatagaacccacatgaatatttcggaacctagacaagcaaacccagcaaaaatacaagcctggacaccatgaatgatccattttctttttaaaggaagcagccacaaaatagctaagcctatctccgctgttcctgtcaatatgcttgtcttaacacctgcaaagccttgatagaaccaaaacaggctgaaaaacagacacatgaacacatagatgatagcagatcgaatgaagcgcttcggatgtttattttgctctacccaaagccttaatgcatcaaagctccaggcagtcgcccagccaagcagcggccgaaataataaacgatcaatccatcttcccagcagtccgtaggctgttttgtattggtactgtgttaaaaacgtcattttcccattttctctctgtatatacttccagtagccgcttccatgccgaatcagagataatggatgatcagagccaaaagccagtgaagaagacctttcagatgaacatttgttgaaaacaccgacggtttctcctgtacctgacacctttaatccaaagcctacccttgtttcgtaaagaaacttctgtttttcgcatggctgactattcaaatacgtaatatttgaaaaccggagatcccattccttatgcagtgatgggttttgtgtatattcccagagtgtatccagatcagatttcatttcgatttctacataaatcggtttctgcctcacagccccttctcccttctatttcaagcaattcctatattagcatattggtcgatttgaaaagtgtatatctctccaaaaaaagtatctttatcctaataaatgcataaaaaagagaagagaggtttccttctcttccttgggattcattactgagttttaaccgtgccgaaatgagtaattgtgacgttcacactgtatgtgatgtcggctttactgaaggtgtcatcccagttatttttcacccttttccataagtgaggatatgtaagtctaaaagattcatcaaaacccgcaacatctgctttataatcatgctgaattttttttaatacctgaccaactattttctttacctcgttttcaatagtcgtttcgagacgatctataaactgggtgtccaacgcctcttttgtgttccagttttcaaccaaatcgccttctgattcaatatcgacatggaatgaaatatctttcccttttacgattggctgaattctgcttttgattttattgatatcgtacgctaacgtctgttggctctttttatcatgacttttgacaactccgcctttcccttctcctctaatccatgtaatcccctcagtttcatattcatttaaggtgcctatcatttttttcgattttccgttgattacagctgctccggaatacttgaccgctccattcgccgcaaccacattttgcagtaaaaagctgctgccagaatgcagttttccaattagtttcgcgagtgtcatagggggaagaattctggaaactttatgttcattttcacctaatccaatcagccgaaatgccggaatttctccgttctctttcagctggagagcgtctcttgcttcccctttagcagataaaacaagacagctcagcctgatttcattatcacgaaaaaattgatccagcatttcgtcgataggaaatgtgtgcagcacatcttcactcatgacaacaacttttaaatgcgggctaaacacttctcggtcccgtcttaatgcaacctcacttccgatctgctgtaatgaatcccctgtttcacttatattaatgtacgctttttgcgctccttgtccgctaccgcctcccccgcttgtgcccgcgcctgccgctttttcattaacaaattgataggtcagcgtaatgttgtcttttttcggatagctcccgccctcttcttttaactctttttcagtgttcgtttcttttcctttatcaattgcgatagcgaatgtgagacccagatcttctatttcccgactgctccagcatcctgttacgcaaatcatcagcagacatactatgaccatagcaggcaattgacgttttagtttacttttcacctcttttcctccatttcgaaatgactaacagcaaaatcggcaaagcgccaaatatatacaaagcgatatgactgaccgtatcgcccaatataaagacgtcattttcatttttcggcatgcaagagaggatatatataacaggaagcagcccaaacatacatgaaaggggtttctttttaaaaacttgtgagactcccagggaagctgcataaaaagtgataataaacgtggcaaaaagctgcataatccaaatcacaagcagaaatgattcaaaccgttcaaatattaaaccaggtatttcaaaacttctcatcaggtcaagccccggccatgttctcgtcacaactccctcaactgatagtgcaccgatgaccataatcatcgtaatcatataaaaactggtcacaacgcctgtcccgatcacaactgctttcaccgcatttttcggctttttcataaatgctactaaaatgaacataatttctgaacatgtaaatgaaaggttcgttgtctttacacctctaagaaccggcatgattccatcacctaatacagggcgcaaattgttgatctcaaatatgcctaaactcatgagggctatcgttaaaaagatgatgaccgtaatcggaaaaatcatttcaaaaagccgtgcaatcggatctaggccttgtgtaattgaataaagcccaatccaaagaactgtcataatgatggcccaagaaggtgtcccttcgaggagaaaaaaatccacgatttcggacatgactctgacttcaaatgcaccgagtgccagaaaataagtaataaaaacaatactgatcagatgcccgagccattttcctacaatatgtcgggagtattcataaaaggtctccttaggatactgctggcttaatttagctataatcatcccggctattaccgctaggaccccgcctaataaaactgaaatccatccatcaggagattgtgtttgttctgttactgtccgagggagcgtaagaactccggcagcaagcatataattaatgatgataatcgttgcctgagcggttgtgattttactggttgggctgaacatgagactttatcaccatcctgtcgagttcatcacttcacccgttttgtattatctgtattcatcattttaggccggcgcttcatgactaaaagaggcattctgataacaaagtctttccaatcttttaagtgatagggcactgccggacttgcgtatggcacaccaaagctctttagctttacgacatggctgcttagcagcagataatacataatgactccaaacaatccaaacaccgccgcacaaaacatcgcgccaaaccgaagcatccgaagtgctatacctgtgctataatgcgggatggcaaatgaagaaattgctgtgagcgcaacaacaatgaccatgattggactgacaatccccgcctgcacagctgcttccccgatgattaatccgccaactatgcctattgcgggtccaattggttttggcaaacgaagccccgcctctcttaaaatttcaatcgcgacttccataaataaggcttcaatcagagatgggaacggaacaccttggcgcgtcccggaaattgaaatcgccagcttggtcggaattaacccaggatgaaaagaaataaatgatatatataaagcgggtgcgaataacgttatcattgctgcgatgaacctcagcaatctgatgagcgagctcgggaaccaccgttcataataatcttcaggcgattgaagcatcatgctgaaagtgactggaacaatcaaagcaaacggagtgccgtcaagcagaatagctactcttccttccattaatccgcttatgacgcgatcaggacgttctgtactctgtacttgcgggaacgggctcaaataattatcctcaattaactgttcaacgtagcctgactccggcaaatgatcgatctcaatccctctcactctttttcttacttcctcgactacttttggatctgcaatgtcattcatataagcgataattaaatccttttttaatcgtgttcctacttcaaatctctgcaatgttaattgatcattttttccttgctgtctcaaaagagctgtattcgtactcaactcttctgtaaagcctgtgcgcggccctctgacaagcgcttctgaaagcggctcctcgatacttcgattttgtttttttacagttcccagaagaaaggcctgcggtattccatcgatgagaagcgctgtcgaacccatgaaaacattcaacacgatatcactgattttctctgaatctatgacatcaccgattgatacgatttgattttttatctgtttcgaagttaaaatacctttgccggattgagaaatttcatcgcttacctgattaggttgattcatgactaacactgatagtcctttattaatcaagtcctgatcagacagtccttcaacaaagatcaatgccgctttcacatgtaattgagtgatttcaagctcacggaaatgaacgtccccgttatgtcctatttttctttttacatgttctaagtcgtatccgatgttaccggttaacacatcctgatcctgcttttcagctgtcgaataatctgatttatgctgcttctgtgttttgtactgattgttccgccacctcatcattgcaccttcttatacatgaatccaagtaaacactttatagattacatatggaacgagaaatactactaacgcttgaaaccacacattccagtcagtaagtgttgatatcatgttatccatctgtcagttcccctctctctaataggattatttttcccgtatacctattttttatgttcgtcttttttctcaataaaaaagcatgatgaacatttcatcatgcttttaaagaaatcaacctgaccattttgcataattaacacaaaatgagccttttagcagtctgggaaaactaaaattccagcttgaagctttctgcctgatctgaaacttccacaggaatccccattatcgttttcggtttggaaacgtaaacaaagcgcatttcttcctctaattgctgaaacgctttttcactaactaaaattctggccggcttccctggactattatcaatggctgctttgatttttccaagcataaaaaacctcctgttttagaaaatggctcatttactattaaaacaaaaatcgcaaaataaattggctgaacaggaatcccagttcaaacataacagttgcggctgcaaacaagaatgaacgaaatgacaacatacacctctctctctttttcgcgcatgcagaattctcccattcacagatcagactggcgactgacacgctgttcaacagcagctctagcataaataatgcacgctatggacatgatcttattagttattatatgattgaattgaaaaaacatcatatgtcaagaggtaaacgaaatggctcaaaacaacgaaaatgcattaccggatattacaaaaagcattactctggaggctcccattcagaaagtctgggagacagtctctacttcagaaggcattgccaagtggtttatgcccaatgactttcagctcaaagaaggacaagaatttcacttacaatcgccgtttgggccgtccccttgtaaagttttggctgttcaagctccaactgaactttcttttgaatgggatacagaaggatgggtcgttacctttcaattagaagacttgggggaaaagacagggtttacccttattcacagcggctggaaagagccgaatgaagtgatcggcaaagcaaacgagaaaagctccgtcgttcgcggtaagatggatggcggctggactggcattgtaaatgaacggcttcgtaaggctgtcgaagaataaaaaagagagaggtatctctcttttttgttttttccaagggttatacttcacaatttgagtccatcaatcataaaacgtaacagttttagatttaccagagtaatcggtaacaaagaactcggccttgttattgctcccatctacaaattttccaatactgccaaaggtgtggcattctccgggtgaaaaatagtttgcccctacataatcatcaggattgtcaccgggatcatcctcatataagtgcagtgaaacagaaaaaggagtgcttcctgaaaggcacactctaaaatctcctccggtcgagtataccgtcggacttgagtaagtatatgtgtaagtccccaacttatcccactctccagcccccgcagttccggctttttctgcttgtgccgttaatggaaaaaccgcagccaaccctaaaacagacaaaaatccaactaccttagtgaatctcatcagctacaccactcctctatgtcaatgatagccgctacgtttgtatcatttccggcagagctacataattgatccagcctgcctcctgcttcttaggcaggtggcattggacattatattcagcagcagccgttttatgaatccgtctttgtgctggttttaaaatgttcaaaataaatgcattcccatttgtactgctatctcttataatttgtttaaaaggttgtacttcaatcagggggaaaaggatatggaattaagcttcacaaaaatactcgttattttgtttgtgggttttttagtatttgggcctgataaactgccggcgcttggccgtgcagcaggaaaagccttatcagaatttaaacaagcaacaagcggactgactcaggatatcagaaaaaatgactcagaaaacaaagaagacaaacaaatgtaggataaatcgtttgggccgatgaaaaatcggctctttattttgatttgtttttgtgtcatctgtctttttctatcatttggacagcccttttttccttctatgattttaactgtccaagccgcaaaatctactcgccgtataataaagcgtagtaaaaataaaggaggagtatatatgggttattacaaaaaatacaaagaagagtattatacggtcaaaaaaacgtattataagaagtattacgaatatgataaaaaagattatgactgtgattacgacaaaaaatatgatgactatgataaaaaatattatgatcacgataaaaaagactatgattatgttgtagagtataaaaagcataaaaaacactactaaacgccattaacatctcctcgtttttactttcccccggctattgccgggtcttttttgtttgtgcactatatgtatatttctgaagcttccctttctatgaaaaccttggtgactgaatctgaaaaagaatagtgaatatttagtacatagtttagttagttcataagtgagcgcattcaatttattgcagttacaaagaaacttttataaactctttgaggatcctacataaaaggagaggttttttgtatagaaacatcgtattttatctcattttactttgtctatttatatcagttgtcatgaaaagctttgaggtgattagaacaatagccaatgttatctgctttattttcgtattgctgtattttaaagatgaaatgaaaacatactcacgtaaagcgttagcaatcctaagtatttgttttcttttcttagtcggtatctgtgcttttatcattttacaaggacagacattgatgaaacgtcacctcttttttacaggcttggaaacgatagcgggcattcttttaataatcgtttctttaagcatttgtacttttattttgaggaaaatttcaaatcggttaaaacgaatgtgatctcattctttcctctgataaaggtatatagctttcagattggcgaagcgtttcgaccttacatcattcaaaatgaaatattttgtcgatttatatacgtaaatccagttccaaaataaggtataataaatggcgaaaccactatcaaaagggggaattttggtgaaaaaagtattgattgcaggtgcagtaggaacagcagttcttttcggaaccctttcatcaggtataccaggtttacccgcggcagacgctcaagtcgcaaaagcagcatccgagctgcctaacggaatcggcggccgtgtctacctgaacagtacgggcgccgtttttacagctaaaatcgtgcttcctgaaactgtcaaaaacaacgactcggtctctactccctatatttattctggctttagggcaacaagcggaactgaagccgatatcgggcttcagtacagcaaacaatacaacgtctggaagcccctcatgaaggttgggtccaaaaatgaagaaacgtacatcgaaggaaaagacaaattcacatacaataaaggcttccgccctggaagcacagtccaaatgacaatctataaaaatttaagcggcaatacgcgcatgaccctttggggaacgaacaatgacggctacaccggacggattatcacagaaattcaaggaaccaacatcggcacgatttcaaaatggaaaacacttgctaccgcggctgtttcgtatgaaagccagcgtgatgcgatcaaagcaaccttttcgacctcttttaacaacatcactatcgacaataaagccgtcactcctgtggtagatacacaggatttcgcaaaggtttcagttgcaggaaataacgttacgatctctgttaataaataaacgaagcagcaaaaagccgccagcattgtctggcggttttccttggagcatactggtcatagttcgtttcttcagctcttttgtttaaacctaactttaataagggtggaaattggtatgaaatatgaaaaaacaagtctttttggaatgattttagttattgtagcacttctaatatctatatattttatgtgtaatacaaatgcgttgatacctgctggatatgatctagctattcatggaattgtaatatctagaactgtaatgattgcttttactttgtatttagtttcaaagttaggatattttcttctgaataaaaaagattaactgtagagttaatcttttttatgtattatacgtgtttgtccttcaatttttattcatcttccagattgcttaatgaaattaggatacctgctatctattcactgcacaataaaaaggcagcattaaaccgctacctcaaataaaagcttgtccccatgtttatagttgattaacttgaaatcatcaatggtaaagtcataaaaatctttcacttcaggattgatccatagttcaggtgcttcaaactgttctctttccatttgaattttcaaattgtctatatgacgtgtgtacacatggcaatccccaatgttaaagatatattcaccaagctcataaccagtcacttgagcaatcatgcgctgcaacacattatactggaatacattgaatggatttcccaatgccatatcattgctccgtgctcttacctcaaggtggagtttcccatgtttaacgtaccattgtgtctcgtatacacatggcgttaaggccattgcgtctaattcatcaggattccacagcattgtaatgtgtctgcgtgaagatggattgttcttcaattgatgaagaagatagtctacctgatccactttttctccatttagacttctgtttttcttccccagctgaaatccatatgcatgtccgatggttccgtcttcttgtttccactgatcccaaatatggacgcccatcatgtttaaatcattaacatcattagatttcagctgccaaatccagagcaactctttaatggctgttttccaggcaaccttttttgtcgttaaaatcggaacctctgagttgtcgaatctcatttgcttactgattacacttagagtatgtgccggtgttccatctgagtcccacttggttcttacatcaaactcttcgtctgagattccattattgataatatcctttataattgaattgtattgtttatcgaattgcgtcatgactattcatatccttctttcattttcagttgctaagcataatttattacgaatgcaatattatcgcaaatactaagcacttgcagataaagtgaggatcttattccactcactgtgtgtttaaagaggagttaatccccctcttttacacctgtatttctccataacatagtctgtcacatagctcatagttaccgccagtttggtacatacaccgttgataacattgttgaggattatacgaaatggtttgatattgcggtacataaaaattcaaatagtcaggtgtttgtgtataccaaattggaaattgtctaaacacattaaatcctccaatagctttttctgatttaatgcattgtattttacctcaatatcaattgtcatttgtccatgtgcaattgggctttctttaaaataaattctctctaatttcattcatttgatcattaacaacttttttatgatatttggcagcggttcattccttatatgatctgtttctagccggttttgctgtttgtttttgatgtctaactctaaatccttcaaaagcagtgtgaaaaatcacatcatagagctcttgaatcttaaccataacgttcaaatattcttcaatgagaaagtccctttttacgtatactaatctctctatacactttactattattttacagtgattgagtgctctctctctctcttattttcataaacagctatccgttttgtttttcagaaagtgttttaaacagcctctttttactattcttatttcatttgaccataccatatcatttaaacttcataaattaaattcgaataacataaaggaggaatttaattgggttattataaaaaatataaagaagagtattatacttggaaaaaaacatattacaaaaagtattacgacaatgataagaagcattatgattgcgacaagtattatgatcatgataaaaaacattatgattacgacaaaaagtatgatgaccatgataaaaagtattacgatgatcacgattatcattacgaaaaaaagtattatgatgacgatgatcattattatgattttgtcgaatcatataaaaaacatcactaaatctcttaaacgtctatttattccctggcgacataccgggggcttttttatgatatttatcgacgaactcagatttttttgtgctcatggctgctgtaaaattcaattattaatgaacacaagtcatttaacttggcttattattagtggcattactagtttttagttgccttcccctatttataaaaatttagataaaagtatttctttatagagatgcttgtttcatcgacaactcaatcctaaatgtggtaaaatcgataaaaatgtaaaaactgtaaatataataaaaggagcatctttatgtatataagtattataattttagcatccatgcttttatggggggcagttatccacgagctaagtaaaccttcaaaaaagcaaagcaccagaaaaattgtttctttgacatctttaggttctttatcgactttagttattactatttcactttttcaaaacttccctttttaaactttgtttttaattaaatccttcgtattaaaatattcattttatacataatatttatatgtaccttggctgaaacctccattgatcaatcacacagcatgaagacagccaaggatttattttgtttacttcgtacctgttgaaccgagtcctcctctatcctcgtttcccaaatgctcgacttcaaccaattcaaccgccggcattttcttcatgattctaaactggcagatacgatcacccttcttaatttcagtatcacgcaatgcataagcaggaaagaaccagaaatcgttgtctcccttatatgactcatcgataacacccattgaatttgtttgaataacgccaaagttcttatatgtacttgaacgagggacgacatgtgcttcgtaaccttcaggcagctccattgcaacacctaatgggacaagcttaaattcatcttttttgattgttacatcttcagctgcccgaagatcaatccagtctccctgctcaattttgctgattcttgtttgtgtttcatctagatacttgattttaatttgcattgtcatgtactagctcctttaatttttattgagtatcatacagtaaggcttgttcttgtgtcattttcatcagttataaattgaacgtcttcaaaatcatgctgtaaagcattgaagtaaagtttttcaatgatatttttgtttttacagtaaatcgaaacgtagctattatctgctatcaaaaggacaagttcgcaatcactgtcagcaaactcttcatatgtattgacttgattaaccatttttccatatggaaatgctttcagttcaacgaaaatggtatagtactgattcgtttttaattgttgctcaaaaactgccccctcaacaatttcgtagtcatgaaaaagctcctcatcatcgagctctccttctacaacaaaataagattccccactcgtttgccacctataattagctatttctaccggctgcagtattctccatagaaaatttccatattcattcggtatttgaaaactaactcccctattcatgtataccccttacttaaacgatttttgtgaatacgagtataattatatactctgatgttaggtttatggaacaaggaatcgactgccttttcaaccgattatcttttacagaatttcctcagcccttctcatttaaaaggttcttcaatgttcataacaacggtaagtatttcctgattagatttctcgttatcatctacccttagaaaaaaatgtcccaaaacaaataatcatttttgtaatcctcggtcgccgcatccattaacaccccacttacaagcctcatgtatcccgtacttgctattattcgaacattgataggcaccttctcgtatcacatggatttgctgttgaatgatttcaaataaagttgaataaaataagatcgaatcatccaacaattaacatttattcttgcggcaataggtggtatttataatccataagaaggaaggaagcgttgatgataaagctttgccgagaagtttggatcgaagtcaatcttgatgccgttaaaaagaatttgcgagcgatccgccgtcatattccacataagagcaaaattatggctgttgtaaaagcgaacggttatggccacgggtctatagaagtggcacgccatgcactggaacacggggcgagtgagctcgctgttgccagtgtggaggaaggaatcgttttacgtaaagctgggattacagcacctatccttgtgcttggttttacatcccttagttgtgtaaagaagtcagcagcttggaatataacattatcagcatttcaggttgattggatgaaagaagcaaacgagatattggaaaaagaagcgagtgctaaccggctggccattcatattaacgtggataccggcatgggacgattaggtgtacgcacaaaggaagaacttttagaggtagtgaaagccttaaaggcaagtaaattcctcagatggacagggattttcacacatttttcgacagctgatgaaccggacacaacactcacaaagctgcagcatgaaaaattcatcagttttctcagctttttaaaaaaacaggggattgagctgcccaccgtgcatatgtgcaacacggctgcagctatcgcatttccggaatttagcgctgatatgatccgtttaggtatcggcttatatggtttatatccttcagcctatattaaacaactaaatctcgttaagcttgaacctgcgttaagtttaaaggcacgcatcgcttatgtgaaaaccatgcggacagaaccccgaaccgttagctatggtgctacatacatcgcagaacctaatgaagtaattgctacactcccgattggctatgctgacggctattctcgtgccctttccaatcgcgggtttgttcttcatcgcggaaaacgagtgccagtggcgggaagagtaacaatggatatgatcatggtcagtttaggagaaaacggtgaaggtaaacaaggagatgaagtcgtgatttacggtaagcaaaaaggagccgagatttccgttgatgaagtggctgaaatgctcaatacgattaactatgaagtcgtgtctacattaagccgccgcatccctcgtttttatataagagatggcgagatttttaaagtatcaactccagtattatacgtgtagaacatcttaaaatgctgaatcaaaatccctctaccagagggattttgttttttctgaaactaaaaaaatccctcctataagaagagagattttcaacatatttatacctcaataactgattgttcaggagtattatgatcgtgtcgagaacgaaaatgctcttctaattcttcaagtgtacgcccttttgtttccggcatgaatttgtacacaaaaccgattgccaatacacctaaagccacaaatataaagaatgtaaaagacaaacctacagagctaagcaagatcgggaaagcaaaaccgatcacaaagtttaatatccaaaggaaaaaaacacttatcccagaaccaagtcctcttaacctttgagggaatatttccgctatgacaagccaagtcacaggtcctacacacccttgcataaaggcaagaaataaaacggtcaaagaaagcactacataaggaagtgccatagatccatcaagcacaattgagaaaatcgcaatcaataggagcgctgtagtcgtccctgccaaaccaatcaataatattggacgccgtctcacttttccgaccagccaaatcccaaatataactgcaataactgatatcagcccatttccaatattagcgattaaagccgcttttgtaccaaaaccagattctttaaggatttgtgtgccataatacataatcgagttcacacctgtaatttgattcacgatggcaacaccgattccaatccataaaagacggcgcagccatggtgtagaaaagtccttgagtgatgccttttctagtgctgtatctttttctaccgcttcttgaatttctctacattcagcttctgcacgtttatcttctcgaatttgtttaagaactcgcagcgcctcactgtttttgcctttggagattagccatcgggggctttctggtaccttaagcatactggcaaataacatgatagccggtacagcacaaatgactagcatgtatctccaaacatgtcccgtatttgccattgttacaccgaggatcgcattaaaaacatatgctaaaaattgcccgccaacaatcattagttcattttgggttaccatacgccctctcttttcatgcggtgccatttctgctaaaaaggccggcaccatcgccgaggctcctccaacagccagccccagtaaaaaacgaaagaccgccatgatgaaaacattaggtgctaacgctgttcccagtgatgccaggaaaaataaaaaggaaagattaaggatcattttacggcggccatatcgatcagccaatcttccgcataacaacgctccaaacgcggcacctaataaaagaatactcgtaacaagcccttctgtaacaggtgttaaatcaagctgatctggccttgccataaaaggtaaagctccatttataactccggtgtcatatccaaagagaagccctccaaaagttgctgaaatcattattaatttcaaccttcgatttcgatgttcattcatatccatttcccctgcctttaagaatacttaataagctctttcagtgtggatattgagtcaaaactaaagtcatctctatcttagattttcgcctctggatttgtaaccgtttacatttttaaccaatagaataaacctaagctattagttgttatgttgtagtaatgtctttgtcacattattgtcatttctcatattatcataattctaaaagcattttcagtcaatattattttcaggattatttatttccgctatgtgatggtgatgttttgatcatctcgttgtgaagttaactattggcaatttggagtgttataagttcccttgaagttttccattcacaaaaaatgtccatatcgttataatgatgatgtttaatcgcgaaaagagaaaatgataaagagggaatcaatatgaagaagattttgatcagtatgatcgcaatcgttttaagtattactttggcagcttgcggatcaaatcacgcagccaaaaaccattcagattctaatgggacggagcaagtctctcaagatactcactctaatgaatataatcagacagaacaaaaggctggcacgcctcattcaaaaaatcagaagaaattggtcaatgttacattagatagagcaatagatggagatacgattaaggttatttacaacggaaagaaagacacagttcgctacttgctcgttgatacacctgagacgaagaaaccaaattcttgtgttcaaccatacggtgaggatgcgtcgaaacgaaataaagaattggtcaacagcggtaagctacagctggaatttgataaaggcgatcgcagagataagtatggaagactgttagcatacgtttatgttgacggcaaatctgttcaagagacattattgaaagagggattggccagagtagcatatgtatatgagcctaacacaaaatacatagaccaattcagactagatgagcaagaagcaaaatcagataaactgtcaatttggagtaagagcggttatgtgacgaacagaggatttaatggctgtgtgaaatagaaaaacactgtttgttaaaaaaagcagcaaacctagcagaatgcagtttccaaagaatgagaaagagatgatggagagtctagttccattctgcttaacaagctaaaatcatgcaactagcctgtaaaatttccgctgtatagtaacaataaaaaacaccccttcacgtcaatgtgaggggttatttgtgtgttaacatccttcctatttcttcataaatcaagagatccctctaccgtcgttagcgcggtttcatacatcttacccattggcattcctaagcttccccacttcttgaagtgttcgctgacaaaatacggttccactcgttcgttttgtctgctggatactccaatactgtttaaaggttgcgataccttattctcaccatcttttcaaaagaaggcagccatgttatcaaaggcctttgatgatgattgatcattaattgttcttcggttgatctccagacaataacatcattagttttttcgaaagctcttcaaagctgtattgagatcctttgtgtgagtgtaaatgttcttatacaaatcaaatagtgttttatatttttgaacattttgcgcctttggataaaatgcagcagcctcacgaatgaactgctctgcacattcttcaagtgattcaaaccaaccgcttccaaaggcagccagcattgcagcccccatagctggcccttgttcattttctaacttaattaccctcgtattgaaaatatcagcttgcatttgcagccacgtatcatttttagctcccccaccaatagaaacaacagtatgaactgattttcccgcttcgcggaatagctcaattgattcatgtaaagagaatgtgataccttccattattgccctcaaaaaatgctttctattatgggctccatccattccgatcaagcttccccgaatagaagaatcagcatgcggcgttctttcaccaaccaaataaggagtgtatagcagtccattggctcctatcggaatagcttccaccccctgcaataattgctcaaacgattcgtttggtgcaaacgttcttttaaaccagtccaagctgtatcctgcagcgagcgtgacgcccatcgtataaaaagaatccttttttccatgattaaaaaagtggactttccctttaaagtctctttctttttcttcttcgtaggaaagtatgacccctgacgtcccaatactgcataatgtttttccggaagaaaggatacctgctccaatagcgccgcaagcattatctgctcccccagcgtacacttttgttttttctaatagcccggtcttcgcggcaacgtgcggaagcagcgatcctacacaatcatgagattcaacaagcggaggacaaatatctgcagaaataccaatttgattgcaaatatcattgctccactccttgcgagtaatatgtaaaagtaaagttcctgctgcatcggagtattcggtgtgaatgacaccggtcatacggaatcgcacgtagtctttcggaagcaaaaacacagcagtttttttaaaaagttcaggttcatgttcctttacccataacattttaggtaatgtaaacccttctaaaacacggttttttgtgatgtcaagaagatgatcgccaaatttctcggtcatccttatacattgaggcgttgttctggtatcattccaaagaattgcattacgtaacacctgacgatcttggtcaagcagtactaatccatgcatttgtcccgaatagcttatcccgtcaatatccttggcttgaacattggatatagaaaccaattcagccaatgcttcaattgtttgctgaacccagtcttcaggattttgctcactatatcccgccttctcttggatgagcggataccttttggacgtttctgcacaaaccttgccgttttggttaactaaaatggttttaacagcactcgttccaagatctattccaatgacatacttcattttttcactccttgcccttttaaaaaaccattcactctaaataaatcctaattatagaagttacccgtcataacaacaagcaataggaaaggaatcatgacgggtaattcagtgacttggtattgatagcaggatctggagcttatcctgttatacttctaaaatgtattggttcaatatcgcttttaatttctcctgtcttccagattcgtttttaattgatttatgatttagcgcatattgctcaagtgtgtggaaattagctcttccttctataatttcaagaccaatcccttcagtaaagctgcggtaacgatgttgaatcacatcttcaaacacacgatcttcgattaatttgtgggcaactttcaatcctcttgcaaatgcatccatccctgcaatatgggcatatattagatcatcaggctcgaaagaagatcttctgaccttcgcgtcaaagtttaatccgccgcttccaaggccgccattttgcaggatttcgtacattgctaatgtcgtagaatataaatccgtcggaaattcatccgtgtcccagcctaaaagaggatgaccctggtttgcgtcaacagagccaagcagaccatgtactcttgccatgcgtaattcatgttcgaatgtatgcccggctaatgtggcatgattggcttcaagatttaatttaaaatgattgtctaagccatattgcttcaaaaaggcaatggttgttgctgcatctgtatcgtattgatgggtggtcggctcttttggttttggctcaatcaaaaactgccctgtgtacccgatttccttcgcataatccactgccatatgcataaatctagccaaattatcaagctcaaattttaaatcggtatttaacaatgtttcatatccttcacggccgccccaaaatacatagttctcagcgccaagctcttttgctgtttctaacccttttttcacttgtgctgcagcatacgcaaacacatctgcattgcaagaagtcgcggcaccatggacgaaacggggattcgtaaacatgtttgctgtattccataatagcttaacgccgctatttctcatgtaatctttaatcatgcccatgatcatatctaaattttggtttgtctcttttagcgtactgccttctggtgcaatatcccggtcatgaaaagcaaagaatggtgcatctagtttttcaaacatctcaaatgctgcttctactctcatcttcgctagatccatgcctttatagtgatcccatggtctttgcatcgtagctgctccaaaaacgtctgtaccatcagcagtaaatgtatgccaataggcaatagaaaatcgcaaatgctctttcagcgtttttccgccgattacttcttgaggattataatatttaaatgctaaaggattagtcgaatctttcccttcgtaaaccactttgtttgcgcttccaaaatagttgattgaactggaatgagattgagccatgtgatttcccccttaaaaataaattcattcaaatacagatgcattttatttcatatagtaagtacatcacctattagtttgttgtttaaacaaactaacttattttcatcttatataacctcgtcagtattttcaatattttttttagttttttatgaacacattagatataataaagggaagattcgctatgtactatgttgatacttaatttaaagattaaacaaatggagtggatgaagtggatatcgctgatcaaacctttgtcaaaaaagtaaatcaaaagttattattaaaagaaatccttaaaaattcacctatttcaagagcaaaattatctgaaatgactggattaaataaatcaactgtctcatcacaggtaaacacgttaatgaaagaaagtatggtatttgaaataggtcaaggacaatcaagtggcggaagaagacctgtcatgcttgtttttaataaaaaggcaggatactccgttggaatagatgttggtgtggattatattaatggcattttaacagaccttgaaggaacaatcgttcttgatcaataccgccatttggaatccaattctccagaaataacgaaagacattttgattgatatgattcatcactttattacgcaaatgccccaatctccgtacgggcttattggtataggtatttgcgtgcctggactcattgataaagatcaaaaaattgttttcactccgaactccaactggagagatattgacttaaaatcttcgatacaagagaagtacaatgtgcctgtttttattgaaaatgaggcaaatgctggcgcatatggagaaaaagtatttggagctgcaaaaaatcacgataacattatttacgtaagtatcagcacaggaatagggatcggtgttattatcaacaatcatttatatagaggagtaagcggcttctctggagaaatgggacatatgacaatagactttaatggtcctaaatgcagttgcggaaaccgaggatgctgggaattgtatgcttcagagaaggctttattaaaatctcttcagaccaaagagaaaaaactgtcctatcaagatatcataaacctcgcccatctgaatgatatcggaaccttaaatgcattacaaaattttggattctatttaggaataggccttaccaatattctaaatactttcaacccacaagccgtaattttaagaaatagcataattgaatcgcatcctatggttttaaattcaatgagaagtgaagtatcatcaagggtttattcccaattaggcaatagctatgaattattgccatcttccttaggacagaatgcaccggcattaggaatgtcctccattgtgattgatcattttctggacatgattacaatgtaattttttatggaatggacagctcatctttaaagatgagtttttttattctaggagtatttctgaagcaatagtgacatggcaccttctcatatgaaaaaggagttctaaaatagaaatctcctttttcatgtgcaaattatttttctttataacgaaaatatctaaagtcggccggaatatgattaccactggtatcttggcattgcatccctacaaaggcccctgtgaagaatcctcccccacggatataatcatctgataattttttcgattccagtgcaatgtcaattttgtgccaatcttctttgttaaaagaatagaaataataatatttgtccttttcaatatttactcttaaatatacatactttacttcacgaggaataacaattttattatttaatggctgtgaaaaagaaaagttgtcacatattgttaattcaagaatgcgcccaagttcttcatcatgcgtgacttgaagagccgtccagttctctgtattgtagtaattcaccaacccagcggcttgttgaaaattttccggataaaactcaacagcagtttcggcttcaaaatggagactttgccagcgtctggctacaaatgcctgagtaaatgtcgaggtcaatgattcatgaccgaataatcgtaaatgatttggcgcttgagtcaatgaacctaattcattcgtgaatggaatccttaaagtttgaaaatttatatttaatgttgaatcctcaaattcatcaacttccgggtacgttgcttcaaatattgtttcgggtatagaaggtgcatctacctccaagcttccttcttttccacctactacatagggccattcatctttccagtaaagtttttgaatagctgtttctctgcccaaaggacagtatcctctctgctgaaaaattgaatcatcgtcaggatgaataggacgtcccgttaaatgagctaaataccactcatctgtatgtgtttgaacaatggatgcatgaccacatttttgcaatggatttcctgggtcatgccatgacgttaaaattggattatcgggatgaacttcatatggcccctcaatatttgcagaacgagcaattgtagcagcatgttcgtaccgtgttcctccttctgcagttaataaataataatagttcccgatatgataaagatgcggagcttctgtcagttttctatcagttccttcaaatataacttttggtttaccgattaatttttgctctttatcagaatattcctgtataacaattcctccaaatgagtgccgatcaatacggtgatcccataacatatttaataaatacttttttccatccgtatcatggaacaaagaagcatcaaaccccgagctatttaatttaatcggctcactccaatcaccattaatcgtttcacaagtaactaaataattgtgacaatctttccatgcgccatctactaccttaacatccgtatagatcagccaaaacttcccatcactatagcttaaacatggtgcccaaactccacctgaatttgggtttcctttcatgtctaattgtgaaactctctgtaatggatgtgcaactaagtgccaatttactaaatcttttgagtggtgtatctggactcccggaaaccactcaaatgtagatacagcgatataataatcctctcctgctctacaaatacttggatcgggattgaatcctttaagtacgggattggtaatcttcatttgggactcctcctcagtttattttcttttttaagccttgaaatcatcaatatgatccaaataaactttgtctctattctctaattctcgaaccatgtttttatattttttctcatctaagttatagaaattaatatcaattaaagctagaacaagcaagaacacgggaataatggttgttgtaattaaaatccccattaaggccgccggggtttgtgcctgatttgctacatatccaaacttatcaagaaccagacccggaacaactcctcctaaggccataccaaacttaaagaaaaatccgattatagcgtaaatgagcccacccattcttttcccagtcctgtactctccatattcaattgtttcaggaataagcgcccacatatatcccccggcagtgagacttccagcagcagcgattaatcgacagacaagtatgaggtaaacattacttggcggaacaaacagtaaagctaagaggcctataatattcagtaataatgcatagtttagtaatttctttttccccaaaaattgatgaagccttggaataaacggtaaaatgaccaaagcgggtaaacttcctatcaaaccgtaccacttcaccaaatcctctctttctaagttatacgttacgtagtaaatgccaaccgaattactgatggaattcactccaaaaataataataaagaaaatacttaatacaacaagtggacgattaacacgaaactgctcaaatatatccgtaaatttaattttctcttcggatttttgaagagtgacccgctcttttgtgcttttaaaacaaaagattaaaaggcacccgcctatcattcccaaaatacccatggttagttgccagccaagagactcgttgccggaagtatcgcttaaataagcagccagtaagggaacaaaaaatgcaacgacaagtcccccaagattcgcaaataacatgcgaacagaagttatactaacaacttcttgattatttctagtcattgcagaagttaacgcgccatatggaacgtttatcgttgtgtatgtaagcgacaagccaacataggttatataggcatatattaatttccccatatccgaaaagtctggtgttgtaaaacagagtattgccagtatgacaaatggaaaagctccgaataaaagatacggtctaaagcgtccaaatctgctgttcgttctgtcaactattgttccgataaaaggatcagcgagagcgtcgattattctaaccactaaaaacatagtaccggctgctgctgccgataaaccaaaaacatctgtatagaagaacaaaagatacgtagacactgttgcataaattaaattacaagcaaaatctccagacgcatatccaactttttcaaccatgctaatcttctttacattttcactgagcatgatttctccccttttcgatcctttaatatggaacagtgtgaaacggtataacaatttctcgaatttacggtcagtaaacttttataaaagcgctttcaaaacagtgcaaaaaaatatggtgatcagcaagcaaaaaattcatcttttttcgtcataccttatatacctggaaaaggataaaagcctcattctttcgtttcttatattgtttagctccattaaatcgaccctcttatcccccttccatccatattagtaagatcttatcttgtggataatgaaagttcatttcattagtttgttgatcaaacaaactaacttgacttaatattataaaatcctttcgactttttcaacatctttttcagaaagtttaaacagaatgaattaaatattgatttttgactgttttgttatattcagtgtctcagtccaaaacagattcttgtgtaaacacatgacaaagatgatctatgcgaaataaagaattggttagtggtaagttgcatttaagagtttgataaaggtgatcacaggatgtatggagactgttagcctagatttatgctgatggcaagcccggtcatgaattgaaagaacggaatggccagaatagtttatgttataagtccaaccctacatacatatatcaatacaggaaagataaataagaagcaaaaatagagaagctttcaaccggagtagaaatggctatttgactgtctgaggattaatggctgtgttaaacactatgatttttccttcaaacttattttaatcttaaaaattttaattgagactggaaacaaaagggaatacagaaattaattccgtattaatttattcaatatgttaattttactttggtctttatgattcttcttccttcttctataaccatctaataaagactttttataaatcttgaggtaatcatcaatcgttagcaaatgatatttcgctccgccatcttcaaaaatctctaggttattatagtctacatctgcaaatggttttaaatcctcaatgtaagaaatgcctatttttgtattagttttcttaaattcatgctcatgtaaatcaaccattttgtatccatgcagttccatcactttttttagtttttcccacttttcctctaaaaaaattaaaggaataaggagatcaatatcttctggggaaaagtctaacccagttaccttttcaagacctaaagatccatataataatggaattatgtctaactctttattaaacgttttagctatattgataaattcattatacaacttcattttacatccccattatttggtgattaattattaagattcaactggctcttgaattttcataagtccttcaatactttcatgcggtatatatctcaaagggttattttttcaaacatcctgaaagtcatctgtacaatatctaaaaagccttgaaaactgaattaaagaaaaacatcaaaatgataatggctagcacaacaacaatttcaaaagtatgtgaactgccatcttctttttctcgttctttcttctccctcatttgttccctatattttctttgtatttcatcctttttcctatccaccttactcgacccctttcaacataaagtaaagccaagcaattctgaagtttttttattccttcttttgacaagctcgaaaataccaatgtataagcgtaatgcctaatggattttaaactccaaataacaaagcccctccgataaaccagaaaaaaggaaatggaaacataattgcatttaagacaatcccatatacagcacaccgtttatttgtctttattgaaacgaacgctaaaatgattcctataggagaaagtaataatggaaaaaacaccggcattccttgccatggaattgacataaatcctgtaaaaaaattaataattaagatggctgagataattggaatagtgattgaaaaaacagctgcagcttttttaacattcatattgaaagcaagtctccgttctctttaaaaatagtagttttatttagttttgagaaagtttgtcaaaatctctttctttcatttcaggcagagtgatatcaatccctaacatttttattaattcttgtacatagctttttattgcaagcatattaaatgggaaatcgaaatcaagttcctctttaacgcttagaatatccattgcatacgaacagttatgctccatacccaaaagatcatcattaaagcttaatacatctttatacgattgatcagataactcaaagtgagtaactaaataaacactaatatggtttccaccttgagaatcaaaatccactaatctttcatcaagtactaataaaaatgcagatctctcatcatcacataataccatcttagtttcaataaccgtttacatcttgtatgtaaggccctcataatctaattctgcctttcctgataaatcgtttttaaaaaaagtattacatgcacttatactcttctacccagtcgtgatatttttcataaagtggacgtattcgtttgaaatcatgagctatgacttcgcatccgcggtcatcatagataaagaaaataatgtcttttgtaatgttcacaaagaaaacatcagggtaatcaatagagtaacctccgaatttcggtttttgtggaaaatcctcattactggctgctttaagtaattcagttacacgtaagtctcgaggtttgcataacagggaaaattgttgcatctcgtattcttcagctttattgatttcgaaaggatagggatatgtcttcaccataatttgattcaaatgatttttacattttagaaacggttgatacacctttaattttcttatacatttctctttctttttgtgcttatacatattcgtcacaaggaatatgtcatcattttgttcaaataattcattaaaaatgattgaggtttgttcatatacaatccgaaacatctttaaattcaattcttcatttgctttgagttgatagatattttccccaagacaaaaatggattcctgtgccccattgattatagatgctaggaattaattcgaggttttgaaacctttcctcaatataccctattaaattcattcacacattctcactttcggttaatcagatgattttatgtagatctaaaaaaattgtaattccttcctgtgattgtaactttagtataccattttcactctgagcgatcgataggaatacggtctttttggaaccccctaaaagataatgaacatctgtggcaggttcactttattctctgagttcaatgacatgttaagcaattcaacatagatcaatttttaccagaagggaataatcaaccactatataaagatattccttcacaaaaaatcctgacaatcatcaacaacggatcaaacaatcgtctggcaaacttaaatagggtcttattcccccgtgggcaaaagtgaaaagatcagttataaaatgattaacgctcgaatggtatggctgcgtatcaggtatcatccttagtgaactcacctaaaaacaattcaccggagctcattgaatcccatttaatcactgtcatatcactttatatatcaccttcatttaactaatatgttctaagtagagggtgataatttgtttgtattgccgcactcaataaagttcaattccactcttcctctaaaatagcgtaataatattcatcccaccattcattgccttttggaatacattttttaaaaaagccttctcttctcattccaatcttcttcataactcggtatgagggaatattctcaggttgacacgtagctataatcctatgtaagttcatttctttaaatccatattccaagatagcttgggctgcctcagaagcataccctttattttgataattgggattaaacacccacccaatttcatatgtatgttcaccaaaatacttataaaaaacaatatggcctataagacagtcttcatctcttagtatgacagggaatttttcagcgttatcacctttgtttttatttacaaatgcctttgcatcttcttcagtaaaaaccccttcaggtatatacttcattacattactatcagatgtatactcatatactgcttgccaatctttgaattcaaattcacgtatcaataacctttttgttgttatgtgcattaaagcaactcccctctaatatacttaatctttatttcaatatgaagacaacaataacctctttaaaactattcttattcaacaatattgcctcttgctagaacaactcaaggattactgactgtgaacaagcaatggaatatgattctccaaaataatccccctatccttctctgaggggtaatatggggaatttatgacaaaactaaagacgaagtaagatcatttactgtggatgcaactcgtaagccagattgcaaagataaaatatgtaagaattaaacaaacatcctcttacaataagtaagaggatgtttgttaccaacaagattgtttaatttaattggtattccttattaagctttttaagaagtgaaatttcaacttcgtattggcttccataaattctgcttattttttgcacttcttcctttgagccgaagaaaataactttaaaatcatcatttacgtattgaactacaaaaaaatcatcaaaatcataaaatgtatttttatttatcgaaataaaaccacttgattgagctgttgtttttacactaatccgtctgccatcactcacaacatcaaatccatgctgattagtttgacgtgccagagtgccgttggtttggattgcacaaatgaattcaccgattctgccaattaaatgcctcaattctgtaggcttacagttcaatacattcatttcatatctcaggatttggttatattcattataaaggtttacaagttgttctttactaatgatttcggcttgatcatttatttggttattagtaacagaagcttctcggagtgatttaacaccgtttacccattcgcctacgataacttccttatcttccccttttgattttctgaaaataagtcctgtataaagagagttttcacctaagtatttgtaagaacttctattcatatattcaaagaggtgcttattaaaagaaatccccttattataccggttataacaataatctgataaaataatgctatccggattagttccgtatttttcttgaagggttttctttacttcttgaggtgaaaccaactcattgatcttatttttcaaagcatccttaatttgctcgtaaattgtcattatacttccctcaaattgcagtttctttggttgttgaaattagtcataattttttcttttgccgaagtgttattctgaaaccagtttataatactcttggagattcggatttacttcccaatatttcgttccatttaaagacactagcatatcaaaccatatctcgaaattagaatctaagttaatcgcatcttcaatatcatcaattgagtctagatatagcatatagcctaatccattttttgatttgtttgtgtctatgacatatcttccatcaaaatgatatccaattaaaacgtatccctctgggaaatcttgaacctcattatattcaatgattccctctaagctaagtatttcaatcccatcaaacatttccatcccattgtgctgtaacaaaaactctttatagtcattagggaaagtaacacctagcttctgttctatatcgctaatttcttgaggactagcaggatctttgaaatgaaaagtagcatcttccatgacatatcctccatgatgaaacatagggaatgtaccatatttagaaactgctttcttaataccatctagtgtcatgtgaactaacttttatttcttccataaatgctcctcctccttaaatcatctcactaaattttaccacacagaacattaatagataaatttaaaagggacataaactgtttattaagaaacaattttactcataattaaagcaggattagtggtgaacaaaatgtaagtgttacgtgctgttttaattactaccctatctgttgagccataaggaaacccaatccttactgcgcttttctcctctcccccatagtttggatcaagaaatacatcattgatttctttgattggaatttcaattttggatagctgccaattgataattaagttttcatttgatttttcaacgttgattccaagcataaaaacattccccttttgactatgaattcagtgaaacaaacacgctttaaaatttattaaatccaaaaagtaatacttacgggaaatatgactataagcaaaagagccctttcaggcccttatttttcttttacccttggtatgaatttgttacaaactcttttgctttattagcaacagcttcccaagtggcggcagcatgatcaagatccgcagaaagcttattgatatcctcattctcaaacccttgggcgagtgaataaaattgatttgctatagaatgccagatgccttcgatttgtcctataaactccttagacttttctgcttgggctattacattaaccaggtctatattgatactgtgaagcatccccaaaacttttacttctaattctggaatctgtatataatcttcatcgcttggactttgatttttctgtttcttgagtaattgacttaaagctttccacacagtattgtcctcctatgatagcttctttagacgtgcctctatggaaatggtcatttggtgatcagcttcacgaaatgcctcagcaaatgtttcaattccggtatcctagaaacatggcgttagataatcatgcccaccgatgcccccgctggtggattagttgcaagcataaacattctgcgatttatcaccgaccttgtcaaagggatgttaaataaaaaagaaccttaattttcccattggcttattggcttacttttgaaaatttataaattattattatattgaacagtgttggtatgatgtatacaagaccagttccaagtagacctattactgaactagcaattaataatatgctgaagactggtttattatttgtctggattgaagcaagcatggttataattcccgccaaagcacctaaaaaccataaattccccaaagtgtaagagtcatctataaccgcaaacagttgagccagtacagaaaaaaccgctcctaatcccccggagaagatagtcaattttttcatagaaatctcctttttgaaaattgatttagatttcaacgtaattatggattcatttggttatgatgtcaatgataaacatctaccttactcatcttattattgctggtagaagtattgaacaatggaattatcacagaatttgtcgaattatttatgcgtattgcttccttaagcgtggaattatttccctaattaaaaatttagtacatagaattattagtgacatagactaaaagtgaccctgctttttagcagtgccgctccataatttattacctattaacataaaaaatcccctgacacttttagtgccaagggattgagatattaatactgagacatatactgttcgcgttcccaaggatgtacttgcgtgcggaatatagtctaggctatatttcaatgtcatagtgcatgataaacgttgaattaaaaaggttttgttatttctcttcgaataagaaatcatcaagtatactatatttgtgggtgtttggtgggtgtatttgtgggtgcccacatcgatttatttttagatttttattgtaatctaaagatatacatataaagggaacagaatctatttaaataaaaaaggagaattagaaaagatgtagtatttgtctttatagaaaggagtgatcaagatgaaaattcaatgtgagttacctgtaggaacacaccatgacccacctgtgggaatggagttaggtcgtgaaataagagtaggtggttaaatcaaaaggctccctcatatgagagggccttttgattattgatcgacttgacagccgcacttacaaatgaaatgcaaatgtttattcccattccaattacatatataatccgtgatttgcttctacatgaaggacaagttacgccaggtcacctcactgaatagaaacctaagtacttatctaatataaaaaagcccattaaagggctacactttagagatctgctttcttacgctgtcggagtctgataataagatacaactcctattattgctaacacgatgaatacggctaggatgctccataacgttattttaacgccttttgtcatcttatgcccctcactttttattaagttccaactggtctctctgcaatttgaatatcagttccgactggcttttcactaaattgaatgtctgacttagtaaacaaactagctccagcagctaacccacttaagataatagctgtaacagacacacgaagtattaatcttttcatcctattccctccaactgcctcattttcttttcggctaaaatagctcgcttagaaaattcaagagcatccttataacattctttctcctcgcagtactgagagataatcaaggaaagatcaagaacactgtctaagtcattcttttctagaaggaaatgaatgtaactccaacattgctcaatggtttcgttttgattatcttgaagaagtgcataaatgatgtttattttagcctcatacactttattctctttctgggttaaattttcctgtccttttttgtaataatatacagctttatctttttgacccatgaggaataactctttggtagccatgtaaagagagttaatgtaataaaccgattgtcgccactctttatttcttatagcttttctcagtgcgttgagacagtcttgggatctgtttgctgctgagtatgtaatacttaaattgtgatggatttgcgcttcgaaaaatttatcatcaagctcttttgaaattctaatggcttggaaataagcttcttcagctttatcaaattggccaagatctgtatagttagttcctacaaccataagtgcagttgcatacttccttttgtaattttcattccctttataaatgttgagtgcgttgtttatataatttaatgaaacaatactttgtcggagcatcatgtacattgacgcaactttagaatagaattcagcgacttcaatttcatcaggaataacggataactttttctctgcaattttaaataagctaatggcattctcaaagtttcgattgtaggattcgtataacgcttcaaacaaaaagaagtagtactcaatcatgttatctgttttttgaatttctcttgcatgtcttttattgaagtatgaatgctttgggaaatctgttcctttaacttgatacatcatcattttatgtctttcttcaagtagagagtaatacattaatacttcctgatcttcttccatgtcatcaaataaagatttgacttctttaaaatatttttcagcagcctcaacattctgctgttttatggccatataccattcatttaagaaattagcaacatattcagaagcaagtttactcataataaacccctctttctgtcaaaattctaaattatcaaacaaatgttaacacaactttaacattaaatgtaatatatagaaaaaattttcgacatagcgcaattctgctttcgtgatgacgcaattaaactcaagggataatttacctaattttcagggtgtgtaagaacggatcacctaggtcttgtatatcaattataaggaaatttcctgtccaaataatgtattgagtaaaattaactattacaataggagtatttctgttatttgggtgatcttaaagccgttaactctcctaaactatggtaaaattttgagtattgagtgtcggaaaaaggagaatgatatgaaagtatttgaagccaaatcactgctttcagaagcagatagacgcacaaaggaatacaaagaattaagaagtcagatggtcaatctaaaaaaggcttttaaagctgtagctgatttagatgacagtgagttttccggcaaaggcgctgacaacattaaagcattttatcaagaccatgcaggtgtagctgacaattggattgacttacttgatatgaaaattgctttcttgacaagcatttcaggcactctagaggacgccagcttatctgatgcatatatagaagaatctttcttagaacacgagctggctaacgcctacacaaaatcaaaatctattatgtctgaacaaaagaaagccatgaaagatatcttacatgatatcgacgatatccttccgcttgatctgttttcaactgaggactttaaagacgaacttgcagatgcagaggacaaacgcaaaaaaacagtcgataaattaggaagcgtggacgaagcactagttactgaatatgccctgtcagagccaaacgagcaattcatcaagaaggacttccaaaagcttgaggaatccacaggcaaaggcaaaaacgctactcccattcactacaacgccaaggcgtatcgtgaaagtgacatacataagaaaaaaggcgatattgagaaaaagactgaagcttatttgaagatcaagaaagatgaagcgaaagaacgagaaatcaaagaattgaagaagaagctagctgatggagtgacggatccggatgaatacttagaaattgccaagaaggtcggctatgagaatcttacccctgaacagctccagtatgtggtgcagcttgaacaagcaaaacagctgaaggccgttggtgaaaatgtgatcaatgccggtaaggcaacaattgatttcatcgatggagttaatgatgcaattgacgatgtgattgacgatacgatatatggcgttaaagacttggttgtaggcgcatgggaatattcacagctccctaccgaactaaaactcacaaaaacaatttcaacagttttaagcgtgccctcttattcaaaaatcatctggacaaacctggtcgactcatggaatgataaaatggtaaatggcgatgcatacgaaaaagggcattatatcagttatgcaataggaaatatcgttgggccaaaaggtgcgggtgccgcagtgcaaaccacgaccaagctttctaaagtaggtaaagtggttgaaggtggaacagctgctgctcatgtgaataaagggcttttaaaaggaaacaaattttttaatcccttatcaaaaagtaaatatgaacctgcacttgtagggatagctcaagatatagagaatacttacaatgtgaaaaatacatctatattaaaaaaagagattcaatcaaaacaagatcaatttgtccaagctgcgccatatacacataaagatgcattcggtaacaccgtcacaaccaacttaaaaaatggacatttaaaaaatgatgttcaccctgtaaccggagtaccttatgataaagatggcttcccaatttttgaaccagttgccgaagtaaagattgataaatcattatatctacagaaagatactgcacaatttaaaaaagccactgaactattacagcaagaaattaataaaaatccagagctaaaaaaacattttacagaaatgcagttaaagcagatttcaaaaggcaaaaaaccaaaaggttttacatggcaccaccatcaaaatgaaggtataatgcagctagtagatgcagatattcatggcaagacaggacatactggtggaagaaacatatggggcggaggttccaaatacagataaaaggagtttttaaaatggttgaatgggatttcggagagcatcctgttagtaacgaggaaattattgaagtagaaaacatgttacaagtaaagttcccaaaggattatttagaatatgtcaaaatctattctggtgctaccccctctcccgaaacttttgatcttgaagatagggaaggagttgcattcggatacttacatagcttccataaagaaagtgagtcatatatagttagcgtttctaatcgttatcgagatggtagaatgccagacaaagtaataccgattgcggatgatgtgtttggcaatgaaatctgctacgattttcggaaaggactcagtagtccttctattgttttttgggaccatgaaattgcacatgaagatcctgatagagctctgagtcatatatgtgattcatttcccgagttagttaataaactatacgaggaataaacggtaaatcccttctcataacgagaagggattctcttattttagtagggattcaagtttcacttttgttttcggcccgtagataccatctgcagaaagcccgtgcatcagctggaaccgtttgaccgcgtttgctgttttcggaccatacacgccgtcaatgccgttattcttcgcccctttgtctggatagaaataaagagcagcaagagctttttgaatctgccttacgtcatccccttttcgcttagggcttgtgactttatagatgccagtaggcagcgcatatgacgtttttttgctgcttggtttagtgctggaagtgcttgatcctgtgagctttaatacttggccgaccttgatcaagttcgggtttttgataccgttcaagctttgtagggttgctacactcaccccgtgctcttttgcaattgcggaaagagtatcgccttttttaactgtgtaagtgcccccagaagctttaggcgcagacgatgacgatttagaaaatgttttcccgcccagcgccttcaattctgcttcaatggcagccttaacctcatcccatcttccctctgacaaaatacgatgcgggcaatacttgccgttccaatcttgatgcttgcgcacacgatcaataccccagccgcgctctttaagcagctgcgccacaaacttaattgccagcttttctgctgccttatatttagcgcctcctgacttgctgtagcagatttcaacgccgatagacttacggttaccgggaccatttgtgccgtctcctgtatgccatgcattgcgatttaacggcagtccttgaataacctctttgtcatcaactgcaaagtgaaaactcgttgaactggtgtttccggtcatgtaactgatctcattggcagctgacgcatcgtttgccgtattgtggatagtgatgtattccgccgtcattggattcgaacatttcaaaccgtatttagcttctgatacaagattctttttcactgtgattgtcatatgtgttctctcctttatttttgatatagaaaaaaccgatggttttatccagcagcctgttcatccttttcttttgtttgttcgttgtccttttcgattacgtgaagtcggtcagtgatggccgccggaatcttaacgccgatctgcgccagattctccgtaatagaaaggccctcattggcgatataaaaaagaacggtcccaaatgtcaggacgccgttcagattgaggattgtatctacgatatttgccacaatgaccactagaaaactgagcatttttcggacatatccaaaccaagcgctccggctccgcagcttcttaaatttccatgccttgatcacacccgttattacgtcaaggatgctgagaactagtagtaaatcaaggtacttcacacccccaaacaggtaaactctcgctaaatctaatgtttcaaaattaataaacacagttgtatcctccatttcttgttatcacctccttagaggcaaaataaaaaacccgtcaatttgacgagtttattagtctctttgtataagcagggtcattggaaaataatccatccacccttaaattaatcattttcattgtttgttttttctcattctccgcatcgaaaaagacatgaatctttaaattcgcagcatgaattttcccaactatggatttatcaactaatttggcattagggcctactgcataagcgtaactttttatctgcttaagcttatcactatttaaatcctccacttcctcatcaccaagtaaacgcaccagtggaatctctttattaatagaatgtatcttctttaaactcttttcactgaatgattgtaaaaccactttgtgctcgactaatagattgtatttatttaggatttcaatgagtttttgttccattactaaattgccgttattatcttctctcgtttcgatataatattttgttgaaaggccgaattcttttattatctcttctattgtcaatattttttgacccttacctgcatttaatttttttaattgagatagagtaagatcctgaatttttccctttccgtttgttgttctcttaacatccttatcatgaatcgctaccaactcatggtctttagtctgtcttaaatcaatttcgataaaatccgctttatcttttattgcacgcttatacgagagtaacgtatgttccggctctaatgctgaagcgcccctatgtgcgataattaatggatgataatcaggtgtttttgatgaagatcctttaacagcagctgtgccgctatacgtcgaacacccacttaatgtaataaaaacaataaaaagtaaatagatagtatttttcatagatttaaattatcatatttaatctacagtaacaatatcttccttaactatttcttcatattggctttcgcttattttattgaaagagacaaaaactttaacgtcatcctttgagtaacatccccatttataacaggtaagtatgcttttataccagtccatttaaacaacccctttttgtgcaagtgatagtattaaatcggcgtacattttagcctgttgctgagccatcgattgagtttcagccaattgtgagataagtaaagcattttgctgtttgagtaattccaaatctgaaggttctctggtgggccttaggcttataatgtattcttcagttgccgcctccccccattcgttcaattcgggattgaatttaggcttatatatcccatcaggtggtgcaatctttgtgcaattattagggagactttttccaccgttagcgtctattccatcgactattacaggtgtttcaaatataaaatcgtcatcatatttatatacttgtatcatttatatactctccttaaacagccttaaaacaaaaccctaaactaatataatcatttggcttaactgtgtttgaacaattttctataataactttcccatcgatatctacaagcaacctatgtgtctgtggaatgcctgacataccaccttgggaagctactccaacccactggatggctctagctggtctgtatccctccggtaaaataaaggcaggaaccccaaatcctattattccttttgaaatagcaccttctacaaatactgtacctgttacgtccttggcataccgtactttatattttgtttggtcagttgcgtttgaatcagtgtaatttacccagctattttgtaacgtcggggagaaccatgttaattcggttagtcttttttcaaggctatcagtatatgactttgcatccgcaagaaatttttcaatttttgtttgagtctcagcttgagtttcgactttagaccaaccagtccatccttgacttaaatctaaatagtttgtaaaaacgttatttttataatctattgcaattacatagccgaacgtgccaagaccattgctatctagtgaggtaaaatgaaacatccctcttgtcgagaccgtgctgggtgaatttgttgcttttcctgttgaataaaaggttccgaatgtctttccagctttaacaattttacttagaaaatcatctgtgtctgctatagatattaggactccgcccacatcattagtaattttaaatagctgagccccgttccatttatccttatctgattgggtgacatgaatatccgttttatttgcatgagcattcactttcccctgtgcaccggaaggtgtctcctttgcattccatatctcgcgctcttttgccgtaatatgctttgtctgatcatttgcgtgttcatcggtatagtccttcgcgttttgttccgcggtgtcggccttctcctgggcaccgtcctttgtctcgatgttctcaagatcggcaaacttggctttaagttcctcaaccgtctggctaatttcatccatggttttatttaaaccagccctgaacgattccacatcatcaatgtaatattccgctaccgggacaatgttctgatcttccaatgtctttgatatcgtaaaagtaaaaaaggaagtagccagagcctgaccatttgtgtagtaaagctttaattctgccttcacaacgccgtaatgctttaattcttcatcagacatgatgtattcagcttttccgttcactttgtctatgatagtaagactctttttatagaaagagccgtcccgataaagtaaaacgatttttgcatcgaccgcagacaatggaagtggtacgccgtcttttgtaaaagaaaaggacagcttggcgctgcccgtgtcttgagtcataaattggatgtttgttgctctcccgtctgatttgtgggaattaatatcaaatgtcacgtttgcgtttttataaatcaatgtttaccctccttaatgctgcggcgtaacgatcatcttagctatcccatagcctttttcttcgtcatatggcacttcaattttcatgacagtgccgtagccatcggactcagcttttgtcgctattcccttattagcagatacgctatcacctacccgcaccgttgagtcaatacgaacaaacacctgaccaataagaccgatgacatgccactcgtctcgttcttcacgaggcttatattcctcagaaggatcgtagtctggattttccgccgggaccgttataacccgttcaccgtcgtaaacctcccgataaataatgccgccaaactcatccctcaagtaccggtctttccaatcgaaagcagcaccaccgaggacaagcccggccgtcttcgatacgacacctagaattttatcgccagcgtcggctttccgaattttttcgccttccaaagctacaaggtaggaggcttcaattttatggccgtcagttgactcaaagtattccgcaaagtctttaaggtcagcgacgctttccacacggtttgtagcgcgaacatttccgcctattgcatctaactcgatctttttgtttccttctgagggattaccgtcaccatgccctaaagcgatgctgtattctttggtatttattacatttttagaagccataacaaccgaagaaccgctgtctccttttgtatgagagttataggagaacataacaccattgcgcgatccttctgtggatgctccgccagcaataccagcaatgaaattccgttcgcccttcgcgataatcgttcccgatccagctatgattgcacttgtatccgttagaggtgagcccgatctggcagcagcccggaagccaccttttatgtttgtaggtaccgaactatatttttgacctgctaaaactgccgcattaatatagccaacagcccgaactgctgttatatcagcctgattgtttggtgacgaaatccctatacttccgcctcttgtatgagcgataccgttcattaaagtgacatagtaaaccccgccgccgatggaaattccctctggtgctgaatcatggatagtaaaattcgaaatacgaacatcatccgttctttgatcaccgccatagatacggacatccgaacccgccttcgcaaatccagaaatgttcaaaccattaatgttaatcttgcggcttttatactggaaggcgataactgggatccctttatagtcataggtaggatcaccaagtgctgtaaagcccagtactgtaacacgctgataagcagaaatcacaagcgctttcggctctagcccagcgtacaaatcattgaatatcggctccttagctgtacagtctactaaagtgacatctcttgctgtttcgctccagggctcatttgcataatgatgtccgatatgacgaaggtcatacgctctcacatcacggaatgattgatgaccgtaaacatgaacattagaaggtgccggccacttcgcatgtgcctttacttccaccccacggacattcccttccgtataattgttaaataaccacacgtctttagagccgtcatctacttcaataccatttgaattggctttaccaagggcatgggctgttccagaaggatataaacacctattgtttgtgatgaagatatttttgctgtaatgagttgtaattccatcgtctccatatccttcacaaatacatccatcaatccaaattgagtcacaaccgtttttagtgtagtcactatccgaaatatcgtaagtaggtgcggaaatatcgattccatgtaacgccgggtttacagttcgaactctttgaacccaagcgttttttacctgtgctaacaataagcagctggattttactccacccatggctttcatggttccattttgccgttcacgattccaatcaagtgtcatatcacgaattacgatatttttgttaccgccctgatgatcagcgtttgtaatcacccattcatctgatggtgtctcatcatgaagaataagagtggtaatatccattccgtcaccctcaaagatgacgttgctttttagctttacaccgcgaacaacatagacgcccggacccagtttaattttcactttaccgttacccatggccttcacgattgcatcggaactgtctgtcactccgtctgaaacggctccgtaatcatccacatgaacgacacgttttattcgcttattcaatctcatgtaatcccggtcaagccgttcttttaataagggcgcaatattaccgtcagtatcaacacgggcatcgacgacctcttttacatttgttccgtcagcattaagaatcaaattacgcatacgattataaaggctttcaacatatgttcggagagaaaaaccttgatgggtaatttgatcggacgtatgagcagtttgagacgttttatgcgttttaatcgcatcatcaagactgttcaacccatcttctatagtttctgtgtctgctctttgctgtgcgatatatcttgcgtttcgggttgtgtcataatctttaattaatctgaatgccatgagatcactctcctttctagacaaaacaaaaaacactctggaaagagtgtcttagatcatcattctgagtttttgcatgtagcgtttttgatcttttaatcttttttcttgttccatccggatatcctgtatatcctttcggaagttggcaaaagtcaatgtaggttttgcgtaaggattcaacggcttatattgaatcgacaaaagccggacgtcgtcttcgtaggtgacaccatatgaggtatcagccaatatatgaagcatgtctcccttccaaaaatcttcttgtatcttcaaaagcttcggctcgtagatatattcataatccacttctatttccgtctgtggatatgggttaacatacttttttagagctgccaacatactggactcttttttatatttttcatccctcaatggttctgcccatcttggcataccatcaatcaaaaatttatcttcatctggatgcttgtacaataccgggtcaaaaacatactccgttttttgctgtcggtgctgctgttttctttaattgcaccataacccatcgctctggtagagcacccttgagaagaggttttgattgtgataccaggcatattataacgagtatcaagtgtatgatttattcgctttcccattttcttataaacatagactttataattatcaacgtccagctccaaaccatagtcttcgacaatttcatccattagctcatttccgaatctatctccaaaattctcctgttcaacgctagagaactcactttctttgtccttaaagatgtaccttaattttgtgcctttaaaaacaaaatcaagcatcttcctgacggtaaacgtcccactgattgtatcttctacatagtgattattcagcgttacaacaaaaacgtggcttgctgttacttttttagagagcgtcccttcctggttaatctcaatatctgtgatgaaatacttttgatgattgaattttttctcatccagataaagaatattgtcattcacaagcaagtcatattcggtgccattatcagctgttcgggtgatagtaaattcaatatcctttttccctgtcgtatcgtctaataagtccggatcagctccgataacttcaatagcttgtgtattatcctgacctgcaacatgtagctgaggaaaatatacatctttagggaggctcatatttagcgttatgtcttttccgtcaaactctttacttggcaggtctacagtcggatcaggattatttggttcatcaggattatcgggcagcccctcagttgtatcatattgggttaatttatatgtgaaaataatgctgttgagctttgttgcataatttggatcagttgcatatccagcttttacgagggcagccgtagctttttgataatccgtttccccaacaaccgccctataatgatccttatcccaacttacaccattgagatacaagttagccaggtcttcaatcgactctttccatgaagggtacttcctgaatttagctggcacttgaacattttcaccattgatcacttcccaggtcatcatagtgacatattgtccgttatattcgcccttcatgccaaataggttgtgtccttttgtcgcaagttcacttgttccccatgcgctttcaaggcacccttgcgcaataattaaggatgcaagaatatgatgatttttataaacgaattgagcatcgacagctatttcttttatgaaatcctctttagccaccaaaccacatcccttacaaataataaagccgagtatcaaattgaatgttgaagtcgtttgtattttgaacttcaaactcattccatccaatttcaagactcggcagacggccagatgttttaatcggtttgttattgattatggtgtactgtttcaagaaagagacttcttgtgtctttttgatttcctgctcaatcgttaacttctcaccatttgaatgattgattaaagtgatatttttccctgcagctttcaaaataacgttatagtcatgatcaagtggattgatttgcacgtctcctgcattaaaaacagagaatcgttttttgttcttaaaataatagtccaagttatcatccgatcggagattcatcccgtggttccaattttcaccgttaagattctgagccgtttttgttgtatatttcgactctgccatgcctgtgatattagtaaattcaacagaaaaatcgttataagttttctccttctcttttgaaatgctgaaattaccatcacaggtaactaagaaacggcgattcggcaaaagatcagaagaaatataataagggaacggcttaaccaacagtgcataaagctgatgccgatacatataaaaattctcatgtatgtgagcattcaaataaatttcaacatctatttttctttccccgtaagtcacatctcgtggatgctgcggcaaaatcagtccgtgccgccgagggatcgaaattgtttcccgattaatctttggagcttccggcaaaaagcttaatacttcaaattgagggagtaagctgtcaaggctctgctcccctagtccgttattgaaatcaataaacagttttaccatgcaggcttacccccgtttctgtaacgttttttgttgtatcggtccacactggtttgatcaactctagttccgtctatatacgtgtgattatctttcaaaacaagctgctgcaaaagctgaatgttttgctgaagagcatctatttgctggctcatcatgctgatttgcttctcttgattctccaccacacgtttcatgtccacattcacattggtttgcggctctgcctcagctttagccattgaagctttttgaagcagtacaagggcctttgaaatcattccttgttgaagtgatggaagaacaccaagctcacgtcctacacgcgcccataaaccgatgttgcgttcccgatacgtcgggtctgttgtaatcgtggtctcatcaaagccccgttcgtttagaatcgcccatttagagccgccgcgcccaggtgaagtccctccttttgcgtaacccacatacggaccgccgcgagccattgacttcaatccagggtgattggatatatccccgtagcgacctttaatgtaattaattgcagccagtatattatcaaccggattaagaatgttattgtgtccaggaaacgcattagatgaaaatgtactcgggatagtctgcatcagcccacgagaaggatgaccggctcttgcatttgagtcagtaaggtttattgcattgggatttccgccagactccttcattgcaatggtgatcaagccaggaacccatgagaatggtacaccagcaataccaacagcttccgctacccatttttgaacctgggcagagcctgtcgctcccttatatgcatctgctgtgaaaagcccggcatccggaagaatgctttttaaaaactgaccagctccattttttaatgtttggaggataccagttcctagtgagtcaacacctttgcctgacttaaaagggataaagcctttaaacaagttcttaatcattttctcagggccattcaagatcatttccatagcacccgatgcaacatctttcgctttattgacaacgcctttccctgctgaaatggctcctttcacaagcttcttggagctattaagggcgtctttgaagaagctgccgacaccgcctgcataaccaggaagaccggttgccataacttcttttgactgactatgtgggagaaccgatgtaccacgcggtaaatcccaaacctgcgggccacccattccaaccacatacgttccgatgcctggtgtatgagcaagctcaaatccttcttcaccgactaacgcccttccgcctgggtgaaagtctgtcccttttgcatatgccctgcctggcgctacttgcatttcagagtttccgctgtatcctttaggcttccattcaggaatggtaggaatgtgcatgaactcaagaacagtattgatcccgccagtaattttattaacaactcctgctagatcaacgagaaaagtatcccatttcccgagcacttcccctgtctcccaatctacttcttctaaatgcccagcagcctgcagtttcgcttcactgaccacgcctttatgagttttttcagcctgtttcacaacctgatctttttggctcttcgcagagctaactgtatcatcatgctgttttttagtgatagaacccttgacgtaatactctaaatcagcgtttttcaccacttctttatattgcttttcagcattcttgaccacattgtcttttgcttttttgctgtttttaactgtggctgctgcttcttttgcagaaagttgagttttgttgtcttttagttttccagcgataattgtctgctcctctttacttttagtaagagcagattcaacatggctattcattttctttataatctgttctatttctttacgttcgccatctgtaatatctcggtgatctttagcagcattttcccaaatctttttgatgcgcttggtatacccggatatttctttatgcttgtccttattgttgtctttgatattctgtaatgtttctgtcttctctttctctgacatttctttattagaagcataaaaatcacttaacactttcaaagatttatcagtgctcttttgatagccatcaagaatggtttggcccatcttttcatactcacttgacatgttatcagcgatttttttcgtgatctttttgttggttaaatagtaataattcagcttggcaccgactttggtattcatatcttcataagcattaatcgcttttgaagtagattcagacaccttatcgccaaagtcgatagttgccggcagcaccctttttttcaagttgtcataatacttaaatcccgcatcagctagaagggtgacaccagtaacagctattccgatcggtcccccaagcaaactaagtccaccgcgcaaaagaccaacaatcccggcacctttttttagaatgttaaaaagaccaaatccacttttcgcaagctgcataaacccgccagcgccttttactgcatttactccagctttgatgatccctgaaccgaacttgagcagttcaggagcaaaagaaaggattaatccggcgatcgttccaactggtccgccaaacaagctcaagccaagacctgctacacgggaagcgccactaaggccactcatcgctcttgcgcttctggttgtcgtttgttcaagccgtcctaccctggttgtggcaagtgcagaggtttgatgaaaacggtccattcttgtggatgctactgcagcagctgttgaagtggcagtcatgcccgctgctgctgttcttgaagctgtgctggccgcaatcgcctcagcagaataaacagttagacttgtagaagcacggttcacatttccggttaaataagccccagctgtgcgaagcatattccaacccgcagccattttaggaatagaacctaatgtcagcaggaaagccccgcccaagagcgagaacacagtgaccgctgcacctgtaatggcaatcgtgctcgccactgaagaaggcaaggaatcaaaccatgtcacagcacttgtaatgacgtctgttgtagcacgtatcactgggatgaattgatttccaagtgtaataacagcgttatttgtggccgactttagatattcaaatgaaccggccaggttgtccatttgcttatcagcaattttctcagctgtgccgccgctgttttccaattcttttgtgaagtcttggagtttatcctttccagcgtgcattaaagtaatgaagcctgatagagcatgctgtccggcaagctgtttggcaatcctgatttgttctgtctccgtatagtctttggttttctcgttgatttgccctatgatgtccgctaacggacgcattttcccagttgaatccgttactttaagccccagctcttcgattgccgatgctgctggctttggaggcgcagccaaacgagttaatgttgaacgcaaagctgttccggccatatcagctttaatcccgctgttcgccatgatcccggttgccgcggccaattcttccatgctcacgcccgcggtttttgctgcgggagccgcatatttcatggtttgcccaatttcctcaagcctagcgttcgaattggtaaacgtataagccataacatcagcaacgcggttagtgtcctctgcttttatatgaaactccgttaagatgtctgagacaatatcagctgtaacacctaaatcggtttgcccagctgcagcagttgccaataacccaggcattgcgccgatgatttgattggttttatagccggccatggctaaatactgcattccttcggctacttgaccatctgtgtattgtgttacggccccaagatggcgggcagtttcagtaagcgcggccatttggtcatctgttgcatttgctaacgctgcaacccggctcatttccttttcaaagctggcggcagcctttacagtcgcccctatgccaagtgctccaactgcccctatagctgtcagcgccttccctgtttccgtcgcagaatcatagacagcttttaattcttttgatacttcttgtgaatcttttttaaagacagaaaaaacactagcagcccggctggtgtttcctgacaaggttccatattctttgctgacttgctgcagttctcgtcctaaattttgatgaacagctattgcatcatttaagcgccgagcttggatttgtgtctcgcggttgtcctttcctttttgacgggccaattcatcatatctctgacggtgttcttggactaaacggccttgaatcttatatttattgtttagcccttccatttgcgactgaaggagtttcgtttggttaccggtatttttataaatactgccggccgccttcatttctgagtttgccaggcgcatttgcctttttaggccttcaatacctcgattaaaacctgtatcgtcaagacctactttaacaaccatgtttcctattggttgagccatatgtaaacaccccgctttcctggcataaactcaataaaaaaagacaggtgagtacctgtctaaaagatttgatcaattgttaccgtcttaattctcggtttattcttttcagccaaaacctctaagtaatggtaaatgtccatgttatctatttcagtcattttccacccttgttcaagcagagtagaataaatttcatttatttgctggattcctctttcgtaggtgtactcttctccgtcttctcctgcaaaaaatcttggtcaaaggcctctatttccttataacctgctatctctgagagaatgcggctgacttctttaccgacttcaaaagactcaagtccttcgaacaattcctcatatgagaattgattttggaaaatacttacgatgaactgcatttgtttttcaagcgttttaatgcttttttcaagatcatctgccgttttttcagcctctgcattaagccttaacgcttcaataagtgctttcgtgtttgtccgcggtgcaatgaatgttttaaactttttttcgtcttcaaaccacagttttattgaaatatgtttttgagccatgatgactcctccttttagttaaatggattttgtctgaacaaagagaagcttttcagcttccccttttatttcccaagatcagcacttacatttccttctgagccttgttcattttgataggcatcaccaaaaactgccttataaaaattatccagattaaatttttctccatcttcgtctgccacgattttgaacacatcatcctgctctctgtctacaaattctgctgaaagtttgatcgtttggaaatccgttttatcttgttttgttttccattcatcacccggcaaagagaatctcccttttaccaagcccacatgacgagacttgccgtttgctttaggaccttggaacgtcatagcaacccaaggaggaatgatatttttcttaaacaaatacaatccgttttcatcttgttcaattccaagtaatttagagagaatctccattggcagatcccgcatttcaatgtctaatttagttgaaccagttgaaactgcaagatcgacaagtttgtcatccgcatattgtttttctgtggatgtttctgtttcaactttcatattgattgcaaattcgtagttaaggatttccgtggtaacaaaaaatttacccaccttttttaaaggtgcgaatttcacattctttaaacctgtaactgaactgtattcaggcatcttaaaacctccaattatagtaaaatgttcgcctcgaaccgatatccttttcgaataagacgttctttttgtaaaaattcattgatggggacagttgtctgaaagtccatgccgcccattacttccacaataggggcaaaaataggatcacatgaactattgtggtacacatcgatctgataaacggcgctgtcttgtatcggcttcccatcagcccatttagttgtcctgtagtctatctcctgaaccacaatgtaaggaggagaactttcaatcccttctggtacggccagttcataaatatttgcaggatcaatcaataataaaagcgccggatgggtttccagcgcttcaaatatcttgtcctttaattgcattgatctttcgatgaggtttaaaagactcatagcttataccccacctttacgaccttttccatagcatcaagcatcttatcattcgcctggatcatactgtttcgaataaaaggatttgctgcctgatgaatggtcccaaactccggcaagtgaacacggaatttagtgtcctttgttgggccgacaaccgcatatatttctccgtcttcatcttgctttatcctgtttccaacaataatgtcctcatctatgtgagggtgcttacccccaatagctgaccgcggagcattagcattgattacttccgccaatacagcaccgcctgcttttacggttgctttatggactttttcgtccttgcgggctaagtctgcgaatgtagattccagttctttaaaaccctttaattccagttcaaaattcatcagctcaccacatttgctttaattgtaatgaagtgccgacgcgaatagttaggcaagatcgactcaatttcataagctttttcacgaaagatgattcgcatatgctcgtctatgtcttcgcgatgacgaattgtaaattccactgtcttttccttctggatcgcagccgcagcataatattctcggccttttaaaccctcagctttagcccagcattcaattaccgtttgccagctgtcctttccatccacaggcaggcggccagcaggcttctttttctgaaattgaatacggtatctcatgtcattcaacattatgagcagcctccggcaatgtatatttgagctgattgatcatggtagtcagcactccgtccaagttagaagttgtcccggcaatttctctgttttcataccagtgagcaacgaacgcattcacacacattgctgccctggctgatttattcgggaatgtaagaccggtagccgaagcaatgtattcttttgctgatgcaataaagtctaaaatcaaatcatcctccagatcaccatcaacccggaggaacttttttgccttttctaattcaactttctcttcttctgtcactcgacatcacctgtctttcattcagcagaagttgaaggtttcagctcatcaatttgtttttgaagcccatctaatacgtttttcacttcactatttaagtggtccatcataacgctgcccgttccaatgttaatgctacggactgatttttcctgcagcatttcatgcgagatggattgttcaccgataacagcaggatcacccttgtcaccctttggaccttgaggaccagtatctcctttgtctccctttggtccctgcggaccggtatcccctttaggaccttgaggcccgggttcgccttgaaggccttttacatagagaggattttgttcgctgttgtccgcgatagagacatccgtaattggttcccctgatccattgtctcttgctgatgtttttgctccgttactttcatttaaaaaatctgccatattaaatcaatccttttgttttttatttacctaaatccgcagattcagtcgatggtgtttccacttgtgcctcttctccaacaacaaggtcagtaacgatgacggcagcttctggatcaacaactttcccgtcgaaacgctcaatacctcggaaatatgtttggtcagtgaggaatgcgtctccgcccacgtcagttgatttaatttcaaatttttcacggtcaaacatgaaataagcacgttcaaaatcaccgaaaagaatatgagtcttttgtgtcttgtcgtcagttacaatttcgtcataaacctcaaccggtcgtccgaacaaaaggaagctgtcttcgtctctaggatcttgagctaagattcctctgccgtttttatcttcaatgtttgccagagtttcaaacgcttcagtattcataacccactttgcatttttacgatatccgcgtttaatctggtttttaaccttgcgtagaaatttaatcgtaattacagaaggcgctttaagggttttatatttttcactagtgataatcccctcaacatttgtttcgccgccttttccataaaagacttcatcattttctgtcactacagcagattcagagagccagtccacgatctcacgaacaaagtttacaaatgaatcatttaatagctcgctagaaacaggcataaagccggcgaactttttgacgttgtaccagatttgttcgaattccatgtttttcaattctttaatttgttctttctcagctgtattatagagttttccagctacaccttttcggactgtataactccctgatggagcagtttttggcacaacacgaacaaggttccgaacggaatttaattccttgatggatttcaaaatctcttttgagatatcgtccggaacagtatacccgccgtctttatcacttccagcagacaaagagcgattttcttttagaacacgctgcatcatgcttctttcttcttcgccaaggtcatggctacgtccagtcagcactttaaaccaagcatcccggtactcttttgtagctgttaagatatcgcgttgttcgggttcttcatcgggctttcgctcgaattctggtacaaagtttcgttcttcacccaatgccggcagttccaagccacgctcttctgacataagttcgatttgtttttgcaacgcctttgcttcatcaagcatactgcgggcttcttcggacttcccttcattcaaaagatttgatgcctcttgttttttctgtgtgaatttttgtctcaattcacgttcttttttcgtcatagcaactgtcattcgtatttcctccttgaatttggacataaaaaatagacctaaattgtcaggtctaaaagttcaagctccatttttaatttttcaattggggcagcacgcatttcttttagctgctccactttagccaagcttcgttcactaacaacagcctccgtatcgctataggcaggtgttgtgaccagcgatatatcaaagattctatctatagcattgattcgccgttcataaactccttcttcatcattatgctgccactcatccggctctccatttctgtaatccaaagaaaaagcaaaagaacactgattaacgactccgcttctaacattcaccattaaatccttcgcatacgacgtgtttgtagggataaaacggaatttgagacctattgcatctgtttccaactcaagcctccctacgtcctcagaaacggtatttctcgctaagggataatcctgacgatgattaaaaagcgcgactacgttagaaaggtctgtagaatccagggcgttccggctgatgatctctttaaaccatcctcccaacggctcggaccatttttcgaatttcaaagcgtatccctcaataaaatgccttttctcttcgccttcaccggcagagcgtaactcaattttcgttgtcagatgacgtacttccttgttcacttttgttttcaccccctttaactgattttgctttactcatttggtattgctcaagcgtatctaagaacgtgtaatttagagaaacaagatgacgatctccattttctatggcatttctctcttctaatgctcggatttcattaatattcaaaccgctgatgcgttccataatttcgtaatactcagcccttgattttgcatcaccgcgtaattcgctattaacattaaatttggtatagtacccctttttaatatcgtcatcggtaaacagcttagtaatgaactcttgttcaaacgatactaaccacggctgaagtgtattttttacatattcaatagattggtgttcgatattgctaaacgtcgcccgatcgagctcattgatcttatgcaaagggactttaaaaatagaggcaatctgagccttattaaatttcattgattctacaaattgcgcctcttgcaatggcattgaaattgattgataatcaagcccggcatcaataatggcaatatttctccctgcatttaccctgtcccattctctcctggctcggtccttcgcgccttcctctaacaaggtaggcactttcagaatgcccctgggagtggcatcattcttatacaacttcgcgttaaattttgtagcagctgattgagctccgacttgctctcttataacgcctattggacttttaccgttaatcccgtcctcagtcatacctttgaaatgcaaaacctcgtcagcatacaattccactctttttgaattaatgatggtttcataccacaaaattcctgtattcgggtccacatagggatgagtattggccggatttaatggtagcaaatcagtaataaaaccatttttatcaggctttaaatacgaatatccattgccccaggtacaaacatgagtcatcatgagcttcttccaagtgaaagctgtcatgtattgattcggtttaagataaagtaatgaagcaatgggatgatgcatcccgctttcgatatttccattaaccttctggaatgtatgaatcgaaagtttagcaatatcatcggataagacattcacacaggaaaacacatcaggatgaaccagtgcagtagcttcacttacacgctcaccgcttgccgttttggaaccgccaaacatatcaactatccactctggtggatcagcaaggttccaggggtcagattcgtttgatctttttgaaaacaatccttctaaaaacaattaatcacccccttttcttgcttaaaagcgcagcataaaacataaaaaagacacccgtcagaataagaccgatgtttgcgttcaaacgatatgcagcagtcagaacaaaagcagctccaatgataaatagaaaatcattcaaaaagagtagaaagcccttcaatattttcttcactcttacaccacctttagaaagagaaagaagctgactgaatataagcatttaaatcaacttcattattaatctgagaagcgcgcacatacgcattaattaaagctgctgccggatcaatacgctgagttgatttggatttatcaagcatgatattctcctgggcgtccatttttgttaccgcattacccatcgcccatgttaacaaatcatttttaggatgaatgacttttttcgccttcactttagctctaaaatcttttgttggttctgacaatgtcgctacgccctgccgtatttcaaccattgtgtatccatccgcttccatttgctgagcaaactgtgtggcgttatatggatcatagcctatttccttgatacgccagccgttttctttctccattttcttaatgtaggccctgatatagtcataatcaacaacggcaccatctgttgtcgttaaccatccccttttcttccacaagtcatatggaacgttatcagtcttcattcgttcatggaatgtatcctctggcataaatccgtgactttctacagcaaaactgccgtcatctaacggaaagataaaagatgctgccgtcaaatcaattgtttttgataagtcgataccgacatagcactctcggtttttcaagtcaggaagttgatcagatccgcagtctgtccatgcctgcatatccatatagccattttcccgcatgttaacccagatattcatgttctttgtcatgaaatttcgcattttctccgggacggcaagggcgacctccaactctccacgtaaataattcaagccgtgttcattggccgcaacaatcggatttgctttaatccaattcttctcgtctttgacgtcgtcacctttatcaagctcattgatcatcacaaaatactgttcattttgttccaccttattcggatccaatatgcgggatacataatcatattcaacgcgataagcagggttattcaattcaaatccggccgtagtaataatcagcatcaatggctgagcacgggcagccataccggaagccaggacatcataaatctctgaggttttatgagcatggtattcgtcgataatgccgcattgcgggttaaacccatcccctgttttgccagcatccttggaaagcgcctcgattttagattgagtttttggatgctcgatttttccatatgcaattcgatattttttctccggcttgttcaaaaggtcagcttgcataatctgcgccttaatttcattccagcagatttttgcttgttccgtctttgtggcgccaatgtaaacctcggacatatattcatcgtttgccattgcctcataagaaccgacacaagccaggctctgcgttttggtgtttttacgccctacctgccaatagacttttttaaatcggcgatagccggtatccttatgcacccagccgtacacattgccaaagatgaatatttgaataggctcaggtacaatattttcaccctgcaaaggccctttcgtatgtttaaactgggtcatccagtataggaaccggcgggctttttcatcatcaaacacataaggaaactcccttgtgccttcccgactcacatcatttaaaaaacgctcgcaggcccaaatgtgtttttcacacgccacaatctcacccgatatcacatcgcgcgagtaatcaatgagaaattgtttgattgtcttcatacgtttttaaactccttctccgcagtcgtcttttcccgctcttcctgggtacgggtgatagcaagttttgctcgagcagacggtgtaaggccaaagtcattcgctgctgatttcatttgatcaaaataattcttttgccgctttaataacggatgctcttcaccaacaagctttattgggttgccgtcttcgtcttttccttccgtatggaccatgatcccgtcttcttcaataattttagaaattgatacatactgcgagtaggcattacaataggcagccaacatgctgatgtctgcttccgtgatgatctcgacttcagttaataaagtagcaacccgtttgaattcttttttccctaccttatccaaccacgttggcggctttatattatcggatctcattttcatctttttctcgtgctcagcccgggcagccagctcttccgtattctttttatttgggttgccctgtatcaattgaagcgtcgcggattttgcaggcctcggcatgttctcacctcatttcacatcaaaaaaattgcatttttcgcttgtttttttcaccaatcgtgatacgatggaattaacaacaaaaccagtcgtaccaagccctctcggcaatttcgccgggagggtattttgtttttccggaactttgaaaagcggtgtttgtttgcagaagagggggcgccgttctccaaacgtttcctttccagagatttggataggggggagggtcacttgcccttaccgccatgaaccttgttgtgacaggcgttacacaggcttacaaggttgtccaagtctaatcttttcgcccaatcttcctttacttccacaatatgatgcaccatgtcagctggagtgaagcaatgatctttcaaacaatgctgacaaagataattgtctcgtatcaatgcaagttgtcttgttcgtttccaatctgttgatttataaaaacttgttattgttttgtttcttgaatgtttgttgtaatgttttgtttcttcttgttgctgtgtcttgtgtgcatcacagtaccgaccacgggtgaggctggggcacccaggggcggcgcatattcttaaagaccttggtggcataaaattcatcctttattttaaaagagttgagttctttgaatggttttatattcatttatttgcttaagatataaatttgtttatgatcattaaaaggcgactaattactatgaacccaagatttaaattgaacttttgtcgtgcaaaatatttgtatcacaataatttgacacgtttcttaaagcaaatgaaccttcttacaatataaaaaagcacctgtaggtgcttttaactactaactatttaaatagtcttgctatccttttccaattgctccaattgttttaagaattgttcatcatttatagctgaatgtaatttctcatgtgctctttccaccacatctacataggtatttctttgttctattgctcgtttcattgaagttttcatttttctaaatttcaaagggttagcaaaacgatttataggacgcacagatttatcgaattctttaaggtgttgattactaaaactttggcttaaatccaatttaacataataaaatccaccagaaaaatcctgtgagaaaataaaacctgttaagttcttaaaatctaaaattccatcttcagtaaaattaaatcgaatttctctttcttcatcagtttcaatggttacttcaggtttcgataaataattagttacttcagaaccatccttatattctagaatcagataagtctttacagctataccttttccaaaattcttaatgtgaaaaactaaggtatcacctttatcccttgttgaagaatattttgtgcttttcactataattctgggtgtatttgtagcaagatacgtttttcttgcatataacaccgtacaaagtgagagtataaccaaaccaaagtcttttattccagctagataagattctaacaacgtactatctcctttcgttccacaaaaacatcttttcttattatctatgaaatcaaagaataacaaaacattttgcaaaatttgtcgaacgttttatcggaagcagtttacagagaatacaaaaaacatcccgaaggatgctttgatgtttatctttttttcttctttttatttttctttgttttactttttcttgtggagtgttctttttcatcctgacctttattattatgttctgaatcatttacatgctttattacatttgatgctgcatgggcgacaaaaacttgaaacagattataaattacgcttttcatttcaactaggaaatttaataccaatgtaaggtataggcctattaaaaatgcagagatagattcgtttgtatccttactccaaaaagttatatgccaatctgcaggcatatatttaaaaatgaccattaataaaaaattaagaattatcataaacaaataacttacagcaacaccaaaaaaatataagttgtaaaccttaaatttactccccttatcttgatgtttgaccgtaattaaagtgatcatggtttggtcactaactaacgcttgaaaaatagcataagcagtaacaatgatagcaaaaacaggaattattatagtgttaacatttactgttaaatcggatataatttctattgcactagtggctttaaataaaattaatttgaaaaataaatataagctaactaacacaatgaataaaaaattcaatctatttcgtgagactttaaagagacctagactagccttgaataattgatttgaatttaatccttttgaagacaataccaattccttagtatgttttcttatctcatcatgttgtccctctaccatttaatcacctaatatactttagaatagacttctgtaaaagttctctaatcttgtaaacagcctgtcatatactgatttgttttcttcacttgtttctgtgaattcatctttatttataaccttcccagtaatttgatcaatattctgattgaaattttcttcatcatccagtgggataccaatcacttctgtaaaagagtcatcctttagagtcattttagttccatttttcaactctacatttattgttggtttcatcaaaccttttgtatcttctatcattgttgctacattctctggttctgttggagaattaaattggacatttcctgattttgagccaattggatctaatgcttttattaaatagtcagcggtttcatttcccatgatatcgccatttaaagggtagaattttaaagtgacttttttattttttcactctctttaattcctctttaatagcacccttaaaaggtatagatacaacatttaactgaacttgaggcaatctttcctctttagttcttgttgcattctcttgtcgaataaaagctcttattttttctctagctgttactgagaaatttgccaaagttgggcttcccttttggttcttgactagtaccattctatgattttttaaattaattatgaaaaaagaatacggatcagatggatatgtttcgttagtctttactaattttccatcaataactctcgatcttatttctaacgttgtcctttttacaattaacccagcaagaacaaaatctccttttaaattcgttaatttgacattttcaaaaaagaaatcaggcttgctatcgaaaggtttgttttctttatgacttgaatttaattcttcactagtaaatgcaggcagcaatatttcgaaaaaatactccaacatcggcttgttatcatttccaaaagtacaattaaaatttgcaatataagattgtttgttttctaacaaagactatttccccctttttattttccaatccatagaattcgacaaaaaaaggggaattcctgctactttttactcaccttttataatacacgaacatacgttcctgatcaagatttttcattaagagaacaataatagttaataaaaaattacttctgcattatacagtttgaacgcgcttggatatattctttctaaacttccaccgtactcaaactgttaaccgccaatcattctccctgagatttaagagaggcagtttacggagaatataaaaaacgccttccaaaaggaaagcgcgtacctctcaaaactttatttaattttatcgttcctctaccaaattgttcgatgacagtcccatacttttcgctttatcagtatagattttcgcgacttttttatctgataattcttttcctttttttatttcgatttttattcgtttccattcagctttcaaaatcacttgttgaattaaatttaattctttagttaaattttcatatgtcttaacattgtatttattatcttttaataacataataatttctaataatttttcagataatcttttagaaaactcttcattaggatttaacaaaagattaatacgatccaataaagctcttaattcataatgtttttccataaaatcaaaattgggtttctctttatttttttcataagtatttttattggaagaatactcataggccaacttattaaaatccacaaaatgatcccttaatttgtttacccacagaattctctgtgtacttattgtattgtttaatgctgcccttctagcgactgtccaggtaatcaccgcggtaattattgcagtagctaatggtatccagaccgaaatagaagtatttgtagttgtactcgtactcattgctttttcagccacttctatataactaatgaaatacaaatttaccactctccttaattgtattatccataaaagagagtggcaaagaaacaatttgcggaatttgtcgaacgaaagtacccttcataaataattggtagtattaaaacaaaaaaagcaccccgctggatgcttactattgtcatctttaattttcttttaacatataacattattcttctgtttgttctacttgacgctttattttatcataatcatctatacactctttcaataaaacatagacactgtatcgtttatctatattttttgttacactcctatgatataaaccccatacaattaagacaattaaaaatggtatagcaacagcccatatcactgagtgaaaaacaggtgtgaaatcaagcgaggtcaacagatctgaaatttcttttttactcatttttttatcatctaagtattttccaaaaatgctgttgagcaatgccatagaagcagtcaatacccctacagctgcagaagataaaacagtaatcatcaccatgaaaaacgagaaaggttgaacattcaaagactgactatcttttgcaatgttaatggctccttctactctgttaaacatttttttcagatcatcttcttcatgatctaaaataattgttttttgtagttccttttcttcatccattgttagattaaaaatctttccataccgattttctaaataagttagaattactttggattctcccaaatttctagtcataatatcacccaaatagaatatcgaccactcttttagaagttttaaccattttgcaaaaaaattctcataaagccagctaatctttacccccttatgctaatagcttaatttaattgatctcacacatactccgagaggaagccaagtatagcaagatcgcacaatgaaacacgataatactattctcccgatacggacgcctcagactagctgctatccaggctcagaatgttcctctcgttttggcttcattcctcaacacctttgttccgtatccgaattcgccttgataagggaaaggcgcttctcccgtatatttcgataagttttatttatctcatttcgttgataggttaagtttatcgggatttcaaacataaatagtccccctttttgtcccctaaaatgtcccttgttttatcggaaatttgtcgacaaaaaagcactcagataattccgagtgctgtagcaatgcgtaaaatggcacgctgttttatttcataataggtatccttcttcatgccgagttccatatagatatgaatgtcttttgtttggctggctgttaagtattttttctcaatgatcatccgttcttcatcgtccaggctgttttctaacgccctttccatctgtttgaccttcaattcatttaatatgaaagaatctctgatagaaggaaacgggctgataccagcgtcaacagattcctttttgttctcaagctgtactttcaaagctcgataatctttcagttctttgatcacgattttacggactgccttcaaatccacaggatgaaggaatgatagttgttctgtcacacccgtcctcctttcctctatttttcgcgttcccatttttgtattcggcgttctgttaagcaaatccataaggcaagagccactgaattaataacgaagagtgagccaataaatataatcatttcgttgtcctttcacttttcaaaccgcattccaacgcatataacatggctttaaacttgctgttctcataaggaccatatattttatttttcataaccaaaacgaactcacattcggttccgatgcatgcaaaatcccctaatataaagtttctgactacccccatctatttcaccctcgatagacgctgcacgtctgaaatggtcatttggtgatcagcttcacggactgcctcggcaaatgtttcaataccggtatcccataaaccatggcgttcgataatctcagaaaactcctcaacatcatgctcgcggattccccagctgtctggattagtggcagcgccgtacacagtcacccatttactttggtctttcgggtccggttcttcccattcttctcgagtaaaatggcaaagctcatgatctaccagggcagcgcgttgttcctccggcatcgtcttccatgcatccttattgataaacacgaaaagcatgtaatcggtcatatggcgctcaaaacccgtgcatttcttcgcctttcctgcccatttgctgttaccctcacggagataaaaacctatttgctgtttagcgtctcttaaatgtgggtggtgctcgtcaattatgctttcagccagctgccgtacttccttcgattcttcaaaacctacaaatgccatgttgcttcctccctttgattgttttattagatttacacaagcccgcctttcagcagttcccgagccatgtaatgaaagtgatgaaaaatgtaattgccggtagcgttaggactgataaaaaccgttgaaaagccgtaacgaacctcaaatgttttcaagctgcccagcaacgctttcggttcatactttgaacgatattttccgttgagtatcttttggtatccttccaggtcttccacaagaagggtgaacggatgtctggatgcccgaatcaattcattttcaaaacgggaacgatctttaatcgactgcaccagctcgtccactccgtttttccgttcaatggctgcattcaaatacatatcacggctgattccaaattcatcattcttgggaatcatggccgagtaatcgccggttttcattcctttgaacttgattgccactttctttttacggagataatcaagaacatgctgatttttttgctccctcgtatccacaataatgatcatgctgtccagaatctcttttaactcagtttccgaatagttatagtgaataattgtcatgctttcttccccttaaaatacgacatggcccgatcatagatttctatggaaagccggtccgtttcctcactttcaaagtttgaaacggattccttttgctccctccagccgttctcccaaaagagaacaagcaatttcatcaccttcataactgattcataatcatgattgaaccagtcatctatttttatatttatatcttgatcaatgcccatgaaataattaatgattttatctattgtctgtttcacattatgttcatgatccgagtaatcacctttcaaataccggataattcgctttttataagattggacaaacgcctcaagttccggatagactttctctggtttctcaatataaagatcgtttccatcaagaaccaaacgagagcccaatacctctaaatcggaacaaatttgttttgggtgcaattttctcacctctttttatcaaaacgggttaatgagttaacgaaggttaatgcattttgtattaaagccctatatatatatttatttttttattaattaattttcatgtgaggggaacaaacaaaatcattaacccttattaaccctaaaaataattaaaatctatagatagagccttaaccccttggtactaaaggatttatagcttttttctatttatagaagtaacctttttggagtcactgtttgcatttgattcattaaccccttcgttaaccctttccgaaaaattcaagtggctctgatatttgtttagccctataccataaaagaagactttatttttcgctccgttttccttcttaaaccctcgaatttcaatttgtctataaaaagcacgatttttgagttcaatctcatcattttcataacaccagtttttgtaatccttatagagctcttttgcttcaatttttgcggaaggatgaacaacacatctttctgacatatacggccctaatatatccatatcctcacggtaaccctccgtagcttttcggatcacttctggttccttaagcccttctctctgccacttcaagcagccatcaactgcccaccggagaatgcccggcatttctgctgcaagtttttgcggaagctttttgtccactttttctttcggaatggtaacagtgaatgggacaagccggatacgacgccagataccctcatcgctgcccttaacaattggtttatggtttgtcgtaaagaacactttaaattctggcgtaaactcaaaatactcctggcgcaagaaacgcgcggacatcttttcgcccccggtgatctgcttcaccaacgactcagacagttgctgtccttcttcactttcaacggccgacacaaagcgcgccccgtcgagccgggcaatgtcattgttgatgctggtatcattcttcttttttatgaatgtgtcactatttgtctgccggccatagtctcccagcagttgctggactgtattgataaacgtcgatttaccgttacggccattaccaaacagaaagaacatgacttgttccgtagtatccccggtcaatgaatagccaatagctttctgcataaaatcaataatttcatagtttggctgaccttgttcatctataaaaatactttctaaaaatgccttccagtttggacagtcggcatccttttgataagccacagaggaaattttggtgaatagaaaatcacggtcatgtggcagcagttccccagtctttaagtcgatcacaccattctcacagttaaacagatatttatgagagtcgagttcttgttttctaacagcaaccatcggccgggtatccaggatggtgttcattcgaatattgcgacgctcacattttttagcccaatcgttaagctgcttttttctgtagccgtcttccatggctttcgcttccccgtaaatggcccggagggtttgggcagttaatgcctcgatctgcctcttgctgtcttcctcccacatcttgccgttccagattaaccagtcaagctcattacagtatctgatattcttgccatggtaatatacaagcctttcagcgttgcctagctcagtcaggtgaaagaccggtggcgtgtctatgatttcctctgtgtcagcaacctgtgaggcctgcggctgcgagaaatacacttcatacggctgctcttgctgctctatcaggtcggatattgtggggccggtcgagtagatagctgcagcaatagtcatttctccatatgtagctccgtcagctgaatgctgccggtcccacttttcgcgaaacaaatttgattcacgaaacatagaatccatttttgatgcgtccttgtccgtccagaatgccaggtgattacataaagccatatccgtggaagaatgatcgccattaatcagctggccgttaaaaaggtcctgaatgctttttccatttttactgttgaacattctttcccaaatttctttatttgaaagattactcatatcgcttgttgattgtgatcgggtgctgaccggttttgcttcttctttctctgtcaaatacttatcaaagatggttttgatctctttcgatcgttccttcacaggtccaacatcaagactgtttccggtgaacgtgaaataacgaccatgcctgtatacttccaggcctttatctatattttttctccctgtgcccggtccgcgtaatggaagcttacctatcgcgataatatgaacaccctcaccactcggagagtattcagtatagctgctgatcgtctggataatctcttgagcgaaaggagacagaacaccatcatttacacagtgatctatatctattccgatgaacggatcatctttagaaaacatgaagccaataccgtcatactcctgttcattgaaaaacttcatgatagtggcaaaggtggaccaggttctcttattgcttgattgagccatgctgccgtcaatctgatatggcactttcgtttttttgccgttacgctcttccgaacgccatagaatccactgaggggcgttttttagctcttgcggtatatttttaaaatcgtacatgtattaactcccctttaaaaacgagggagccatacactccctcaaatgtatttcttgtgatcaaaatggtacatcgtcatcgctcactgtaattgagccggtatccggcgccggcgcttctgacggcttaaacgctttgacttctggatattttttgccgttatgctctctttctccgacaactaggcggatcggtttattgaggaaagcattggcccattcaatatgatccttaaatttcattccgttcgggaagcccgcggcctttgatgcttgatgaaatctccacattgcattctctgtaacagtgaaattgtcgtataggattttctggccctggcatgcctgctcaacgtcagaacggatttcatagtctacgacaagtcgcttatttccggatgaagctgctgttttttcctcaaaattaataaccgttgcctcatattctcctggtttaattggttcaaaagcttcgcctttgctgtggtctactgtgaacatgtttaattcctccaattttttgttttatttgccgtttagtacagctacaagattttgcgtaattgaatccactacatgcggatcagtgatgtcttcatttcgcaaatcataaattacactgtctatgccactattcaatctatcaatctctgaaattaaccagggcacgtcagatatggtcgcatgcccccgaatctcttcgagttttgaatcatttttcacttgactcacctccaagtacgctgtttaatctatcaatagcagcattagcaagtttgatattccattgttcaatcttctgattcgctttgatctggaactcctcaatcatttgcgcagccttttcattgctctcaatcatcattttgatgtgagtaatcaacccgatgcgttctgtttcttcctccgcctttacgtcaataccgagctcaagccactgataaagtttgcggccgacttccgggtttagtttgattgacgagccttcaaacattcgcgtattgtcttttgaggtctcagccatatgatcaatgtcaatattaaagttgagcataaactcgtattccatttcatctttctgtacaggttttgtcccaaccttacgaggagccattttgccgttattatcaggctccactacatactccgtttttgttctcaatgtcgctaagatgtgaacatcattttgcgttaacgtcttaatgagcttggttgtttccggcgcaagcttgccccagttttgaaaagagttaccggacatgctgccatgtgtttcaactattccgccttcaccctgccagttgtgtgagagtgaatcaattacgacaacctcagcaccggcgttcttaatcgcttctacagccatttgataacgctcagttgtatacggcggtgtaaaatcaatatgcttaaagctaccgatgcgaatatcatcaaactgtaaattagcgtacagttttgcgcgtcggtgctcagtatcaacgacaccgatttttgaccagattacctcgtcgcttacttctgggtatgcttcacgcatcattccgtaagctaccagtagggcgccggctgttttaccggaaccactcggaccgataaagccgacaattgccttttctttttcacgctgtgcgtttgtgacttgaaacatctatcacacctccactttgaaactgactgtttctggctgcacttctacgccggggacagcttgtccatttgaatcaattacgatcggtttaccttcaagctcagtgacagtcaatgtcttcttaagatcaccccatgccacagactcttttataaactcctccataccggcatccttcacatgctgcagaagcttttccttgtccacttctttaggcgctgcttttgttgtgcggcttttagatttcccgtaaggtgtggaaagtgtttttgccttcggatcatcctgcagctgctttgtatgatagacactaaccaagttttcaaagaatgatagattatcagctaaaggcttaagctcctgcctttcccattcttcaatacgttgtttttctgtggttgccagcgctttgatttccttttcctgcgacttaagagcagctatttttcggaaagcccagttcaggctgttcatatcagtaatttcaaactgtggacggtcccccggcagtttgccgttattaatttcatttagttcaaaatccagcaatggattcatatgagacaccttcctctatttgattttgttgaaagttccatttaaaatggagttgcttttgtttttataagtccacattgccgtgtgggcttttttatttatcttcttcatcggcatcctcttcccgatcccggtcatactggagatactcttttggataaccgtaacggttaatttccgttatgatcggatgctcaagattcatatactggcctctttacgattgagacatctagacctttactcagaaattgagttgcaatttcatgtagctgaacgacttgttcaggatgatgcatccgtttgatgtctttgaacatttcagcagctgacaggcaaagatcaatacattcatcgaaattgttgtccttaatttctttcggtaaaagttcctgtagtaagaactgagcagaacccaatttacgtttcgctaattctctatcctgttttagaaagttattaagattcatagtttttccccttccaatttactggtataatgttcctatcaaaaattaataggagtgcatcttttttggaaacatcaacaataatctcgatagttgcaatagttatttctttatttactctgggagtacatttactcaagtatctacatactgttccaaaacttgaggtttctgttttagacgcttttgtatttcaagtcattaaaggtgaagaccgttatggaaagccgtatagaatgattattgaactcactcttgtaaataaaagtgaacaaccaatctctatctatgaatatcaatttgtctcaaaagaatttgatagacctgttttttacagaggacatcatagacctggtaataaatacactatttcaaaaataggcagtgaagaagcctcaattgattttgaacaatttaaagatcttaagccacctataaatcttagtccctactcttcagagtacggcacaatcattttcttaacgattccaaacctctatacatcagaaaaagaaattgatggggtactcacagttagaacatcaagaaaagactattcaattcctgtaaaaggaagaagaagtgactttataaaagggacagaattaatgcagtaatagataaaatcaaacaaacactactgatgataattcctattaaatgaatttttttgtcatccatatgaccacctctgtttctgcaggggttttttattgtgcatatacctttaattccttggctgctccgaaagccatttgagtaaaaactctttacattgcttttcaggaaacaaccattttttaccgacgcgatatttcgggaatctttcatcataaaaaaacgtttctttgatgaaattcaggctcatattcgtttgcctgcacaattctttcatatcccaaaaagtgtatgagtctctaacttcattcaacgcttcttcgattttttgaatacaaagctgctttatttcttcttcatttacttgaacagagaacaaaacttaccacctccccttctgttatgctgattggtgttcgttatcatcgcactcgaaaagatattcgatattacactcagggaaaaaatgtcgtttgattttcaatgcttcgttataataaaaacgatattttccattcactttgtcattaacagtcgcataacgaacatttaaaaaattagaaatgtccaccatcgtaattccttttctagccatttctgcgcgtaaattattatgcattctcagattcacctcctcaacaaacgcaattgcgtccgtttgttattctcaatatagacgcattttcgtcctttgtcaacaaaaaaatataaaaaatggacgaaatttcgtttattgattatttacatacgcaatttcgtatagtattattgctatataaacgatttttcgtataaattgtaaaaaaggagttaaacaaattggataagagaacagagatcatagaacggttaatagcggactcaggattaagcaaaaaagcttttgctgaaaaaattgggttacctccaacaacattacgctcaatgctttcaagaggagttggtaatgcatcagtagataatgtaattaaagtatgtaagggtttaggtattacaaccgatcaattagaagatttggcaggtagtgatactgatgaaattaaaacaattgcagcacatcatgacgatgaggattggacagaagaggaattagaagaaattcgtcgttttaaagaatttgttaaatcaaaaagaaaaataatcaggagtagtctgcaaatgagttatgagaaccttttaattgaatcagaaaaagcagccgtatcagtatacgagaaaaaacttagtcgaggtataaaaggtttatatgcagatggtatcgtttggataaacaaaaagttatccaatacagaaaaaaagtcattctagctgaagaattaggccaccattatacaacggctggacatattctcgatcaaacaactgttcaaaacaggaaacaagaattgagagcaagaaactgggcttacaaaaaattagtacctctaaataaaattgttcaagcgcataaatcaggtgtcaaaaatcgttacgagctggctgagtttttaaatgtaactgaaaaatttttagatgaagcgatcaaaagatacactgaggaatacggggtatttaagaaggtaggagaagtaacactatgctttcaaccactaggggttattgaattgttttagacttctgaataaaaaaatttaaccatcaaatcgaacgtatattctgtaagaggtgatcatttttatggcaagttttcgtaaacattcaaatggaacatgggaatatagaattcgttacaaagatcctatcaatcaaaagtttaaagaaaagtccaagcgtggtttttctacaaaaaaagaggctcaattggctgcagctgaaacagaaaaacgaatctttaatgatcttgaattggataatcacccctactatcttaaaaattatctgcaagactggttaaaagaatataaattaggatcagtgcgcaaaaacacttttgaattacataaaagaaacataaataatcatatcattccgtacttcaaagatattgatattaaagacataaagccaatcctctaccaaaaatttatcaaccacctttgcgaacaaaaatatagtaaacgaaccatcgaaattatccatggaacaatgcgaaatgcaatggagaaagcagtagtattaggaaaactcgaaaaaaacccttgttatggtatcgagattaaaacaaataaaaaacgagaatacaatatggagtttatcaatagcgatgacatacctctttttttacgtgtagcatatgaatatggttatatgtactatattttctttaaaactctcataaatactggcatgcgtaaaggcgaggctgctgctttacagtggtcagatattgatttaaaaaataaaaccatctcaatttctaaaactctagattttaaagcagcttcaaaagatgaattatttggtgaccctaagacttatacatccaaacggattattactattgatcaaaggttggtaaatgaacttcacgaacttagaaaacgacaaaacgaagataaacttcagcttaatgagatctatcaccatgaccttaacttagtcttcactcgcaaagatggttcacatttacctaaatcgtccttgtttaatgcttttgtccgaatactaaataaagctggtctagagaaacttcctattcatgcccttcgtgacacacatgctgttttactccttgagtcaggtgcttcaatgaaatatgtacaagaacgactgggtcataaaagtattcaagttacgtcagatatttactcacacatcagcaaaaagattgatagggattcaatgaataagtacgaagattacatctccacaattatggagtaattttttattgttttttgtgggtgttttgtgggtggtgtatgatttatattaagttattaaaattgttaaataattaaagaatcccctgacaccaatagtgccaagggattgagagattaatactgagacatatactgttcgcgctcccaaggatgaacttgtgtgcggaacatatcccattcgatttcttttgcttcgatgaagtgttcgaataggtgctcgcccagcgctttgaccatgacttcgtttgatttgaattcttctagtgcttccgcaagtgttgctggaaggtcaacgattccgttttccatgcgctcttctttgctcatcacatagatgttgcggtcgattggagccggcgcttccagtttgtttttgattccgtctaatcctgcagcaagcaatacgctaagtgcaaggtatgggtttgcagctgggtctacactgcgtacttcaacacgtgtgctgatgccgcgagaagccgggatacggataagcgggcttctgttttgcgcgctccatgctacataacaaggtgcttcatagccaggaacaagacgtttgtaagagtttactgtcgggtttgttactgctgtaaagcttgttgcgtgcttcacgatacctgcaatgaagtgcttcgctgtttcacttaactgaagatctgcgttttcgtcaaagaatgcgttaacaccatttttgaagagtgatagattgcagtgcatacctgaaccgtttacaccgaacaatggttttggcataaatgtcgcatgcaggccgtgtttacgggcaattgttttgacaactagtttaaatgtttggatgtcatcacaagagcggactgctccagcatatttaaagtcgatttcgtgctgaccaggtgctacttcgtggtgagacgcttcgatttcaaagcccatctcttcaagctcaagtacgatatcgcggcggcagttttctcctaaatcagttggagctaagtcgaaatatccgcctttgtcgtttagttcaagcgtcggctcgcctttttcgtccaatttgaataagaagaattcaggctcaggcccaaggttaaaatcactgaagccgaggtcttccatttctttcagaatccgttttaagttgtttcgcgggtcaccttcaaaaggtgtgccatccggattgtaaatatcgcagatgaaacgtgctactttacctttttcagctgtccatgggaagataacaaatgtatttagatctggatacaggtacatgtctgactcttcgatacgaacgaatccctcaatagaagaaccgtcaaacatgactttattatcaagcgcttttccaagctggcttacaggaatctcaacattcttgattgttccaagaatgtcagtaaattgaaggcggatatacttcacgttttcttcttttactaatttttcgatatcttctctagtgtactttgccatttggtaaaattcctcctcttaaaaggtaaatgtatatagcaaaacagttgctaacggattaatgaaagaagcgggacatgtcgccttgacggaatgtattccctctttgaaaacggccggcttgcatgagctcgtttttcaggagctgtctcagttcgtcatcggacagatcatgtttcattggttttttcgtcttctcgttttgtttttgttctggctcggcttcggctttcgccagaatctgtttaattcctgccatgtttacaccttgttctatcaggtgcttgatttctaacagtttatctacatcatgaaatgaaaataatcgtctatttccttcacttctggctggaaatatcagtccattttcctcataatatcgaatttgtcttgctgataactcagttaactgcatgacaattcctattggaaataaaggcattgagcggcgaatattatcactcatctcaatttcctccttttcttaacttagtttcattataggtgatgttatattatgtgtcaatacgatgtaaggattcttaacatcaaatccagagaaatttttaaaaaatttaaattaattgcttttgcatcaatgaatccactgcactgcatatggcattcttcacatgcgaataggttaatcctccctgaacatacgctacatacggcgggcggatagggccatcagctgataattcgatgcttgctccttgaataaacgtccctgctgccataatgacatcatcctcgtatccaggcatgtaggctggataaggcgtcacatgagcattgattggcgatgcaaattgaatagcctggcaaaaagcaatcatcttttctctgtcagaaaactcaacggattgtattaaatccgttcttttcgcatcccatttcgggtttgaagtgaagccgagtttttcaaggaatctcgctgtaaacaccgctccctttaaactttgagacacaacgtgaggcgccaaaaagaagccttggtacatttcttggagcgagtaaagagatgcccccgcttctctgccgatgccgggtgacgtcatacggtatgagcaagcttcaatccatttcgcttttccgacgaggtagccgcctgttttcgcaaggccgccgccgggatttttaatgagagatcccgccatcaggtcggctccgacatggcaaggctcaagctcttccacaaattctccgtaacagttgtccacaaagacgatcagattttcattgatttcttttacaaaacggatcatttcttttatttcactaattaagaaagaagggcgattcgcatatccttttgagcgctgaatgccgattacttttgtcttcggattgatcgcagcggcgactgcatcatagtctatctttccgtctttcgtcagatcaaccgcattatagccgatttgaaaatcctttaacgaaccagcgttttctccacccctgacgcccacaatttcctctagcgtatcatacggcttgcccgtgatataaaggagctcgtcccccggtctgaggacaccgaacaaagcaattgagatggcatgtgtgcctgaaatgatttgcggccttacaagccccgcttctccgccaaacacatccgcatatatgctttcaagcgtgtctcttccgatatcatcatagccgtatccagtagacggcgtgaaatgagtgtcgcttactttgtgttttctatagctttgaagcactctccactcatttcgctcgctgatttcttctatttgtttatgaatgccggcaatgtccgcttccacttccattgccgttttcttcaataattctccgtgtgttaatgtgtcaaacatgtctttatatttccttcctacatatacttctttaattcaccgatgatactttgctcttcttggacatagccggatatgtcatactgttcattttcttcattaaaatagaagcggtctaccatcgtttccgatttgattctggaaaggagcttcccttcacttgccggcacatgtgcttcaaaagacgttaacagttcttggcgcaaatagcgctgaatcgcttctttaaaggctgcagcgtcgtcctcaaatttcgcactgaccataatgtgatcccttccggcggtcggtataaaatcaggcagtttttgatcacgtttattgtaagccgtcagcatcgggatatcatctgcttcaagctcctcaagcagccgaagcactgttttttcatgtcccgcataatcctcatttgaagaatcaattaaatgcagaattaaatccgcttcttttacttcctcaagcgttgagcggaatgcagcaatcaatgtcgtcggaagatcctgaataaatcctactgtatctgaaagaagaacactgtagccgcttggcaggaccatttttctggtcatcgggtccagcgtggcaaacaggaggtcttcttcatagctgtcagcactcgtcaggcggttgaaccatgttgatttccctgcgtttgtatagccgacaagcgcaatttgaagcacaccgtttttctttcttctttcacggtatcggcttctatggcgaatgacagtggaaagctgtgtgttgatttcatgaatgcgatttctgatatggcggcggtcggtttccagtttcgtttccccgggacctcttgccccaattcctccgccttgccgggaaaggttgatcccttgtcccgtcagacgcggcagtgcatattgcagctgagccagctcaatttgaagtttgccttctctcgttctcgcccgctttgcaaaaatatctaatatcaattgcgtgcggtcaatcatcttcacttcaattgctgttgccaatgacttcagctgacttggcgacagttcatcattaaagatgaggagatcagcttcaagctcttccacgagtgccttcagctcttctaccttcccttttcctatatatgtagcggcgtcagccctgttccgtttttgtgtgacgctggtcagtacttttccgtctgctgttttcgtcagagatgctagctcttccatagaattttcaaaatgctcatccgtgatatgcggcagctgacatccgactaaaatggctttctcctgaatcgtttcttgttcgttcaaatggatgttcctttcttttgcatattgggcagtagtattatcataccaaaccctgcatgtgtataccacaaatcgattgctttgaaaagcggaaatacgagcaaaaaacagacctctcaaaaactgagaggtctatgcagatccagatgcttcttctttaatggaaagatcttggcttttgatggtcatcaagtcgctttttaagtattggtctcccattaaaagcctcatggcttgtgctctgatcgatttttcgatcacatttctgacaaaacgtccattgctgaatttaatgggacttgtcgtgcttttcactgtcattaagtaatctttcaatttccattccgcttcttgactgagctggtattccctttcatcgatcattcgtttcgcaatctccatgagctgggtcacagagtaatccggaaaatcaatggagatgggaaatcttgattggagtccgggatttaacgagagaaaatgatccatttcccgtgaatatccggcgagtatcaaaataaactcatgctgtttgtcttccatatgctttacaagtgtgtcgatcgcttctttcccaaagtccttttcgccgcctcttgccagcgagtaggcttcgtctataaacaaaatgccacctaatgactttttgattaaatctctcgtcttttgggcggtgtgtccgatatactccccgaccaggtcagcccgctccgcttctattaagtggccttttgacaggacattcatttcaaagaacagcttgccgatgagccgtgcaaccgtcgtttttcccgttcccggatttcctttaaacatcatgtgcagcgcttgctttccaaccttcaagccttgctccgcgcgtttttggttcacaaaaatccaggcgtatatttccttgatgttgcgtttcatttcctccatcccaactaatgcgctcatctctttttcgatttccttcaaaatgccgtgctttgcttcgtttttttgcaatgcagcctgatattccgcctctgcctcagcattcgtcagcacctgcttttgcccgttcagaataatgttgatctgtccgttgtttttataagtcacagcgcgctccaacatcttcacctctctgttctctctatatgatattcaagcggatgccgattgtgacaaacgcctatcatgtgtcgaaacaattgcttttttcgggaacaataaggaatcctgcgctttcccgagaaatactttatttcttattgtattcacggacatggggtggacaaaccatgagattttgtttttaatcattttgtcagagtattatagtgagcttctttctcattatttctttttcatacaacgggctgatttttgtacgaaacgtattacccgccctaagatacctgaagtgtttttctttttttcgatttataaagcggtgtctttaatgaaaggagctttcctcatcaatttacgttttaaatgcttgatttaatatgaacgcaaagcttaaaaccagcaggaatcagtgcaggttaaccgaacccatagtacatacaaacatatggcgtatgcacagatttcatgtcggaccgtatctgttgtcgcttcatgttgaattgtgcgctttcccgagaaataatttctggatgtgaaagggttatttcctcatttttcagttgaatgataatcgtacaagcagaagccgtgttttttcatatcctgtaatgaggtgatgaaaaatggttaaaatttttattgatcctggccatggcgggtctgatccaggcgcaacaggtaatggccttcaggagaaaacgttaaccctgcaaatcgctttagccttacgtacgatattaactaatgaatatgaaggcgtttctctgctgctgagccggacaagcgaccaatatgtcagcttaaacgaccggacaaatgccgcaaataactggggagcagatttctttttgtccattcacgttaattccgggggaggcacaggttttgaaagctatatttatccagatgtaggagccccgacgacgacttatcaatcgacaattcactctgaagtgatacaagctgtcgactttgccgatcgcggcaaaaaaacagcgaacttccacgtcctaagggagtcggcaatgcctgccctcttgaccgagaacggcttcattgataccgtttccgatgcaaataagctgaaaacgagcagttttattcaaagcttagcgagaggacatgcaaacgggctggagcaagcctttaaccttaaaaagacttccagctcagggttatataaggttcaaatcggcgcatttaaagtcaaagcgaatgccgactcgctcgcaagtaatgccgaagccaaaggttttgactcgattgtccttttaaaggacggattatacaaagtgcagattggcgcattttcatccaaagacaatgcagacaccctcgctgccagagcgaaaaatgccggctttgacgctattgtgatcctagaatcatagccgagacggggacgagcgtctcataaaaaaacccggctcctcatcgcgagaaaccgggtttttttattcaagaatatcaacaacaaactgtgaccatgtttccagacggttgtagatatcatcctgttttaattcagaaactttcatccatttacccgcaatttgttctttctccttcacttccacttgtgcgccaggctttaattgaagcgcagaaagaataccgatatgcactttgccaacactgttttcatcatcattgatcaatcccagtgtgacaatcgcctgtttatcttcttcatttatttgcagttcttcctcaagctcacggtctgtgttcagctttaagacttcagcaaatgaagctgccccttcgatggcgttcatatggccgccaaaaccgagagaaagcttgttgtgcagacgtgattcaccgccgccagccagccgctcgtaaagaaaaacttcatcttcacgcttaatgacgacataaggtatcggctgcttgaaacgcggatcttcttctgcgtcccctcttctcatttcacgataggccgcttcaatctgagccatgatttctgctactctgctatcttcactgtacacgccctggaaggttaagctttcttttttaaacacatcatcgcgcggggcaactaaaatcatttcgtccatttttcccatgggtactgcgtcctcctcatttgaaccttcaagccgaaaagagcagatattatatctgctctttttcatcttcaaaataaaagtcatcatctttgagcggctcaactgtcgcttttttatagccattccccttcatagagaagaagtcatgcgattttgtttttgtgtttaatccgtttaaaacgatcggattaatgtcttcctcttcgaagtatggatcaaatccaaggttcatcagcgctttattcgcattatagcggatgaatttctttacatcatgtgagagcccgacttgatcgtacaagtcctctgtatactcaagctcattttcatataactgattcaggaggtcgatcgcaaattcacgaagctctgcttttttctcttctgtctgtttattataaatttcctgagcaaggagaccgacatacacgccgtgaatcgcttcgtcacgaaggatcaggttaatgatctcaccgctttgcatcagttttccttgtccgtagaaatataacggataatagaaaccgctgtagaaaaggaagctttccagatagacggaagcaaccatggctttgaacagtgaaatttcatcatctttttgaatggctttgtaaagcccgacaatcatttgcgcttttttctgcaaatatttattttgtttaacccattcaaatacttcattgatcgtttcagtcggtgcaagggtcatgaaaatattagagtacgacttcgcatggacagcgttctccatcatcgccataaagttcagcaccgctttccgctggtggccatctacgtgttcagccacgatcggcatccccgtattcccctgctctgtgtcaagaagcgtaagtccggccagtaccttcatataagtgtcctgctcattttttccgaggtacttccatgtgaggagatcgccgtttaaagcaatctcttccggaagccagaactgtttcacgttttggttatagaacatttgggtaaaatcgtcttcatgctttgaccagtttgctgcgtcataaatttttgtcactataaactctcctttaatcaaacaacacaagaaaggcagctgtcttgcccagtatctttcgttcttgcatagtaaatggttttaattcctctatgatgtgcatacagatcgattcggtttaaatctcgggtcgtcattgtgtcttttaagaacaatgtaaagctgattccctgatcaatgtgctgctggatagtggcgatcatatccacaaccttgaacatgtccatatcgtaggcttctttatagaagaaccagttattagatgcaagcccaggcattgggtagtacgtttttgagttgccgtatgttcgttcttcaatccgttccataatcggcataacagacgccgtgcttgattgaacgtatgagatagagcctgtcggcgcaatgcataatctgtagctgtgatacataccgtgttcagcgacaaatgcttttagctttttccagtcctctgtcgtcgggatatgcataccttcaaacagattagcgattttttcgtatttcggtgagaaatcagttgaaacgtatttgtcgaagtattcacctgtcgcataggttgatccttcatattgatcaaacgtttcgcccttctcttttgcgatttccgcagaacgctggatggagtagaaattcaccatcataaagaacgtgtttgcaaagtcacgcgcttccggactttcatacgcaatgccgttttgcgcaaggtagccgtgaaggttcatagcaccgaggccgattgatttcatcgctttgtttgcccgtcttacagcaggcgcattacggatgtctgttgtttcagacacgtgtgttaaagagtctgtcgcaagcttgactgtcttttcgattgatttatgctccatgacattgagaatgttaagcgaacccaggttgcaggaaatatccagaccgatttcatcttcttcatcatagtctgtgtatgaagaaacttgagatgcctgcagcacttcagagcaaaggttagaaaatttgaccttggaaatatggttattcgcatgcactttattgacgttatcttggaacatgatgtatggatagcctgattcagaacgaagcatcgccaatttttcaagcagtttccgcgggttgattttttcctttttcacccgagggttgtcgacaaacttgtcgtacatttcgttcatgtccatctcatccatgtgctggccgtactctttataaatcgtgtgcgggtagaatacataagccgctttgtcctcgcgtgcaagctcaacgaacttatccggaatgacaacaccgatcgaaagcgttttgacacgcacatcttcatccgcagaaatctttttcgtatcaagaaaatcattgatatcgcggtggaaaatgtttaaatacgccgcgccggagccttgtctttgtcccatttggtcagcgtaacggaacgcgttatcaagaagcttcatgacgcctacaacgccttttgtcgcattctcaacatctttaatggcttcacctttcgcgcgaagcttggacaggttaagagaaaccccgccaccaagcttagaaagctgcatggagatatcgattgctcttgaaatgtcatttaaagaatcattaacttcgagcaagaagcagctcacaagttcaccgcggcgttttctgccggcattcaaaaatgtcggtgtgctcggctgatattcttgattgatcatcaggtttacatattcttttgctttctcagtgtcgccgttagcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaaccaaataatccagcttctcttttaaattgtgaaagaagactgtgttttgattgatataatctacaaaatagctatgtacagcttctttatccttatcaaactggaatttcccatctttttggatcatgatttcgttatttaactggatccattttggcacttgattttgtgacaactctttctacctcctgagtaaacaattcaacgtctttagatgtgccgctgagttcaaatttgtgcaagatcggcacctgatattgtcttgaaatggtatcggcgctttttgcaaagttatcgccccatactttgttgccgctcgcagcgactcccaataagagatgggcgtatttttcgagaaatgattgtgttgatgccggtacctggccgaagtttgtcgtgtaggtgaccaaaacaaacggagtgtccacgtggtccatttcgtccaccttgcgtatctgctgaaagcctgttttattcacaaaccgctgaacattccctgttttcgaatcaaatatgatttgtaccacgttttatcacgacctatcaaaaaatatgaatctctcatcactaacactatatatagtatactaccctctagcaaaaacacaatatatagattcgtttttatgaaaaattcatattttgatcaaatcaggcaaacgggcagactcattagggcccaaaaaagagagcagaacgagaatcatctctcgtcctactcggggtgtcgtttttagccgatgtatatcataacatgaaaaaaactgcttagtagtctagattttttttcttaagctatcacagcatttttcgctctctactgtttcttctatttcaacatccgcgccgatctcttctaaaaccgccttcaaagcagtgataattgacgcttctctgattaattcttttccgttcacaatgatacttgttccgtattcatagcaagaatcatcttcgcaaatttcttcccaatgattcacgatcactttatgcttcatgttttcaccctctgtttgatctgtgtctgtatttagtttagcggctggcatccgctttgtaaattcgaatgcttgtgaattttattcaagctcatcatccgcgtattctttcttcagctttacctcattgcgggactcattatactcataaattttgatatagccgtcctccataacgccaaaatggttatgttcaagtggaaacgaggtgggctgaggcgtttcatagtctgaattgccgttgtctgtttcaataatggtatcttgattcccgcacgccccgaacagtaaaaagacagctatccatacaagtgcaatcctgattcgtctcagttctgcttcactttcaaacaagatcgatcactcccaaattcattttatacataatataccatttttacttccgtatgttgttctcataaaaaaagaccgtgccttggcatggtcagcttacacaaaaagcttggagcaaaagtggattcatgttaaaaatggccgccgggaacccccgacagcctttcctcatgtcttgacatggcattttttgatctattcgagttcaagctggacgtttttttgcggcgcaaacgttgagatcgcatgtttatatataagctgctgcttaccttccgattccaacaatacggtaaagttatcaaagcctttcacctggccccgcaactgaaagccgttcagcaaaaaaacagtgacatacgtattttctttccggatttgattcaaaaactgatcctgaatattaatcggtttcatgtttcgtcctccttgattctctatatcatacagtttcgattaaagttcgagttttcctgctatatgtgtgaaaatttccttttttttcagctccatatcaacaggcggtgtcatatcgaaccatgtgacctgcattttgttgcgaaaccacgtcagctggcgtttcgcataccgcctcgagttctgctttagctgttcgacagcatcggaaagtgtcacaaaaccgtcaaaatatgcatacagctctttatagcctatcgcctgtattgattgacagtctctcacgttcttgtcgtataagcgtttcacttccggaagaaggcctgactgcatcatcaaatcgacccgctgattaattctttcgtaaagcgtgtctctatccattgtcaggccaattaacactgcattgtacagaagttctcgtttttgttccttcaaatgctgggacatcgtttttccggacgtatgtaaaatttccagtgcgcgaatgactcttcttgtattattcggatgaatcgcagctgctgcctcgggatctgctgcagcaagtttggcatgaagaaagtcagcgccttcccgctcagcagccatttgcatgctctctcgaaacacgggatcatttgcctcttccgtaaatgtataatcgtaaagcacagattgtatataaagccctgtaccgccgacaatcatcggaagctttcctctatttgcaatctcgctgattttatttcttactaagctttgataatcggcagtagagaaagagtcttggggatctaaaatgtcaatcagatgatggggcactccctccatctcctgttcggtaattttagctgttccaatatccatccctttataaatctgcatcgaatctccgctgataatttccgcgtttaaggatttggctagctgaatacttaaattggttttccccactgccgtcggtccgactaaaatgacaacgggctgcttcgtattattcaatatgtatcactctcttttataaatctccccccattatagcattcaacatggacaaccacctatccattttgccctttttttgcatcggtaaacatccttctaccagccgagcggctcattgccgacaatttcccttgtctttcctttcagggtatgacgatgcgtttttcttctgtcatctccgggatcgtacacaacccctccgtactggatctcaatcggctcgttataggccagatacgtcgtttcttcgatttcatgataatgtgtgccatctgctaagggaatcgccggtcctgagattccgtaataccgatgaaaatggccgttttcaaatgaagtgatccctgtatagtaatgtgtatgctgatcggtatttgatccgtttgccggctgagtaaacccttcgatgagatgataatggccctgttctctcgttgttttgacatgataagcatgtgcgtggggcggtgcttttgaccagtcagactgatacaggcccaatgtgttcacatcctccttttcctcgattcgcccaatcaaatccgggcagggtgaatacactgcatcatctacactttattacaggaggaaagaaaacatgaacgagttagagcatttcagccctgaagatacaagaatatttggaaggccgttcggattcgggagaccatttgggtttggaagaccgttcgggttcggttacgggtttggaagacccggatttggttatgggtttggccggccattcggattttttggaggaccgtttatcggcggccttgcaggcgggcttataggaagcgctttatttaatccttatttgtatggcggatacccctattatccgtatgccccgttccctttttattattaaacgcaaaagaccccttaaaaaggggtctttttaagtgtgtgaaaatgaatctcttgactcatacataggcatacactaatatttttctagctgaagttttttttctaatctaaaaatatagtgaggagaattcatgatgttgataggatatatattcctcacgattgccatatgttcggaatcgataggagcagccatgctgaaagtatctgatggcttcaaaaagtggaagccaagtgctttggtcgttattggctattccctcgccttttatatgctgtccctgactttaaaccatattcccctgagcctctcctatgcgacttggagcggggcaggcacggtgctgacgacagtgatcggagtaaaatggttcaaggaagatctgaatgccaaagggcttatcgggattcttttattactatcaggggtcgtgttacttaattggccgtaaaggagtgatgaagatgagaggattgctttatttggctctcgccattgtatctgaagtgtttgggagcacgatgttgaagctttcagaaggatttacacaagcctggcccattgccggagtcatagtcggatttctttctgcttttacgtttctaagcttttctttaaaaacaattgacttatcaagcgcgtatgcaacatggtcgggcgttggtaccgcgcttacagcaattgtcgggtttttgctttttggcgaaaccatcagtttaaaaggtgtattcggtctcacgcttgtcattgcaggcgtggtcgtgctaaatcaatcgaaagcccacgctgaagataaaaaacagacggcctgtgagtgaccgtctgttttctttattctccacccagtttcacagaggcttcaagctgcagctcgacatttccttgaattgcacgcgaaatcatgcatgacgactccgcttttttacaaagtttgtgcgccaatgcgacgtcgtcttgtgaagcatcatgtttaagcacgacagagggacggtgaatgatctttttgtatgtaaagactccttttgtaacgttgacaatgccttctgactccatctgtaagtcttctttttccagcccgcttctctccatcatcgctgcaagtgtaataatgtaacaggtcgctgccgccccgagaagcatttcatctgggttggtcccttctcccgggccatccatttctttaggaatggaaatcgatgtgatcaggtttccgctttcgatcgtaccgacatcattacggttacccggccagttcgcttttaaataaaaatgatgatctgccattgttttgcctccttttttatcctatttcagtctactgatcttctcttattttgtcttctgatctgcttgttacgaatactctttttccaggacacctttgatcgcactgacataagcataaaattcactgttctttgtgtattttctatttttataataaaaatcatcaaaaaatgcttctctctgctcacggctgatttccagctggatacttagccccgtttccccttggttattaatgttttcggcattcaatccagcaagaccgcttttagacgacgctaactcagcggaaaaccctctccgctcaagggctctcacaatcattttcgcccgctttcggtctgttccccctacaagggtattcttgttctctcctttatatccgtgaaaagccaccacatattgatgctccttgattttcttttttgccaatggctcatcaaagttggtgcttgtaatgtgcagtgtttggttatcatgggacttcaacccttcaaataggtatgtagagtattcattattgaaataacgcacaagctcacttactccgccttcaattcttccgccatgcggagacataattaagactttgcttccttttttctcattatatgaaatatcgtaatcggctgggctctcattctctgccaagctgctgaaatttgaatatgtatctggctgatttgatggttctggttccaatgagtaatgaacatatctcaagaacaagacaatggctaagactaatatgacatttagtaaaaatcttctcatgtttaactcctttcataagaatggcgcggttcattatatgaggtttagccaataggttttatcttaccattgtatacacaatatcatcagtgaaaaagttcccggtttcaaaaaatcaattgattgtcacggttattagcggttcatttcaaataagagtgaaaaaaggttgagaggaaagacaaaaaaggtaggaacaacctcacttggcaaataaatgtatataggtttaaggagggttttagtaacaggctgcccggttgctgagacggacagctgttaccggcctgcagaatagagattttgcttatttgttctcacaaaatcacaggagaggatagagtccaataaaaatgttctgatctgttgtttcgaaaaacaaaatgctttgattttcgttttgcttttctgtctcacaataatcgttcttttactaatcgttccgtctttcttcatatataatgctgattggcatttggctttccaaagatcggtgcaagtagaaattcatacggttgctctccccttcccagtttgatatgatcacattataatacgaacaaacgttctttttcaatccccaatgatttcctcagcttctgaatctatcgtatctaatgcgaaagattcagaaaaacaaactcttgtctgtctcttacagaggacaaacaaacttaccaaacctatcatctgttcatagagtatacagagaaccttataataggaggaaaatacatgtttgggtactctatggtacaaatggtgagagcaaatgctcacaagctagattggccgttacgggaaaccgtattgcaactttacaagcccttcaaatggactccttgcttcttgcataaatttttcgaaaccaaattgcaaaacagaaaaaaaatgtcagtcattatcgaatttgaggaaggctgtcacgagaccggctttcaaatggctggagaggtgctgcaaaaagaaaaacgcagcaagctaaaaagccgcttcaacaaaatcaactgctgcagcgccgaggttactccttcagcattacattcccttctctctgaatgcagcaatatccgtaaagtgtatttaaaccgcgaagtcaaagcgcttttagacacggcaaccgaagcaagccatgcgaaggaagtcgtcagaaacgggcaaaccctgacaggaaaaggtgttactgtcgctgttgtcgatacaggaatctacccgcatcctgatctagaaggaagaattatcggattcgcggacatggtcaatcaaaaaacagagccgtacgatgataatggtcatggcacacactgtgcaggtgatgtcgcaagcagcggtgcatcctcttccggtcaataccgcggacctgcaccggaagccaatctcatcggcgtaaaggtattaaacaagcagggttcaggaacgttagcagatattatagagggtgttgagtggtgtattcaatacaatgaggacaaccccgatgaaccgattgatattatgagcatgtcgctcgggggcgatgcccttagatatgatcatgaacaggaagatccgttagtcagagcggttgaggaagcgtggagcgcagggattgtcgtctgtgtcgctgccggaaactcaggccctgattcgcagaccattgcaagcccgggcgtgagcgaaaaggtgattacagtaggtgcgcttgacgataacaatactgcaagcagcgatgatgatactgtcgcttccttctcaagccgcggcccgacagtatacgggaaagaaaagcccgatattttagcgccgggtgttaatattatttcccttcgctctccgaattcttatattgataagctccaaaagtcaagccgtgtagggtctcagtactttacaatgtcaggaacctcgatggcaacaccgatttgcgcaggaatcgcagctttaattcttcagcaaaacccggatcttacccctgatgaagtaaaagagcttttgaaaaacggcacggacaaatggaaagatgaagatccgaatatctacggagcgggcgctgtcaacgcagaaaattccgttcccggccaataaacatcatcaaaagccggcaattctctctcagcagaactgccggttttttcgtttgaatattcataatcataaggtaaaataatggaaaatagatgaaggaagtgaagaaagtgccatattatatctgcaatacatgcggtgtgcaacatgcacagactgtagatccgcccaactcgtgtctgatttgcgaggatgaaagacagtatattcatcccgatggacaaacttggacaacccttgaagacatgcgtgagaaaggaaaccttcaaaacatccttaaaaaggaagaagagcatctttacagcatcaaaactgaaccagagtttgcgattggacaaacagcccatcttattcagcataagggcttcaatgtgctgtgggattgcatgacatatcttgaccaaaagacaattgaccaaatcaacgaattaggcggtattcaagccatcgccttgtctcatccacattattactctactcaggttgagtgggctgaagcgtttcaggcgccgatctatatccatgaggatgataaagaatgggtgacaaggccaagcaatcacattcacttctggtcaggggaaacgctcaatatgaagccgggactggacctttaccgactgggcggacattttaaaggcggtgctgttttgcattggagcaagggcaatgaagggaaaggctgtctattgaccggagatatcattacggttgcggcggatcgaaactgggtcagctttatgtacagctacccaaatctcattccccttcccgcctccaaagttgaagaaatagcagccaaagtaaaaccgcttcaattcaaccggctttacaatgctttctctaaagttgtcaaagaaaatgccgacgaatcggtccagcgttctgccgtacgctatatcaaggcactcaacagcgaactgtttcatacataaagagtggggcggctctttcccgtgtaaaagatgcagcaattgggaatagtatcgtgtagatcaaaaggaggaatattgatggcacacacgaatacacagctttctcaatggctggaatcaaaagtcggccagacgcttgatattagaaaaggtgaattgacccatgatgaagagatatcagacttggatcagattgttctccaccttcaaaaagtggctatacgcagtacgaatcatcctgatgattatgttgcgaaagaagagcttgttttagaaggcgaaggaacaacattcactgaggacggaaacgtaccgcttccgcaaaatgcctatgagattcctttattaggtgagcttcatattcaccaagaaaacgaaggattgaaggtcgtaacagatcgtgcagtatatacaattgatatccagcacagctgacagccactttcatcaaaataatacagcgtagcgcctttgagctttcgttcaaaggcgctgctttatatcgagccgtttttttcacttttttcgttcttctccctattgaatgacgcctaagatagatatatagttttagagacaggattacatttcaaatcattctgttttttgtaaactaattcagcaatttgattcatctatttaccctattaggcgaggagaatgcaaatggaaaaattgatgtttcatccgcatggtaaagagtttcatcacaatcctttttcagttttaggacgatttagagaggaagagcccattcaccgatttgaattaaaacggttcggagccacatatccggcctggttaattacccgatacgatgattgtatggcctttttaaaagacaatcgaattacaagagacgtaaaaaatgtgatgaaccaagaacaaatcaaaatgctcaacgttagtgaagatatcgattttgtatccgatcatatgctggcaaaagacacacctgaccatacccgcctgagatcacttgttcatcaagcatttactccccgaaccattgaaaatctgcgcggcagcattgaacaaattgctgaacagcttttagatgaaatggaaaaagaaaataaagcggatatcatgaaatccttcgcttcccctttgccttttattgttatatctgaattgatgggaatcccaaaagaagatcggtcacagtttcaaatctggaccaatgcgatggttgatacctctgaaggtaatagagagctgacaaatcaggcccttcgtgaatttaaagattatatcgctaagctgatccatgacagaagaataaagccaaaagacgatttaatcagcaaacttgtgcatgctgaggaaaacggcagcaagttaagcgaaaaagagctctattcgatgctgttcttgctcgttgtagccggccttgaaacaactgttaacttactcggctcaggcaccctcgcattgctgcagcacaagaaggaatgtgagaagctcaagcagcagcctgaaatgatcgctacagcggttgaagaattgctgcgatacacctcacctgtcgttatgatggcaaatcggtgggccatcgaagactttacatataaggggcattcgatcaaaagaggagacatgatttttataggcatcggatctgccaatcgcgacccgaatttttttgagaaccccgaaatattaaatataaatcggtcgcctaatagacatatttcttttggttttggcattcatttctgcttaggagcgcctcttgccaggctggaaggccacattgcatttaaagcacttttgaagagatttcctgatattgaacttgcggttgcacctgatgacattcaatggagaaaaaatgtctttttaagaggattagaaagtctccctgtttcactttcaaaataacattcaaaacgcccccttttaaaagagggggcgtttgtgttttctcagcgcttcaccaattcatctgtttctttttcttccctcgcttcatgtttcttccggaaagccttaaggaaattcgcattcactactcccctgtttgaatagagcttttcgcaaaattctaacagggctgttgacgctttcggttcggttaatatcatgaagtggttgcttgaatcgacatccaccaggtggaaatgaggaatttgccgctcccattcctcccaataggcagcttgatcaaacggttctttttcatttgataaagtgaaataagtgtctaaatcaccaaagaaagacctgcttttgttgcggaaataataacattttaccgtctcaggatcagggagaggcttaacagtgtacgactccaaatcataggcgcgctgtgttttcatcatttgctgagcctgcgcacgtatttgtttatctggtttgtttagccctcgttcttttgccaagtcaatcaactcagacaggaattcttcatcctctaagcttatgtccacctcttcacggctgatgagaacatccgtaaacttttcccgtttcgcaatcgatgccagcatcgtattaattgtttgcagcattgacgttttcatagatgcctcattctcttttgtctcagaacgatatggggagtcaatcatcaccatgcttttgacagcaaggccttggctttgcagctggcgagtgacttcatatgcaatcatcccgcctaaggaatatccgcctacatcataaggaccttcaggctgtatggatcgaatgatctctatataataggaagccatttgttcaattccgtgcaaaggagcagaatcagtcatgaatcctctggcttgaatgccgtaaaaagggcgctggctcttttgtgcaaattgctgatagatttcaactcctcctactccgccatggaaccaaaagacagggcgcccccgcttgccgtcatttaacggtattaattccggaaacgtgcgagcttgatcattttgtaaggatgtatcctcctgtttctttgcgatcaagtccatcatgtcctgaacagtatggcatgcttgaagctccgtcaagacaatgagagggtccacctttgattgcaattgctgtaataactgtatgcaagaaattgaatcaaatccatactgctgcaatggcttatgaaactgcagttcatccggagccatccctagtacatttgctaatatgtgatgatcgctgctgttgttgatacgctcatcctgtgaaacagaaggcgtattctctactgcttgaaagccgttccagcagcttctcttttcaaatggataggttggcaacggtattctgcgggcaccttttccttgataaagcttttcccatgggatttgcaccccttttgtccagcaaaacgcgatcttttcaaggttgttttcagacaacaaagtctcgatcaccatttctcttaatggaccatccagcaaggcttcgagatctgacgagccattttctgcatttccgctaaagacaggtacagaactcttcagcttatcgcctttttctgctaagcaggcttgcaagccgattaccagttcttctttactgcggacgacgagcgccaggcggtcttccatttcctctcggccggtttgaagtgtataagcataatcttgtaatgacagttcttgttgtttattcacatagtcaagctgctgttgagcaattgcttttagcctgtcttgattctttgcagaaagaactacaatgtgggcaccattctcactcatactaaccggtggttttggtaaaggaatatattcttctaaaatgacgtgcgcatttacgcctccaaagctatagctgttgatactcgctctgcgcggaatttttttgcctgcatcgtcacttaaatccctccattgctgattctcggcagtcactcggaaacgggtgccctttaatgacacctggtcattcaaagacgaaaatccggatatgcctggtattgtttgatgcttcatcgccatgctgaccttcataagagcagccatgcctgagacgagttcaccgtgtccgatgctcggctttaagctgctgatataacatggcgcttcctcccgtacttcctgtggaagttccaattcgagctgactgcagcctgactttaacgcctctatttctatcgcgtctgccaatggagaggcgatcccatgcgcttctatataggtcaccgttttgggatcaatttgcgctccttgataagccttcagcattgcatccttcatgccggccggatttggcgcgtgaagtgacattcccctgccgccatgcgatacacctgaacctttaataaccgaataaatatgatcagaatcttcaatggctttttgcaatggtttaatgatgagaactcctgctccttcacttctgacaaagccatttgcatctgcttgaaaggatttggcctgccctttctcactcaaatagcccattgagtcgaagccaataaagccttttggtgaaagcagcaaattcacagccccgacaatggcttgctcacattcgccgtttcgaatggattgtatagctctgtgcaaagccactagagctgaggaacaggcagcttcataatattcacttggcccttttacatcaagtgcataggatatacggtttggaattagggaaggaaccacagctgtatccgtattgccggctgcgacaaatactcctgtcgggcggctggataaaacctgccctgttaagcctgcatcttccatcgccttccatgcatgtatcaagagcagaaactcctgtgggtccatattcgccgcttctttaggcgatatgccaaaaaacaggggatcaaactcacctattccttctataaaaccgccccattgaaggcttgattgcccttccttatcggctgcggcatatttgcgccagtcccagcgttctttcggcacttcagagacacagttctttccttggacaaggttatcccaaaattccgttacgctgtttgctttcggaaactgtcccgacatgccgataatggctatgccgtctgccgcgtgttcgattgttttatccgtgttcgtctcgtatgccggaatctgtttcatttggttttcgatttgagctgggcgttcttcctgctgatgagcttcaccaaacagctgagcaaaagatgcttcatgtttgtccgcaaaaaagtcgattaactcttgaatagtcggatattcaaaaaacagagtcggatttaattcgatctttgtctctgcttccatctcccttgtcagtgcaaccaattgagaagaatcaattccaaaatccatgatatgcgcttttgcaattgacaattttgacggatcggccatgtttactgccagtttatctgttacatagcttctgatacgagctttcagattgctggctttgatggccttattttgatttcctctttgattcgaaatacgaagctgtttaagcgagtagcccgagtagtgcagcactgtttctgacgactcattgatcacatctacatcaaacagcaacatgtcacctgtattcttaaccaatgtaatcaaaagccagcaatccccttttatcgtttgctttgtaaactggatatcattgattccaaacggcaggaagccgcctgtcatgtcaaactgctctaagaaactgaggatagccaagtacgcgctgtttgtcatcaatgggcttacagtgtaatggtgcccgtttgccagcccgctttggggcaggcgaatttttgccagtatagacttgtgatctctgtagagatgagtaattgtcttaaataactctccccattcaggaccgtttccggttttatacatctgatcgatgtgatgaagcttagttaatgaatgcttaacgttctcgatattgacttttttgggctcaaaagaaccgattccgcattgtccgattgcggcaggcttccacaaaccagaggacggctcgcgatacatgatttgcagttctatgacttgatctttttgcagcggctttgcctgaagttcaatggtctcgccttgtttgatgacaattggactgatataacttaatttgctgatacggccgctgttttcctcagggaacaggttaaaaaatgcttcaatggccagactgccatatgtggcaccgacaagcacccgttcattgttgaagacgtgtccttgaacgtaaggctcatcataagtgaattgatcttgaatgaccggctgattgatattgtcttcaacatctgacgatttctcattgatagacgatacatcgaaatgaaatgatgtattatggtcaaatgcatagtgaggcagatgaacccagcctgttcggttccctatatcagcttctttaaaagcaatcaatgccccttgtgcccattgctctgctgcgtttatttctctatccctagatgctgattccgcacatggctgtaaatcgaatgatgtatagatgccttgctggagtgagctttctcttgatgttcggaacacctttagtttttcgatcagctcttgagtcgatgccactgtaaatgcagtcctatgctctaaattatggtttctcctgtgtaaagcctgtacaacgggttcaatatccagagaagcttccttctctaaaaacaattgcatattttctagatagctaagcaggctccattttgttttggctgaaaaaacggcagtgaattcctgctggcggggagcgatatgttctttctcaggggccgtctccatatattcttctataataagattggcataggctccccccgctccgaaggaattgatcatgcttctgcgcggcaattgttttccagtttcaggatcattcaagcgatgccatggctctgtttgttcctgaagatagaaagccgtgtgttccagcttaatatttggattgacaggcatcgcgttaattgtcggcaccagcgtccctttcttcatctgcagcagcacttttgtcagctgagaaataccggaagccgcctctaaatgccccagattggatttgacagagcctatcgcacaaaactgtttcttgtttgtatattgttgaaacgcgtttgttaaggcaattacttcaataggatcgcccagcgccgaaccatttgccgccgattcaatatagccgatagtctctggatcaatgcccgactgctgaatcgacttgacaattaactttgcttgctgcttcgggtccggagctgtatacatctgtcttccgccgctatggttagcaaaactgcttttgatcacagcgtaaatatgatcctgatcttccatcgccttcgaaagtggttttaacaggacagctccgacgccttccccgggaataagcccgtttccggtgccaaaacttttgctttgattgccgcttcccagcagattggcacgctccaaagaatcatatttagagagatcgagtgttaaattgacacctccagcaatcgccattgagcagtttttcaatttcaggctttcacacgcaagatgtatggcgtttaatgaactagagcatgctgagctgacagcgatactcggtccggtcaggttaaaaaagtgggaaacgcgatttgcaatgtgccagtctcccccatttgagctgaggactgcctgctctaaagatgggatattccaaaaatactggttatacatattccctataaaaacacctactccgtcatcatcccgcaatttatccagccgggttcgcgtatagccgccgtcctcaaacgtttcccagacggtttctaaacataaacggagttccggtgtcatttccatcacccggttttgctccacctcaaaaagctgatggtcaaatgcctctatatcttgtaaaaatccgccatagcgtttcttatttgccggcttttttggatcttttgataatgttttcaataaagatgtgcgccatctggattccggtgcctctgtaatacaattgtctccggcgattaaatgcccccaaagctcttctaaactgttagacatcggatagcgcccgcttaccccgattattgcgatatcttctgtactagaatcattaaaatgtgttccttgcaaattacttgtcttttctatttttagtggttcggtatttgctagctgagtttccgtgacttcctgctctgtaacaaagcggcgtgtatgaaaagtaaatggcttattaggatctgtacgctctgtttgaagtggagcttcattttttgcaggcttcgttttttcctttaacaatgctgtccgaagcttattttcatgcccctttactaaatattcgacgagttcttttgtgttgttatgttcaaataaaatggtttttggaagctctcccgtcactttttctaattcacgaatgaaattcacctgcaaaatcgaatcaattccatacttctcaaatgtcgtatcttcgtgaatacgttctggtgatagtttgattgattttgccagcgtatgcttcacaaattgtgccgtttgttcgatgagagaatcgctttcctgtgaatgatcgatttcagcattcatttgtatatggcttggatcttcttctgcctccgttctcttcttttgacggacgactccgttactttcagcggcaatgatctgctggccgagttgatgcgattgttcagccataaaggaaacatagcgaaatccttcactctcaagcaccattttccaagtgtctggatacaggcccgggcagcccggtatgcggagatcaggatcctcatacagccaccagccctctaaaaggccgaacgtcaaatgcgaatatatattatgattacttatttcatttaaaaggagcagcccgtttttttcaaaactgcttttgcatttcgcaatgtctgccggatattttttgtggcatgaagcacatttgccgcgatgaccgcgtcgtagcctcccgcatcaatatgctgttcagacgccggctcctcgacattaaatcgtttatatgtcaaatatggattgtcaggaccatacttattttctgcatgcattaaaaaagctttagacagatctgtataacaatattcttttatatgtgtctgccatgctttcaatttttgaaaaacagccgcgcttgtcccgccggtcccggctccgatttctaatattcgaatcttcgcctcaggctcttgcttcagacgttcttgcagataggctgttaacgtatctgcaagaacatcattaaaatagtctgcgacttgattgtttttatagaccccttctactaaatccatagatgaattcggaaacaggatatcggtggctgacgccttgccggtcagaatctccggcaaggctttaagtgctgtctccaccaatgtcaccatggctttcatattattgtcttgaagcaggtcaaatttttgttcattccattctttccacagctcgctcatggtgcctattgagcgtgttggaacatgtccgttctccgttcgcttgagaaattgatgccgttctaaaatcgattggctttcttcaaaccatctgccatagaaattctccaataccggctgggatttactttctgtgaaaaaccctatggactgtaattgtgcgaaaagcattttacagagaatgtcttctgtgttcagcattggcgtttcccctcctataacagttgttgaatctttgtgttgtcacccgggtgatagcttcgcagcttttgaatggcggagccgtgagtttccgggtacacttcaatcgtttcttctgtctgttccgcttcatcattcgtttcgtttgccattttcatcattactagctgcttcagcggtcccccgagcagcaattccaaagcttccattgcttcaggggcttcaattgagcctatgcctgcctgagccattctcttttggtaatccggtgatgaaacaacaccaatgcttccccaataactccaattcatcacggctactgtacaaggccatacttgagaaagccgctgtgcaaaagcatccttaaaactgcaacccgcagcgtaattgctttgtccggaagctcttgcaaacgattgtacggaagagaaaaacaaaacaaaatccagtggttcatgccggaaaacttgagccattcgcacgcttacatcaacctttgcagcaagaacgtttctgaaacattcctcactcatattcatcaggcttcggtcttgtaagacaattgcagaatggatgatgccgttgatttcacgatgtgtttgtttcattgtttcatacgcgcgttctaattcctctcggttagccgcatctgcttgaatgtaatacggggctcgccctagacgtgcaaatctgtccagcttgctttgaatggctgcatcctttttccttctgccaatccaaacgatctgcgcctgatatgttctgatcatatattcactccacgcctcaccaataccgccagctccgcctatgacaacataaacacctccgtgcttatacttcgtgtgcaccggttgattgttgtgtactggaattagacgaagcttatgccaaatcttgtttcgataggcccacgtattcccttcttgatcggcaggcaaggaaaggagttgagataacggcaggtcttcgtattttttaacatcgatcagctttgtctgccaatttggatattcttttgacattgaaccgatcaggccgtgcaccccggcatcgaccgggtcgacaatatcatgctgatcaacatattgtgtgttcaccgtcacgatcgtccagcttatctccttctgtccatagcctaaagaaagcattgccttaatgagcctatacatttgaatgacgccttgatcttgggcttcaatcatttcatcgccgacttcgcactctgtcacacgagaaggagacatccacacgatgtggtcaaacgatccgagtgcttcaagctggcctgtaattctatgaattgatgcgttcggctcaatgtacagctccttggcaaacggaaactccctttgaacagcttttctgctgttgtcatcccctccgaggatgacaacacgctcatcagcaggcgaaatgctcctcttctccagctgcactcgatcccatatcggcgccataagaagcgctccgttaagagttgctttggagtttcctagtgatgtcggcccgtctggcggttgtatgccttcttccagcagccttgaggtaatccccttgattcttacacacactcggccttgttcatcacacaaatcaatatccagtctctgtattttgtcctcattaggacgagatgtcacagacacccacattttatttgtacacgggctgaatatttctagctcttgcagcgcaaaaggcagagaaagctgctcgtcaccggaattcagctttagcccgatcgacgcttgtaaagcagagtcggccatacttggatgaagaacgaattcattcagtgtgtgagttacaccagcaggcagagaaagctctgccaaggcttgattgcggccgatgtaaagccgatctatcccttgaaaaccaggtccgtagtcaatgccgatcgccttaaacaattcataacactggtcgtgtgagagtgtgcttaaactgcattggtcttgaagcgcgctgatatcctggactggaatgtctcctgccccacggattgaagcactgccttgacaatgtatctttcgatcattgtgtgcagcctctgtatagacgttaaaagcaatctcgccgtcctgctggggatttagactgatatccacttgaacaggctggccatccgccacaatcggctgcacccacacaacatttttgatgtgaataacagattgttgatcttcggttcttctcactgctcttgtaacggcagcatgaaccatctcaagatatgccacgcccggcataaccggttttcccttcaccttatgatcggcgaaaaagaactcagcacctgtaaaggccgagctgaaacgctgctctgacaaatcagatgtgttgacatgtatcaatggatgcaaagctgctgattcgactgtttttaaagctgtttgatgggcggctgcctcctctttcgtatccgttatccagtagcgttctttcgcaaatggataggtagggaggctgatgcgtttcggctgtttgccgtcatacagtttactccagcctatttccatgccttttacccataaatcaagcagtctttcatatatgtgaggctcccagctattgttgagcgttttctgtacttcgtcatctgatctcaatgtttgtgcgatacctttttctgctctgcctctgtacatgtacttcgcattggtgcccccttctataaagaggttcagtttttccagcaagtccccagtcgagacagcgatgatccctaatctctcctccattgcatcacgcccctcttggagtgtataagcaatatcagtgaggtcacgagcagtgatagatcgcttgctgataaagtctgctaattgccgggcttggtctttcagacgatcttcatcctttgccgacaaaataaagatgcccgggtgctgtgctgtcacggctggtgctgttgcaggatgggttgtttctttcggaatatattcctcaatgaccacgtgggcattgacgccgcctatcccgaacgaactgatacctgcgcggcgcggcagctctcggccggcttcatcccgaagcgcctgccactctctcgattcctgcacaatataaaacgggctgtcatccagtctgatatacggattaacagtttcactgtacagacttttgacaagcgttttatgcttgagctgcaataacactttaatgacaccagccacaccggccgccagtgataagtgaccgatgtttgttttcgctgacccaagtccgcaatggctgccatgaacagccgggtcccccgttttttcatacagctctttaaatgccgcttttaagccgttgatttctactggatcgcccagctctgttccagtcccatgcgcttcaatataagttacggttcttggatcaattcccgctttttcatatgctgtttttacgacatccgcctgagctttcggattaggagtcgttagagaatttgcgcggccaccgtggtttaccgcacttcctttaatgacaccgtaaatatgatcaccgtctcgttcagccgctgtcagctttttcagaaagagaatgccggcaccttcactgactgcgaatccatcggctttgtcagaaaatgttttgcatcttccttctttgctcagcgccccggctttatcataggcgatatggccttgcggagttacgaccgtgttgacccctcccgcaatcgccatttcacagtttccattttcaatggcgcaaaccgcatgatgaatggcgaccaaagagcttgagcacgcagtgtcgatcggttcactcggcccatgaatgttcaggaaataactgactctattcggtcctgcagaaggactcatattcgcagccgctgagccttcgatgtctacatttgacagaagtgaactgtaccctgtgtttcctgtcccgatgaagatgcccgttttggttcctgccaggcttctcgctgagtgtcccgcttcttctaccgccttccacgcataggtcattaacaggcgctgctgaggctccatctgctcagcctccagcggagatatgccgaagaacaatggatcaaagtcagcaacttcatcaataaaaccgccccatttgacgtttgttttattcgcttctttcagagggtctccgtaatactcctgccaatcccagcggtcttttggaacctctgtaatacaatctgcgcccgatgacaggttcttccaatattcctcaacgtcttttgcctttgggaaaacgccgctcatccccacaatcgcaataggctcaggcttgtgatcagcttccttttgcattggtgttaccgaaggttttacaaagcggttttcagtcgaaaacgtcatattttttatattctgttcgacaggctgcatcagcacctcagctttggcaggcgtttgagctgtaaaagcatttggatattcttctgacagataccctgcaaatgcataaacagttgcgtgctcaaagaagaccgtaggcgtaagatccagcttgcacttctcattcagtgtatttgcgaattcagttaacgtaatcgaatcaaatccatattgattaaactccatgtccgggtcaatctcttcaggtttgattttgagcaattgagagattgtttgctttaaaacttcttgaatgtggtcaaacatattcccttgatccattcttgcttcagatgtcacccgtacttgcactgttttcattggtacatcatcagaagacggcttttgagtcagcttttccctcatcatgtctttgaatccttccatgacgatgacttgatctttgccaaatgccaaacctttatacagcgcttgaatgccggtctcggtccgcattggagtcacacctgtgtttttcaacgtcatgttttcaatttctttattcgcgcgcatgccgccttctttccagagcggccaattgattgacaacgtttgtccgtgcctgtacatggcggttacaagcgcattccgataagcagcataactgtccataaatgcattagccattgcataatcggcctgtcccgcgctgccggcaacacttgatattgaagaaaagaggataaagaaatctaacgcaagatgctcggttgcctcatccacattcacaagccctttcaccttaggagcgagaacttgtgtcagctcttcattggttttgctcataagatagttatctttaatcagcccagcgctgtgaatgacaccattcaagtcttcgtaatcagacgtaatgcttgtgataagctcggaggctgcttccgtttgtgtcacgtcaacctgcctgtattctgcgcgagcccctaattgctgaagttcgttaagctccgcctgctgatccgcattcaacgcggatctgcctgtcagaatgagcacaggctgttcggcttggcgagcaatctcttttgcaaaaataaacccaagtcctcctgcgccgcccgtgatgaggtatacacctttatctctccacggcatgcttatttcccgatcatctatttgcatttcatccagatcattgatgtaccgtttgcctttttcatatttgatgtgctgatcttctgtgtgccttttattctctttcagtttttctattacactttcaacattttcatgtgaatcgatttcaatcgtctggccgattagttttttattctccaggccggcggttttaaggagcgccgatagccctgagaatgagtactgctttctttgtgcagaggtaagcagctggatcagaacattgccctgaggtctgcttttgagaagaccctggaccgtctcaagcgcttgttcggcataatcttggaacctctctgcaagtccttcgcggaatgactccaaaacgatgcattccgctcctgtcattcttgattcaatgcgatcttttgagaggccattcatgtcgcaaagcatgacaatgtgccgttcgtaatgaggctcaggactttcttttttaaaatccttgggcacccatttttcttcaaacatcagggttgccagcgtttgatcagattccgccgatccagagccgccttctgctgctctgaaagataatcctttcatccgtacgcaaacattgccgctctcatctaaaatatccatatcgcgcttttgcaccttatcagttgccttgctgccttggctgtatcttgcgtatacccacatttctgacgaacatgctccgaagacttcaagctcctggaccgcaaaaggcagtgtcagctggttatccccggctcctgtcaaaatgcttgacgcctgcaaagcagaatccatcagcccagggtgcattttgtattggctgagcgtatctgcagctgacggatgcaatgacaattttgccaaaacaaattgttcagctgtatagatttttttcactccgcgataagcaggaccatattcaaatccaatcattcgataggtgtcgtatacttcgtttacgctgaaatgactttcctgacactgctcccgcagagattgcaaatcaaccgccggcaaattttcagcaggattcaataccgcgctgccttgactgtagacgattgactgttcgccagtaacgtctgaatgaccatagatttcataagagatctcaccattttctcccggtaaaagcctaatgtgtacttgctgcggctgatcctctacaacaataggccgcacccacaccgcattctttagcttcatgatgcgcggtacaccttgtacctctgcggcctgctcaacagctgcccgcgccaattcaagatgagccactcccggcaaaatccgttggcctttcacaacatgatcagcaaggaaaaactcttctcccgtataaatagagctaaacctttgttccgagagattggatgtgttttgatgcattaatggatgcagcacggctccgccaaggcgggaggctgcttgatttgcatcaatgctgccgcttttttcaatatgatcagagatccaataacggtcttttgcgaaaggatacgtcggcaagctgatgcgctttggcagattctcgccatacaatttcgtccagtctacatcaagcccttttacccataattcaagcaattttgcatactttccccgttccatccatttctcgacggcttcttgaatctcttcgtcctctgtcagcatttggagtgtgcctttatcaatcctgcctttaaatacatcctccacaccgcttttctccgctgcaaagtcttttaactttttctgtaaatcctcaatggaaccggaaataatcccgagacgttcttccatcgcatcccgtccggcttgcagtgtataagcgattcgggcgagatttacgtcactatatgtttgcttatcaagcgcatctgccagctgctgtgcatgttcttttagccgcgcttcatttttagccgataaaacgaagatacccggatgttccggcgcgatggatggtatattctcatcggatgcttccggaatatattcctcgataatcacgtgggcgtttactccgccgattccaaatgaactgacacctgcccgtcgaggaagctcttctccctgttcatttttcagcgctttccattcttccgtttcccgtacgatatagaacggactgtttttcagctgaatgtatggattcacgttttcgcaatgcagacttttcactaaggttttatgcttaagctgcaataatattttaataactcctgctgcaccggctgccagcgataagtggccgatgtttgtctttacagaccctaatccgcagtaaggattggctgatgtgtctccttcatttacacccaatgctttaaaagctgatttcaaaccgttaatttcaaccgggtctccaagctccgttccggttccgtgggcttcaatgtaggtcacggttttcgggtcgattcccgctttttgatatgccgactgaataacatctgcctgcgccttcggattgggagtcgttaaagaggctgcacggccgccgtgattgattgcactgccttttatgactccgtaaatatggtctcccgcttcttcagccgcttttaattttttcaggaacagtatgccggcaccttccccatgtgcaaaaccatcggcttgatttgaaaacgtcttgcattttccttctttgctcagtgctcccgccttatcaaagctgatatacacctcaggaaggataatcgtatttacaccgccggctaatgccatgtcacaagtgccttcctcaattgaagagatggcatggtggatcgccactagtgaacttgagcacgctgtatcaaccggttcgctcggcccatgcagattaaggaaataactgacccggttcggaccgaccgatgggctcgtattggctgccgctgatccttctattgccgagttcgctttagatagaagagagctgtatcctgtatttcccgttccgatgaagacgccggtttttgtgcctgacaaccttttcgccgaatatcctgcatcttcgatcgctttccaggcgtaagtcagcagtaagcgctgctgaggttccatttgttcagcttcacgcggggaaatgccaaagaataatggatcaaaatctgcaataccgtcaataaaaccgccccatttcacgttcgttttattgacttccttcgccggatcaccttcatattcacgccaatcccagcgatctttcgggatttccgtcatgcagtctttgccctcttttaagatgttccagtacgcctcaacgtctttcgccatagggaaaatcccgcttatgcccacaatggcaattggctcaggcccagcatcactctgtatggcgtttggcagcatgacttgctgctttctgcgtcttttagctttggcacgcacggcttgttcctgtttcgcagcaggctgaagctgagccgatacagcgcgcacagcaaatgtcttcgcaaataccgattgatattcttctgacaaatgcttgccaaacgcatgaatcgtcgggtggtcaaaaaatacggttggcgtcagctctaactgataggcgcgattgatatggttggtgaattcagtcatggagatagaatcaaaaccatacaccgtcatctctgcatgatcgtcaatcgtttcaagcttgacctttaacagcttggcgatctctcgctttaacatcgcctttactttatccagcaaactgtctgcatcaatgctatttatttgttcagtcatgtgttctgcttccttcttttccataggtgctgaggcgtttttggccagcatgttttgttttattttctgcacatcgccttcgatcaccattacttggtttgcctctgaatgaagtgcttgatataatgcctgaattcctttttccgccctcataggaacaataccggcaagttgcacaagccttttctcagtttcttgatcgacctgcatgcctccatctctccataaaggccagtttacagaaagcgtctgcccatgccgctggctgaggtcggcaagcctatttcgatagcctgcatacatatccataaatacattggctgccgcatagtcagactgaccaatgctccctaaacttcctgaaagagatgaaaagagaataaagaagtctaaaggcaaatccttactcgcttcgtctagataaacaagcccttttactttaggcgccagtacatcgtgcagatcttttgcctgtttattaaccaggtagctgtccttgatgattccggcactatgaagaataccgttcagacggccatatcttttttgaatgtcgtcaatgagctgatagacttcaattttattggtaacatctgtttgccggtaggtgatgtcagcccccttgctatgaagctctttcagctttttgcttttgctttcgctaagaggtgagcggcccgccagaatgactgtcgcatttttcgtttgttccgcaatttcctttgcaaaaatatgacctagtccgccggcacctcctgaaatgagataaacgccattgtctttccacggtttgctgccgtctccttttgcctgtttgatttcacgccaatcagcaatataccgtgtcccgttttgatatttgacatatgaatcgctgctcatttgattttctaacagtttgccagcaatgctttctccactttcttcactgctgacttcaatcatttggccggttagtttggcattttcctgacaagctgttttcagcagtcctgtcaaccctgaaaacaattgctgttctccctcggcagaggtcacgatctgaacgagaatgccgtctttcggtttcgtacgaatgatctcttgtacctttttaaacacttgttctgtataagaatggaaacgcccatctactgaagaaggccttgcttccaggctgtatacatggacatcctcgatggctgcttcaatttgttttctcgtctcatgatcatattcacataggaatacgagatgctctgcatatttttttgcagctaagctgttagcagccttttgttcttgccaaacgggctgaagcaataaagtttcagcgttgatttttgatggttcggtttgtatatctgcctccatcactctcgtcgaaaatcctttcagccgcacacagatcatgccatgctcatcacataggtgaatatcgactttctgtatcaaatctcctggtttgtttttcgagttgaattgaacataaacccacatgtcagaaacgcactgacgaaaaacctcaagttcctccagtgcaaatggcagtgctgccttaaagtcttcagtgtctgaaagttccgctctgacgacattttgcaaatattcagccgcctgtaacgccccgtccattacacttggatgaagaacataatcgcccaacgtatgtgcaacagattctggcagtgataatttggcaagcagctggccgtcgcctttatatacggcctctacactcttgtaacctggaccgtaatcggcgccgatcatcccttcataaaacgaggcagcatccattttgctttgatcacattgtttcttgatcttagaaagatccagtgctttttctcgctttaactgaatcaattccgctttaccttggttatatacaactggttctgcatcagcggattccggatcaccatacatccgataagcaatatgtccgccatcttcatcgtaaagtccgatatttacctgaaccggctcacttcctgctacaaccgggcgaacccacacgacatttttcagcctgattccagtttcatgatcctccaatccgccaattccttgttctatagcggctcttgccatttcaagcgtgaccgccgccggcaaaatcgccatgcctttaatgatatgctcggcaataaaatactcttgtcctgtgaaaatggagctgaaacgctgctctgacagaaccgatgtattatggtgcaccaaaggatgcaaacgagatggttcaattgttgtgatagcgccggtgctgctttcaggccagtatcgttcttcggcaaaagggtatgtcggcaagctgatgcggcgtggctttatatttggatagagcctgcgccattcaacgtgaaagccatttgcccacatctcggcaagctttctcaattcttcttttgatatccgcgatgaagccatatcatctgcttcagcatttccaagcagctgttcagcggatgtcattctcgttttttctccttgaatacagccttctgcgagcggctttccagtcacaaaagcttccagctgatgtttccactcttccagatcgttcactataaaaacgatcctgttatccattgcttcacggccgacttggaaggtatatgcaatatctcttaaagagaaatgcctttgctcgtcttgactgatataggacagcatttccttcgcgtatacttggagccgttcactattttttgctgatataggaatgatgtaaggctgattgccttcgttttcggcacctgcatcagaaatgttttcatattgctcaaatattgcatgggcgttagttccgccaaggccgaatgagctcagagccgcccgatggacacctgcgtgtttctctaacgattttcgttcacggacaacataaaaaggagagctttcaaactttatatccggattcggctccgtacagttgatggtcggtgcaagttcattatggtataaactcatcgcaactttaatacatccggctaaccccgcagctgtatccaaatggccgatattcgttttcactgaaccaattccgcaaaattgtgttttgtcggtgtattgcttgtacactttatttagagcagacatttcaataggatcgcctaatttcgttcccgtcccgtgcgcttcaatataactgaccgtttcaggatggatcttggttgtatccaatacatgctgtatcacttctgtttggccttttacacttggcgcatagaagcctgccttctctgccccatcattattgatgcctattccgcgcataatggcataaatatggtctccgtcttttacggcatccacagcttttttcagcaggatgactgctacgccttcacctccggccattccgtccgccgaagcatcgaacgccttcacatgcccgtcgcttgaaaaattcaacccgttttggtgcacgtagccgatcgctgattgtgcgtgcaatgttgcgcctccgacaagcgcatattgtgattcgcccgatgtcaggcttttgtatgcttgatataaaccgactagtgatgaagaacagttagaatgaacaaaatagcttggcccttttaatccgagcttatgtgagatcattgtgggaatggttccgctttgggctaaaacccaagagacatagccatccggtgattcatgtccttctgttgtctccttcggcaataacgttctatatgaattgctgcttgcagacatatatacacttgttgccggaatctccttagccacatatcctgcatcttcaatcgctttccaggagtgcagcaataagaggcgaagctgagggtccatatactcagcatcttttggcgagatttgaaagaaaccgggatcgaataagtctttcccttcgatcacagattgcacaggcacatagtcaggatgctgtatcaattcttcgggaactccatttgcgcgaagctcttcttcagaaaagaatcgtatgctttctttgccttctttgatgtggttccagaagtcatgatgatttttcgcacccgggaactggcaagatatccccacaatcgcaacactgtcgtcaaaataagggggaatcttctgtttcgggtattttccatcttttttgtcatcatgatcatcttcattttgtgtcccggctagatctgagtttttcatctccaaaatgtattcactgattgcacggatcgtggaatactcaaacagctcagtaacatgaaactcacaatcgaattcttttttgattcgttcagccacagctacagccagaagcgaatcgccgcccgcatcgaaaaatccgtcttccggcccaaatccgctgaccttgagcgtttcctcccaaatgcgcagcacctgatcctctatttccgttaattgcaagtgatttggtttccttctgttgaacacgatctcgcgtttttctaattctttacggttcacttttccgctgggcgataatggaagctcatctaagcggataaagtgtgaaggtatcatatattcgggcagactcgattttagatgaaggcgcaaatcttttggattggcagaggcatgtccgctttcctctgtataataagcagcgagctgttgatggccctcaagctgcttcaccactaccgcctgatctaaaatgcccggaaattcacccagctttgtttctattgcgcccagctcgacgcgaaaaccgcgtattttgacttggctgtcaatccgtcccaagtattctatgttgccgtcaggaagccaccttgctgaatcacccgatttatatagcttcgtccctgattcaaagggattatcaataaatttttcagccgtaagccccggctttttaaagtagcctcttgctaagccggctccagcgatgcaaagctcacctggctttccgatcgggacaggcttcaaatgctggtccacaatataaattttcgtgttggaaacaggctttccaatcggtgtatggtgacttgcgatatctccttttccgcatccgaaatacgcagcgtaaatggaggcttccgtcggtccgtatatattttcaacacggcagtttgtaaagagcgataccgcctttttcactaatactttagggaaggcttcacctgcaaccatcatatacttcagcggaccgtcctctgtgaatcgcttgttgtctttcgccatttctaaaaaaacatgcagcatggccggcacaaaattaatgtgagtcactttatatgtttcaatataatccatgcaaagctgcggtgatttctccccattaggcggaagaatcactagacggccatctccaataaaccatccgaataattctgagatcgatacatcaaacacatagttcgtcttcaataaatatgcatcctcagccgttacaggatagtgagattcaagaaaattcagggtattcataatgctccgatgctctaccataacccctttaggctctccggtgcttcccgatgtataaataatataagcgaggtgttccggttttacttcccgctttaaaccgctgctttgctggtctgtataaccgtttcggcaagctaactcgatattgatcgcttttacatggctgccagttaatccgctgatcctatcatgaacgttaggttgggtgaggacaatggatgcctgactgtctttgagcatgtactttaatcgttcttgcggaaaacttggatctaacggcacatacgctccgccagctttcagtattcctaaaattccgatgatcatatcaaacgaacgctctgcacaaatgccaacgggctgttcaggtctaacaccctgatgttgaaggtagactgccacagatgtgcttttttcatctacttctttatatgtaagtgatctgtcttcaaacatcacagcaaccgcatcgggggtttgtttcgctttttcctcaaacacctcatgtatacacttgtcatttgcgatgtttgtccctgtcgcattccattgttccagcaaactagtttgttcttgatttaattgcaaagagtaggcttcaagcggcaaagacgggtcctccatcatgtgctgcgcgagcttcatatagttctccatcatgctttcaatggaggacagttcgtacaaatcagggttgtacagaagatgaagcactgtttcattttcttgctcatatatttcgagcgccagctcaaattcaccctcttgccgaatgtcttcaatatattcgatgccaagcgtttgatacggttcaagcactttttgcaagcctgttgcctgaaaaaagttttggtacagaaaagctgtttgaaaaaccggagaatccgcggccgagcggtctacattcagctctcttaccaatgcagggaacggaaacgccgcatgatccaggccgacagccactgtcagctgcagttcccgaataaatgctgttaatggctgagatccgatattcttgctccgaacagccatcatattgataaaataaccgattagggtttcaaatctgtcttcttgccgacccattgtcggaacgccaacaatgatatccttttgttttgtataatgatgcagcagcactttgtaaatggagagaaacacaaccgattcattcacatgattggtgcgggcaaacgatttaatttgatttctcaggtgatgagggagcaagcttttataagcttgccccttaaattttcgtgctgaagaccgcggacggtcagcaggcaaatcaagaactggcagactcccagacaactgttctttccagtaagcgagatgctcttccccttctctgccagtcagcattcgattttcccaatcgacaaaatcgtaataatcagctgttgatggctgctgcaagggttcaatcccattcagcaattgttgatacgcttcgaatagcgccgatatcaatgtcagcatcgacacaccatcaaatatgatatggtgaattgttataagaacaatgcattcttctaaccgatgaaaaaggtgtgtgcgccataacggaccagcttccaactggaaaggttcttttgctttttcttttagaaaaggcataatatctgctgatttcattgctgatatatcctcttccacaaaataaagatcctttgataactgaaccgattgaaatggaatgccattttcttcttgaatcacactggctaagaccggatattgtctctgtacaaacagaagggctttcttgaacgtctctgcatgtattggtttgctgaagcgaaagcataaaggaatgttatatgcactcatcccaggagacattttttgaagcatccacagccctttttgcccttctgaaagcgggcttttcaactgccgcttcatgcctttaagatgttcttccacctcagaaatggttaattctcctgatctgaaggcatcgagaatttctttatgattcatacgatttactcccttctatgatgttttgcacactcttaaaatccaatttccctagcgccacctcttgcatcaatccaatgatttgctcgtctgtatacgtgccctttatgtgatgtgctgctgcgctatgattttgtttttccgcttttaaggccaaatggtcagatagagcttggactgtctgacattcaaggatttcccggccggccatcttcagctgcgtggttttttcgatatgccgcatcaattttcggccaagaattgaatccatcccataatccaggaagtttcttttgaaattgattcgatcctcagatatgcccaattctcgtgctaaaaattgaacaatgatcttttgaatatgggttttgccattcggctcgtcaatctctgttttcatatcttgtgaatgctgtttaacggcctctgattgctgagtgcctgacgaaatccaataccgttcccttgcaaatggataaccaggtaaagaaaccatccgaacgtcatcgccatcatgaaggagttcccaaggaatctgatatcctttcacccagcattccgcgatgttttccaaatttctttcttttgcgagagcttgcagaactgcttcatcttgttcttctaaaatcccttctgtatatcctgtataaagggatctctgttggcctgataccccaccattcttcattgcttccacatattccttcaattttcgcaccaattgctcctgattgtttgcaacgatcgcgagccttgcttccatggcttttctcccaacctgaagcgtatatgccacatcaggtaaagaaaggttatgattctgctccagatacgcaatcatgcggcaggcagcatcctgaagccgatcgtcattttgggctgaaatcacaaagatctgcggtgacccttgatgccgctgtgtggacggctgatcatccggaatgtattcttcaatgactgcatgtgcattggtgccgctgattccagtcgtgctgatcgttcccatcctcggcttctgatttttcttgatccacgaacggttttctttgcaaagcacaaatgggctttctttaaacggaatatacgggttttccgattcacagtgatgagtggccggaatgatctggtttttcatagccatcagcatactgattaaagcaaccgttcctgacgctgcaaatgtatgtccgattaaaggtttaattgagctgatcatacagaattgcttctgcttcgtatatttgctgaacacgctcgttaacgcttggacctcaagcggatcaccaagattcgagccggtactgtgcgccatcacatattgaatatcgagcggattgatttcatttttttcataaatgttttcgatcaattctgcctggctaaaaggatttggcgcagtaatgccgttggttttgccatcgtaattcacgccgctggccttgatgcagccataaatatgatctttatcttcaattgcctttgataatggtttcaagagaacagcagccaccgcttcacctggcacaagaccattggcatcctggtcaaacactttgcattgtccgttcggagacagcatttcggcccttgtcagcgcctcaaaagacatgtgagaaatattcaagctgacgccgcccgctaaagccatttcacaatccccctgacgcagagctgaacatgcctggtgaatcgccaccagtccagatgaacatgctgctgtcaaagccatattaggcccttttaaatccaatgcgtatgcgattctcgcagacaatgtggcgttttgtgttccgttaatgtaatccgtatctccggttagatgcgcatattccccttcttccacacctacataaacaccgcaggattttccttttatccgatctcccatatagccggcgtcttcaaacgtgtgccatgcttcctctagaaaaatgcgctgacgcgggtccatgctttcggcttctttaggcgatatttgaaaaaacagcggatcaaaccggtctatgtccttcaaaaatgcaccccaccttggcactgctttttctggatctctgttagctctcccccagtcccggcgttcgcccggaatgtcagagatacacgatttaccgtttttcagattatcccacagctcatggaccgaatcagcttgagggaacctgccgctcatgccgataatggcaataggctcatcgtgaacctgccgaatgctttttttactggcttctggttctaaagctacaggaattactgcataagcttcagggggcttttgcgcctctgatgcatcatcccggtaaaatgcttcaatcagctctttatgatcggttaagaaaaagctgatcaattcttgtaaagttgaatagccgaaaaataaagccggtgtcacttcgatgttgaaatgctttgataacacgttcgagaatttagccaaatagatcgaatcaaatccgaagtcggcccaatttttgttcaaattcagcttgtcctttgaaatcttaagcaatgtgtgaatatgctctttcaagtcgtgttctaaacgcttttcaatgcttagtgtttttacctcatccttgttttcttgtgctagaggggcttgagtggccggttctggaatagctggttcagtcattcctaaaaatctgctgacacggctgggctgaccggctatcacgagatgctgagcatcctgctgagctaggatgtgctcaaacatacggataccttcctcggcttctaggaagcgttggccgcttgatttcaggtacatatccgttgtttcctcatcaccgatcttcattccgccatccttccacacaggccagttgatgacaaacgttttaccgttatgcagctcatttctgtattgtgcgtaagccatctgaaacctattgccaatcgcataatcacaacatccaaaatcccctaaaaccgcagaagaagaagaaaaataacacataaaatcaaggtcttcatttttaagccattcatcaagcgctatcgtgccgttgattttcggttcaatgatgcgctggaagctttcgatctttttgtcaaaaatagcagagtcgctctcgattccggctgcatgaataacaccgttgatggcaccgaatcggtctttccctctttttacgcagtctcccattgcgataggatcagacacatctgcttctgcatacatcgcttcgccgcctagatcctttaattcttttatttgcttttgcttctcatcattaaaaggcgacctccctgtcaaaatcaggtttgcggcatagtttttggccaaatgcttggcaaataaataaccaagccctcctacaccgcctgtaatcaggtaagtaccgccagacttcaatttgctgttgtccggttgtatcgttgtctgttcaatgtgatttacatatcgtttcagattctgatacaaaaccgtttgttcagttgaagcctgtaattctgcccagactttacgtgtccaatcatccatcgatccttgttccgcgggctgaaagattccagtcacttttgtgtgcggaaggacaagcccgagtgaacgttcgaagccaatccatgattccagataacttcggtcaagactatcttcaaaacatcctgccagcagcagccgtgaaggatgaagctttgctgcggacataccttgtaataggtaaacaatacaggaatggtcctttatacagcgcttgtcttccataggccacatatagaggattgcatctggctctccaagttcttctttaatgctctggaaggccttttcaaaagtaacgggttcttgccgcacaatctggtagctatattcagactgtttgctgtacacttcgccctgtgatataaaaatgaccttggtgtcttgatcaacgtttttcagggctgaagcaaatgcgttttgcttttctctttcagtcagaaaacagatgagcgttttgatacgtttcgatgtgagagtcgccggctcttctttccacacttcttgaaacgtcataaccttgaaaggttcttctgtttgctgatcatgatcctgttctatagacaccggggcctttgccgcgcctggtgcccagtaacgttcttttgcaaatggatatgccggaagactgatccggacaggcgtttgggtgccgtacagcatgccccagtcgaaagacaagcctttcacccaaagatccagcagtttcgtgtatttccctttgctcatccatgcttctatgattttttccgtatcctcatccgctgataagactgctaacgcttttttgttatcatcgatgcgatccagatacaggctgtctgctttgttttcgataaaatcgttcagctttctctcaagatcctctagtgattccgctataaaggccagccgttcctccattgcttcacggcctgtttgcaaggtataggcgatcctgatcaggtctgtttcgcagtaccttttttgtttgatggctgtaagcagctgttccgctttttcttgcaaacgttccatgtttttggccgacagcacaatcagcgctggaggatggtctttcggcgtttgcgcccccgttcttggaatatattcttccaggatgatatgggcattggaccctccggcgccaaaactgctcaagccagcgcgcctaggcacctcttgcccgccaatcaccgggcgtttccattcaccaagttgctgctgaacgacaaatggcgtatggctgaactcgatgttcggattcaaccgctgagcatgcaatgatggcgcaatttggccatatttaaactgaaaaagtatttttgtcagccctgcaattccggctgcactttcacaatggccgatatttgatttgctggagccgatcgcacaaaactgtttctcctgcgtatctttctcgaatgcttttgttaaccccgctatctcaatcggatctcctaatgcagtgcctgttccatgcgcctctaaataactgatggttcgggcaggaatgtcggcgcgctcaattgcttctttaatcacctgtgcctgtgcatgaggatttggaaccgtgtatccatttgtttttcctccgctattaatggcacttgcctttatcacaccgtaaatatggtcaccgtccgctattgcttgctgcagcggctttaacacaatggcgcctacgccttcaccgtcgacaaatccatctgcatcatcgccgaatgatttacatgtatcactagcagagagcatattcatgacagataaattctgatagtgaaccgggtcgacaactaaattgacaccgccggcaatggcacaatcactcgatccgctatagatgctttccagcgctaaatgaatcgctgtcagggaggatgagcaggctgtatcgactgcaagactcgggccttggaaattcagtaaataggatattctgttggcgatagaccaatagccgtagccagtcggataatttttgttcatgactccggcaaagacgccgatttttctgcttgaacagagcgagtcaggcgtgtatcccgcgtcttcaatacttgcataagcggtttgcagaaataatcgctcctgagggtccattctttctgcctcaagcggagaaatctgaaagaataatgggtcaaacttgtccatatccttgataaatccgccccatttcgtataaattgatccttcttttccttttctttatcgtaataagctttccaatcccagcgatctttcggaatttcctcaatacaatttcttccttcttttaggttgttccaaaagtcttctgctgtttccgcctgaggatagcgtccagaaatgccgataacggcaacgtcacggcttgcaagagtgtttgtcggtgtttctttctccccgctgaagccaagcttgcgaaagcgccgtgttcttttagcggcctgatcaggtttctgtgaagattgggttctgctttcggccggtgtatgttgttgaacttgacggtcaagacctgttaatttcatcagagcttctgtttttgttttgatgaaatgctccactaatgcgtcaatggtctggtactcgaaaaataaagtgctgcttacatggtcaaattctttacgcaatgtattcgtcagctggacaacaacgatagaatcaataccgtacttttcaagaggttcagatgactcaatctttcctgcaggaattttcaacgtttccccgattagttttttcatatattctgtgcttttttctcttaggagagcatgtttcgattgtccagcttcctctgaatctatggtatgaatgtaggctggctcctgattagacgcttgtgaaacaaccttctccggcaagatcacatttttcatcatacgtcgaaccagcccgttgcttgaggctgcgacgatttggtgactcagatcatgtgccgcctcggccgggaaaaagacagattcaaagccttcgctttcaagtgccgctttccagctgtcaggatgtaagcctggacagccgggaatccgcactgcaggatcttcatacagccaccagccttccaaaagaccaaaggtgatgtgagggaacaggctgtttcccgccatttcattcagcagcagcattccgttgtttttcattaccgcttttgtatgccgcagtgtttgacggatattttttgttgcgtgaaggacattagcggcaatgacgacatcatagcctcccgcttcaaattcctgctgatcaatcggtttttccacatcaaaaagctgatatgtcaggtacggattttccgccccatattccttttctgcatgcagcaaaaatgctttagacagatctgtatagcaatattcattgatgtgcttttgatatggtttcagtttttcaaagattccggcactcgtgccgcctgtgcctgcgcctatttccataatgcgaatcgatgcctcagggtcgtgcttcagacgttcatccagataagctaataatgtatcggcaagcactttattaaaatagtctgccacttggttatgcttataaatgccttccaccagttccatcgaggaatgcgggaacatgatatctgttgcagggactttccctgtcaaaatatccggtaatgcttgcagcatggcctctgctaatacaaccatcgcctttgtctcgctgtctttaagccacttttcttttttcgcgttccattctagccaaagcagctcgatatcctctgcttggtccttcctcaccaatgaatctccaactttcttaagatagccatgctgcaagagaaattcgctgctttgccgaatccattttccataaaattcacgagtcttatattgttgaagacgttcaaccgataatgtataaccatcaaacagctcggctgtttgcagctgtcctaacaacagcctgtaaagaagatcatcaagctcttcatgtgtcactctttgaaatcgtcccgtagtcggcagacgctccatcaggctctctgcatctgctgaaggttgctctggataaagagtgatgaattcattctgattcacgccttcgactgctacaggctttgtcgtatgaatgaaagctgtttggctgactggcccagaaagcagtgcttccagcgccttcatagcctccgcgggctcaattaaacctaagccgatttgattcatgagctgtacataatgttcatcctcagccgcttcactattcccccaatatccccagttcatgacttttacagggcatgcccagctctgagaaagctggtgagcaaaagcatctgcaaatgtacagccagaggcataatggctttgcttcacatttttgatatgggctacaagcgaagagaagaataaaacaaaatctacattctcctggcggaacacttgggccatccgaatactgacatcgatcttcgccgccagtccagcggtgaattcttccggcttcattttttccaggctttgctcaaataaaaccatcgcagagtgaacaatcccgtgaatatgaggatgacgttttttcacttgttcataagcctgctgcagtgaatgcttatcggctgcatcggctgcaatgtagaaaggctcagggccaagcgccgaaagtcggtctatttttgactggatggcagcattaagttgacttcgcccaatccaaacgatttgcgcctggtagcggcggatcatgtactcactccacgcctctccgatatacccggctcctccgatgaccacatagactccgcctttccgatatagcgtgtcgcctgacagtgaggaccgatatgggatcaattgctgctgatgccattgctgattacgataggcccaagcatggccaaggcggtcagctgggagcgcaaacatgtgatttaccggccatgtgcagcctttttcaagatcgagaagacggattttccagtgtggatattcctttgccattgtgccggcaagcccatgaatgcttgcatgagcgggttgtactgcctcatgttgcgtaaccggctgcgcttggacggtcacaagagaccattcaagttgtttctcgccatagcctaattgcaggcatgctttcacaagcttaaataagtgaagaacagcttcttcttgtccatcactacctatacttccccggtgtgacggggcaatccacaatacatggtcaatgcttccgtacgcttgcagtttgtccgctattgcctcaatgtcatctgcagggcggatatcgacaaaggaaatttgcggataatgatgctttatgaaagtccgatcagcttcagcagctccgcataaaacagctcttttaccagcaaacgaagcattatcctccgcttctagagagactggttcccagacggggatcatcaccgtatgcccggtcagctgagaatcagttaatagttgcggctttgaatgctgctctccatcaagtgcccgcatcgaggcacccttcattcgcacacaaacacgtccgttctcatcacataaatcaatgtcatactttctgactttgttctccgctttactgtctgaactgtatcgaatataagaccatatcttctctggacatgggctgaaaatatcaacctcctgtaacgcaaatggaagagacagcgtctgagcttgtccagcggcattgactgagctaacgataaaaccgactgtggcatggaacgcggaatccatcaaactcgggtggagcgcaaaatgctgcttgtcgttttttagaaaagcgggtaacgagatttttgcaagcaattgatctttgccgacatagactttttcaatcccttgatagccctcgccatagtcaagcccaatctttcgaaacgctgcatagcattgttctgacgtcactgtgtccaggctgcattctgtctgtattgatgaaaggtttaaaatggaagtctccgcttcatctgaaatgacagcgcgaccttggcagtgtatcgtcagggcttcttctttatgttcagagctgctataaatatcaaaggaaatgtccccgttatcctcaggaaaaaggccaatatgtatttcttttggttcactttctatcgtgataggacgcacccacacaatgtctttaagcgacaccactctttgttcgccgtccagatcgcctgcagctttttccgctgcttcccttgccatttctaaataggcaacgcccggcaaaattttctgtccctgtacaacatgatctgacaggaaaaattccgtgcctgtaaatacagagctaaagcgctgctcagtaaagtctgatgtattgcggtgcaccagcggatgtaagatatgattcacagtgctggttttcatttcaggaaccgagatccagtagcgctcccttgcaaacggataggtcggaacactgatcttaagcggcttgcgatcgccgtataggtcgtcccaggtgacccgctttccttgaacccatgctttcgccatttccatcatttcactgtctcttatcaaattgttattcagcgcatttaccgatgctagcccagccgcctcctgattctccttggctcgtccggtccagcagccctcgatctcttcttcgccattggcaaacgcccgaagtttagccgttaaatcttttatgtcttttacaatgaaggccgcacgctcctccatttcaacccgtcctgcctgcatggtataagctaacgctaaaagattgacgtcctcgctaagaaaatcaagaagtttaagagcgtaagcctgcagacgatctttgtttctcgcagacaaaggtatcactatttcttcatttttcgttaaaatcgtctctgaatggctctctgccggaatatattcttccaaaataagatgcgcatttgatcctgaagcgccaaacgaacttaaaccggcacggcggggatatgtgacgtccaccccgttttctgtaaaagatggctgctcccattcctttgtttcatgctggacaaaaaatggggtttgatcaagcttcaaataaggattcagctcttctgaatgtaatgacggcaccaaggttttatgatgcagctgcaggacagtcttcgttaagccgctaatgccggctgcagcttcagcatggccaatatttgatttcacagaaccgattgaacagaattgcttgtcctgcgtattgcggctgaaagcttttactaacccctgtacttcaatcggatctcccaatgaggtgccagtgccatgggcttcaacatagctgatggtgcgcggatcaattcctgttttttctagacatgcttcgattacatcagcttgagctaccgggctcggtactgtaattccgcttacttttcctacatgatttatcgcactgcctttgatgacagcatagattcggtcaccgtcctgttcagcttttcgcagcggttttagcaatactgtgccgacaccttctccagatacgtagccatccccgcctttgccgaaagtatggcaatagccgtcacttgagtgcatccctacactgccatagctgatatatttagccggatgcagtgacaaattgacgcctccggcaagcgcggcctcgcattctccattccggatgctctctattgccagatgaaccgcagttaatgaggaagagcagaccgtgtccaccgccatgcttgggccgtggaaattacaatagtaagagaccctgttggcgatttgcgcataattcagcgataaaggaaatggattgtgttctgatagagcttcagctcctataagagaatagtccttatgcataacgccggcaaacacaccgacatgctgtcttttattttctccctgcggtgaagcaattgtctctggtgtataacccgcatcttcaatagcttcccagcacgtctctaaaaataagcgttcctgagggtccatcatttccgcttcacgcggagagattctgaaaaattgaggatcaaagcaatcagcctcctcgataaagccgccccatttcgagagcggcttgcctgcaggtgaatccagtccatcgctttctttccattcccagcgtgagtttggaatctctgtgatgcagtcggtacccgctttaagctgttcccaaaattcctgtatatttttcgccttaggatagcgtcccgccattccgataatggctatgtcctccccgatctctggtgaagaggtaacaccatcaattggtgaaggagattggcggacagcatcgtccgcctctccaattgaatagtgatcagcaagatgagcagctagttctgcaattgttgtaaattcaaacagcagtgtcggagcaagatccgccccaaccttatctccaatttcctgaaccacggtaagcaatgacgaagaatccagaccaagctcatagtacccagcgtggatatccatttgttctgccggcctttcaagctgcttagcaagcagctgacgcaaatacatttcaaatgcgggatagtcccgactgatgttctgagagacagcagctctttcttcttgaatttcttttgcagaatgaaaggctgacatattccgtacagacttgcctgcaaattgtttcagctcggccactttttgtcctgctgaattaaaatattcaatcgtcatataagtgagttctttcttttggcgcacagatgaggagaggatccgtgctgtacatcctttttgcaatcgttctgaagcagaaaacgattcataatacaatggcaggtacatcgtttgatctgagatcaggcagcttgaacctatgccgctgccgtcaataagcgtcggatgaaacagaaaagcatcagaatgacgcaatgcttcctgtccgactgctaaatcaattacagccccctctttggcttcataaatctgtccttccgccttcatcatgccggtatgcactaactcttgagatcggcattgttcatagatttcatctaaattcagaatcctgtcagctgtacttttccactgattaaggtctattgattcggcaaaagcggtttgctctttacgatgcatgtcagcagtcacatattgtctcttgtcagatagtgattctccatgctgtttttgtccgtcgatgatgatggaccatgtcccttcctttctttcagacacgtgaatggtcagggcaatgtcatatgactcatctgcgatcaaagggtaaaaaatggttaggtttttaattcaagctcttggtatgcataaccatgttcctggaatacttggtagattaaatctatataagcaaggccgggtaataacgcttgtccatataccttgtggttggacatgattggattatttaatgaaatgtgcagttgttcagttatcattttcccactcctctcttatttgaaagttttccaaaacatatctttagaagcccctgtgtctgaatgcacttttttctgcacgttttgagctgatggtttgattaaaacgggctgcctatttaattccggcaaaggcagaggttttcttctaattggacgctcagccgagtctctccaaccttctataatgagatgggcgttcgttccgccatctgcaaaacaattaattgccgcagccggcgttgtctccttccactcggcttgcgatctgctgaaatacaaatctgttttttctatatcaaaatacggcatattttcattacctgacaggaacggaaccaattgtctatgcttcagcattaaagctactttaatcaggctcgcaattccctctgcacataatggatggccgatgttaggtttcaccgatcccagccctaacggagcctttgattcagaacggtaaatggactggattgcctttaattcaagtaaatctgttactgccgaccccgatccgttcgcttcgagatagctgatctcttcagtctttttgccgcttttttcaagcgctgacagcatgacgtccttttgtgcctcgagattcggagatgatgggcctgccgttcttccgtcattattaatcgcagcggctttaatgactgcatatatggaatctccgtcttcaaccgcttggttgacggttttgacgagaaccatgcccacgccttctcctaaaatgacaccgtctgcccgcttatcaaaaatatggaatgacggtttgtcacataaaagtccgcgctcatgaaacattcgatgcgcatcagcatcaagcaaactgacgccgcctacaaccgctgcctcaatatctccgcttcgcagagcctgaatggccatattcagccccaccagtgcagaggaacaagcggtatccaggacaatactcggtcccttcaagtcaaaaaattgtgagatgttagccgctaaatagttttgtccaccagcgactatcggattttttgcttttgaaagactggccggatcaggcttgtgctggctgcggcctcctatataaacaccagccctcatgcctttcacttctttctctgtataacccgcgtgataccatagcttcaagctttcctccaatacagccaaagcttgagggtccatcgctctgacatcgctttcggacatcatgaagaaatcatgatcaaatcggttcatttcatcaatgaggcccgcgtaattcgagctggagttcccgaatcgttcaggcggaacaggcgcaatcgcagaccgtccatcacgtattaaatcccagtattcctctagggtttctgctcccgggaacctgcaactaagaccgatgatagcgatgtcctcagcaagaagtgccgttttttcatggcttatctgttgcggccgctgttctggcaccagcttctgtttcattgctgattgcggcttgagaggtgtctgtttctcaggaacagatggctgtaaaacagctgatatgtcatatttcgaaatgagccagtgtgcaaaggattctattgtcgggtattcaaacaagattgacggatcaatatctccatttaattgttggttcatctgctgtaccagctgggccaatataatcgagtcgattccgtattcttggaaaggttcatccgtttcaaagtcttctgcagctattttcagttcatctgaaaaaagagttacgagccagtcgactgtttcagggaacaggttgcgagtgctggtttgctctttcgtctcaggatgcgagagagcttcgacaggcaatgacggctgcatcagcttatccggcttccaaacgtttgtatctggtactgccggcagcacgacagcatactgtctgtctgatagaatctggtcaagcagctgtaatccctcgtcgtttgtcaaactgatcaatccagtttgttctaaagctttgcttcgaacctcgcctaaaccggtctccttccagttaggccactgaatgcttacaatgggacatttatcttgatgagcctccgcaaaataatccataaaagcatttgccatcgcgtaatcagcttgtcctgctgctagtgcagggatggccgctgatactgatgaaaacaaggtgaaaaacgccaatggttcatcttgaagcaggtcaaacaacgtttgcagaccttcgactttcggttcaagcacctgtccgatctcttctagtgattttctgataaaagccgggttttgtttgttcaccatcccggcacaatggatgactccgccaatcgcccccattgtttcgtgtattgtcttcaggctctgttcgacagcaaccctgtctgtgagatccagagacagcacctgaacttgcgcacccatgtcttctagctcttgaacggcttttattttctcggcaagcgaggaaatttttaccgaattccactggtcacgcggcggaagctcttcacggccgataaggaccagccgcttaacgccgtatgttttcacaaaatgccgcgcacacagcaagccgagacctcttgtcccgcctgtaataagcaggactttgtctgttgaaaacgatacttgcttatgacttagagcggcttctgctggctgctctgtcaaatatgcgcgatatcgctgtccgtttcgataacagacttctgattctgtgctcttggcataatattcaactgcaatcagtctggccagctcctcatgagaggcttcgcattccatatctgcatgtcttgaagtaagatggctgtactcactttgaagcatgcggtataaaccggcccgtgaagcaccagacaaaagaacaccctcatttgcgtaggcctccagcccctttgttacacccaagaccgtcaaatgatgcttgcttgcacgtccttgctcgatcagcttttggagccagtttatccagcccatagaatgctcatggctcgttccgcacccgatcagatcgattgctccagcaacgtgttcatagtcagcagcagatacccgatccagctcttggctgtcaaatatacggtatgtcgagaaatacgccgaaagctcttccgctaatgccattgtctcctcatttgccaaaatggcgacggtttgattcgtcatttctgccggttcaatcggacaaggctgccactgtttacgcagaaagcagcgctttggcatcagttcgaattgaggcattgctgtagcaatggtttcgggttcgccttcttgagttggcagccagtaatactcttccgcgaacggataagcaggcaggctgattcggcgaggcgtgtattccccataaagcttgttccaatctatctgcagccctttcacccatagctctgctactttctccagcctttttttctctatccatgtttgcagcaatgctttggcatcatgatccgtttcaaacagcttgatttcgctcttcttcgttttcacgtgagcagcaaatatgctgccgttcggcatttcagccaaataatcatctaaagctttgatcagcatttctctcgaatccgccaaaaacgccatgcgataatccattgcttcccggcccgtctgaagtgtgtatgccatatcctccagatcgatatcttcattggaagttacgaaatctttcattgcttccgcataggccttcaattgcttctcttttttcgctgagagtacaaataatgctgagcggtgctgctttgttaatcgatcgttcctcttttcaggctgatattcctctatcacaatatgggcattcgttccgctatatccgaaggagctcacacatgctctccgcggttttccatcagccgtttcccaaggcttaagctccgtatttacgtataaaggagaatgctcaaattcaaaatgctcattcggtgtcgtgaagttcaatgtcggcacaagtgttttatgattcatgcacaataacactttttgaaccccggctactcctgccgccgcggatgtatggccaatattgcttttgacggaaccgattgcgcaaaactgctttttgtctgttttttcttgaaatacggtggacagagcttctaattcaattggatcgccttgttttgttcctgtgccgtgcatctcgacataactgatactctcaggatgtatgccgtatgtttcatatatgtctctttccagatccatttggcttttcgcactcggtgccgtgattccgtttgttttcccgtcctgattaatacccgagccaatgatgatgccataaatatggtcacggtccgcttccgcatctttcagccttttcaataccagcgcacccgcaccctcgccgggcacaaaaccattcgcgccattgtcaaatgctttacattgtccatcaggtgaaagcatgccggcctcacacatactcatgtaagattccggcgtcaggtataagctgaccccgccgaccagcgccatatcaatttctttgtttataagtgcctggcgcgctaaatgagtgccgaccaatgaagatgaacatgcggtatcaataggaatcgctggcccttttaaatttagaaaatacggaatacgcgccgctgcgatcgcaaagctgtttccggtggcatttgctcttgactgccgattcagcatgaccccgtattcattgctcataatgccgagatatacaccgcattttttctcatttaaagttcgggcgttgtacccagcgtcctcaaaggctttatagccttcctgcaaaaagattcgatgctgcgggtccatcagttcagcttctgacggcggaatattaaaaaacaacggatcaaaatgttcaatatcatcaagcatccccattgatttgcaatagactttcccttttttgttgaggacaggatcatagtatttgtcaacatcccaccgtgatgttggaatgtcccgaatggcatttctcgcatgaaccaggttatcccagtactctcttacattacgagcgcccgggtatcttcccgacatcccgacaatcgctatcgcatcctccgggcggtcttgaagaacaggaaccgttttcttctcatgttctttctttattggatgttgaacaggctgtagtggccgttctgccggctttggatgagatgatgctgctggcttttgctgggctgcttcgaaagagtcagtatgctctatctttctatcaagatgagttccaagctcggactttagcatttcggcaaaatcacgtatcgttggataatcatatactctggttaccgtaaaagacgttccgtattgcttgttcaccgcttttatccattcgagtccggtaatcgagtccattccgatatctatgaacgcttcgtcaatatccacctcgtatggctccatgtataacacgtctgctatgctttccctcaagttttcatgcagcgtttcaattgctacagtatattgtcttgatgcagatatttctgccgctgcatattgaatcgtttcttcagcttcctcttgcactggctgatgatgttctaacggctgcagagatatattagccggtttagcagcaggtaccactgttttttgtctgatcggcgtgtacgtctccgtttgttttttctccccagcttgtgtgcttaactcgtgtgctaagtaaacagcgaaatcacgtgttgtcggataatcatatacctttgtgacatttagtgatgtgccatactgtttatttattgcttttatccattcgagcccggtaatcgagtccataccgatatctatgaatgcttcgtctggatcaatctcgttttggtccatgtacagcacttccgctaagcccgctgtcagttcatcgcacaaggcttccgccgtgatcgtctctgtttctgtatctgatggaacacgctctaaacgatcctgattggtcattaaaggctgtaacgtaatattggcaggcttgccactggcttctctgtctacagacggcttcggaataacgggctgtactggagcgaatggctcctccgttcttttttcctcagcctttgcatttacgtctatccaatagcgatctcttgcgaaaggataggcaggtaaactgatgcgccgcggtttttgatcctgatatagcgtgctccagtcgattcgcaaacctcttacccacaggtctaaaaccttcgcatattttcctttttgcagccatgcctcaattgtttttgacatatcctcatcagcagcaaaagcagcaatggcttctttgttgctctttacttgtccgcgatagacatattcacgattttctgttccggagatacattcatacagcttttcttcaagctcttgcatcgtttccgcaacgaacgccagccgttctttcatcgcttcccggccgacttgcagcgtataggcaattcggtgtaaatctgcttcaacatatgtttgttcacgaatggcatgcagcaatcgctccgcgcgtttctgaagtctttcctcattttttgctgagagcacaatgacagccggctgtttcctcgctggtaaacgttcctccacaggttccggagcatactcttctattaaaatatgggcgttcacacccccggcaccaaatgaagagactcctgcgattctcggtaattcgatgtctttgccattgacactgatgatcggcctcttccactcttctagctcttgctgtactttaaacggcgagttaaggaaatcaatattcgggttcagcacgtttgaatgcagggaaggcgcaagctgcctgtatttcatttggagcaataccttcgttactcctgcaatacctgccgcactctcacagtgcccgatatttgatttggctgaccctattgcacaaaattgtttgtcatcggtttcttgcgtaaacactttggacagccctgtgatttcaataggatcaccgagagaggttcccgtgccgtgggcttcgatgtaactgactgtccgcggatcaaccttcgcttccacaaacgcctttttgatgacatctgcttgggcattcggattgggcactgagtacccgtttgtttttcccccgtggttgatggctgtccccttaatgattccataaatgtgatcaccatcttcaactgctttagacaatggcttcaaaagcactgctccaacgccttcccccggcacatagccgtctccgccctgtccgaagctttcacatcggcctttgctggacataaatttgttctgcccgagcatcaaatatttatttggatggattgacacattcacgccgcccgcgaatgccgcctcacattctccgcgctgcaggctttggcaggccaagtggatagccgttaaagaagaagaacacatggtgtctaaagcaatactcggtccgtgaaaatcaaaataataagatacccggttcgcgatggatgatggatttcccgttaaagccagagaccttccccgcacctgctcttgtgccccgtacagctgatattcttcgtacatgacaccgacgtaaacaccgacgcttccgccaagctcagcatcacgcttacggccgaggtgctctcttgtatagcctgcgtcttccatcgtttcatacacgcactgcaaaaataaacgctcttgcgggtccattaattttgcctcacgcggcgaaatatggaaaaactgcgggtcaaacttgtctacatccttcatgaagccgccccacttgctgtaggtttttccaggcttgtctttatcttcgtcataataaagactgtgatcccagcggtctgcaggaatttccgtaatacagtctcgcccgtccctcagtttttcccataattcatcaatgttgtctgcctgcggatagcgacctgagataccgatgatcgcaatttcttccgtttccttctctcttacctgcttctgctctttatcttgcaaaggaagaaatccagactttcttgggataactgggatttcttgtttttcaggttctgattttctttcaacagaaggttttcccgtttcaaatcccaagatgtccagcagtttttctctgcgggaatcaataaaataccgggttaatgaccgaatatcctggtattcaaagaacagcgtcttggacaaagatccgaatactttttctaattgacccgttacatgcatgatcatgatagaatcgatcccgtaatcctcgagaggagcttcagcatcaatctggccagctggcagcttaatcaccgaagaaagcacctgtttaaaatagttctccgctttttctcttagtatctcttcatcaatttccccgatcatgtctgctttttctgcctcctgattgagactgctttttttgatattgtgagattggcctttgccatgtcccgtttcatgtaaaaatgcacgaatccgatcagtaacaccggaagcaactaacacttgcgggttccctgacgtccagccatgatatagcgcctgaatcccacgatctgtttccatggccaccatgcctgtttctcttttcagcatccttgcagtttccgcatcaatttgcatgcccccgtctttccacagcggccagcacactgaaagagtttttccgtaacgcttgtgcagctctgcttggccattgcgatattcgctgaatgcattcataaatgcattggccattgcgtaatcagcctgtcccgcgcttcctactgctccggcacctgaggaaaaaaggataaagaaatcgagcggaatatctttcgttgcttcgtcaaggtgaatcagtcctgctacctttggagcaagaacggtttgaacctcttctttctttttctttataatgaaattatcttttattaaaccggcgctgtgaatgatgccatctaagtctccataaacgttttgggtttcttttaataaggcatcaaccgtttgtttgtcagccagatcagcttgtctgtaaatcgcttggatgccaagtttctgtaaggctttaagcttcttcttcttcctttcatcaagcggagagcgtcctgtcaggatcacaaccgcatcattcgtttggtttgcaatttcagttgcaaagatgaatccaagaccgcccgcaccgcctgtgatcagatacacgcctttatccttccatggcatgtcagcacttaggtgctcaccagacacttctttccacttgcttacaaatcgcttcccttgccagtggcggatatgcgtgtcacgcggatagcgtctgttttcctccaatatttcgaataggtcaccagctgacatcccggtttctatttcgatcaactgtcctgtcagttttggattttccagttcagccgttttgagcaatccagttaagccgcttaatagctgaggctcgtccaacgcaggcaccgccacttgaatgaatgtatgtcctcctgtttttgagtgcattagctgtttgatttcttcaaataactgtatggcataaccttcaaaccgttcatcaattgtctctgtatcatgctgcagaactgtacagtcaagatgattttggaggctttccatttgttctccaacatcacagacaacgactttatgtgtgtcgtactctatgagctcttgcctctctgcagcacgttcttcccaaatatgttcgaacagtagcgtgtcagtcgcttcagaaggaccttcttgatctgtttctaacactcttgcagaatagcccgtcaatcgcacgcaaacctgcccctcttcattgcataaatcgatatcaagcttctgcatacgatccccagctgtactgccctcgctatatgtgatccgcgcccacatagatgcctcgcagcctttgaagatttggacatcctgtatggcaaaaggcagcattgcctttctgtcttctaaactcgcagctcctcccagcctcaaaccgatagatgcttgaaatgccgaatctatcatgctcggatgcagaatataatggtcttctgtattagagattacaggaggcatcgtcaatttcactagaactccgttttcgccggcatataggctgtcgatcgctctgtggctgtcaccataatgaatacccatttctgtataagcctcgtagcaatcaaaaggtgacagcgtccggccattatagcttgccttcagttcttcaatgttgataaccggattttcaccagcctcacaaagcactgcactcccttgcccatatacaatcggcgactcctctgcgctttcagggtcccggcagatttcaaatgtaatctcaccattctcctcaggatatagacgtacatctatatctttctgctgttctgtgacggcgaacggccggacccagacgatattccggagccggaatcctgtcgggaactgatccgcagctgccctttccacagctgcccgaaccatctccaataaagctgcgccaggtaaaacgtgttcgccctttatgacatgatccttcaagaaaaattcacgtcctgtaaacgctgaacggaagcggacacccgatatgtcggacacattttgatgcagaagaggatgcaggatgtgtcgctcctcctttaaacgatcagtctttttctccgctttcggcacccaataacgcaccctctcaaatgggtaagtcggcaggctgatccgctttggtttgtttccgtcgtaaagcagcttccagtcaaccccagatccgttcgcccactgctccgcaatttgatcgagttttctttgctccagcaatttatgtaccgattcggcgggacgcgatggttcgcttcctcttgacacgcggcccttccagcaatgctgaatggtttttcgtccttctataaaagccttcaattggtcgcttaattcttgaattccggatgctaagaaagtaacccgttcttccatcggttcacggcctacctgcaatgtatacgccaaatctctaatctgaatcccatcatgaagaaaatccaagagacgttttgcatatacacggagacgttcttgattacgggcagaaagcggaataactgcggatatgtcagaatctgaggacaaagaaacgtcctgctccgctgcttgaggaatatgttcctcaaggataatatgtgcgtttgaacctgttgcgccaaaagaactgatccccgcccgtcgcggataagggacgtcttccccattctccttgataacaggctgcttccacgtttctgtttcatgctgtacataaaatggagacttttcaaaatcaacgtacggattcagttcttccgaatgcaaagaaggcacaagtttttgatggtgaagctgaagagcaaccttgcttaaaccgctgatccccgcggcggattcggcgtgcccaatgtttgactttacagaaccgattgaacagaactgccgatcctgcgtatattggcggaacgctttcactaatccctgtatttcgatcggatctcctaaggacgtgccggttccatgggcttccacataactgatcgtccgcggatcgattcccgttttctccaagcatgtctcaatcagatcagcttgggaaacagggctcggcactgaaatgccgcttacagtgcccacatgattcacagcacttcctttaataactgcataaatgcgatctccgtcttcctctgcctggcgcaaaggctttaataaaaccgcgcctataccctctgcaggcacataaccgtctccatcctttccaaacgtacggcagtgtccgtcagtggaaaacatatcccagaccccgtatgtcatatatttattcgggtgcaaagacaggttcactccgcctgctaacgcaacatcgcactcaccgtgacgtatgctttccaacgccaagtgcactgcggtcaaagaggatgaacataccgtatcgacagccatactcggaccgtggaaattacaaaagtaagaaacacggttggcgatttgcgcatagttgagcgaaagaggaaacacattttctgctgatgcttcttcagctccgactaatgtataatccttgtgcatgacgcctgcaaaaactcctacatgctgccttttatttcgtcctttaggcttggccaacgtctttggcgtatagcccgcatcttcaatcgtttcccagcatgtttctaaaaacagccgctcttgagggtccattgtctccgcttctcttggcgtgattctgaaaaattggggatcgaagcagtcgggatcatcaataaatcctccccatttggaaatgtccttacccgaaggagatgtgattccttcaagtcgctgccaatcccagcgcgactcaggaatctcactaacgcagtccttaccctctttcagattgttccaaaattcatgaatattggctgccttcggatacctgcccgccaagccgataatcgcaatatcgcctgctgcctcaataggtgcaggacgagagccttcaacagtcttatggtcgtttatgctgtcggaaacgcgtgctctttcattctggccaagagaaccagcggcactaaaatgctcagcatattcctcggcaagaaacgctgacagttccgctatggtggtatgctcaaacagaagagtcggcgaaaggctctcaccgatcttatcactgatcgtttctaccacctcaagcaagcccgatgaattcagtcccatttggtaataaccgacctgtttttcaacttgttctaccggcttattgattttctctgcgattaattggcttacgaactgttcagcctcactataggaattaacgggagaagataccatgtcagcaggtttatcacgctcagcagtgtccgctcttgtcatctgtgtctcctgtgcatcttgatgttttccgctaatcagctccgcttctcgcaccaatttgcttgtaaagtttttcaactcagccactttttctcccgacgcattaaaaaattcaagtgttacataaatcagctctttttcccgccggacggaggagcgcttaattcttgtcatgcaatccgtttgcaaaagtgcagaagcggaaaaggattcatagaacagaggcaaatacagcctctgttctcctttaagcaaagatgtgagcaaatgattggcacccaccccgctcccgtctatgagagtcgggtgaaacataaagccttctgcgtgaagcatggcctccgaaccgagagaaagctcaagaaggacgccgtcttcctcttcatagatgcagccttttgctttcatatattcgctgtgcaccaattcctgacgtctgcattgttcatatacatcatcaagctgaacaacgttctgtgcagatgctttgatttgactgagatccagtgtttcttcaaatatggctggggagtctgcgtgcatgtcagccttcatatagagcttttcttctgaagcttctttcccatcacgtttttcaattcccttggctgtgatttgccactgtccttcttttttctccgcgcattggatattcaaaacaattactgcatcctgttccgccgtcaatggctgatagatggataaattccgcagctgaagctctgagcaggagaaaccgtgttctctgaatatctggtagattatatcgatataagccaatcccggcaggacattttgtccgtaaaccacatggtgataaataaacggattttttaacgataatgtgagttgtttcgttatctttttcacgttagacctccacctcataagtatcccatatgtttgccgcagtcatttttgaagtctccgcttccagctttggctcgcctggcgaaagcattcgtttctttaattgaggaggcgatattggactgcgcttgatggcgtgtttttcatctttttcccacgcctctacgatgacatgggcattcgtccccccatcggcaaagcagttaatagccgcagtaggctgcgaatctgtccatttttccagggctcggctgaacgtgatgttcgctttctgttgatcgaaatgcgccatctctttttcacctgataaaaatgggacaaagcggcgctctttcagcatcagcacaaccttaatgaagctggcgatcccttcagcacatagcggatgcccgatgttcggcttgattgagccaagagaaagaggcgatgagtgcccagaacggtacactgattggatcgcttttagctcaaggagatcggttacgattgaacctgacccgtttgcctcaaggtagctgatgtcctctggtttttttccgcttttgaaaagcgcatctttcatgacttccttttgtgcctcaagattaggtgttgcaggtcccgccgttcttccgtcgttattgaccgaggccgctttgacgacagcatatatgatatctccgtcttccagtgcctgttttacggtttttagcatgaccattccgacgccttcacctaacacaactccgtcagcacgctcatcaaacacatggaaggatgaatgcttgcttaaaatgccgcgccggtcaaacagcctgtgagacgcatctgagctcagcaagctgacaccgccgactatggcggattgaatatctccgccacgcagcgcctgaatggccatattcatgccgaccaaagctgacgagcatgcagtgtcaactacaacacttggaccgcggacatcaaaaaattgtgaaagattagcggctaaataattttggccgactgtcacgatcggattcttggcatgatcaaggctgtcttcatcaggtttgtgctggcttctgcctccgatataaacaccgacgggcttgccctttatttcctcaggtgtataaccggcgtgatacaagagcttcagacactcttccaacacgagcagtgcttgcggatccatcgcccttacgtcttcttcgtgaagcaaaaagaaatcaggatcaaaatagctgacgccatcaatcacgccggcataatatggcgtcttacagccccaacgctctgccggaatcgggccgattgacgaacgcccctcggatagtaacgaccaatatgactccaatgtctctgccccagggaatcggcaagagagtccgacaacggcaataccttctgcatgagagtccggtgacaaaatcgctggcgcctgaatctgaggtgtaagagctcgatccttcccaggaacagatgcctccgcctctattttgttctccaaaggtgctgatgcatccgatatcctgcctccgaataaagcggacagcctttcggaataagaaccgatcagccaatctgcgaacctttgaattgtcgggtattcatatagaatcgatggatcgagcgctgcctctaatttgcggtttatacgctggagcacctgtgccaaaatgatcgaatccacgccataatcctgaaacaacccgtcaatctcgaagtcttcacgatctattctcagctcttcggtaaacagatcaataagccaggactgtgtttcagataataatccatcacatttggaaacttcatcggcctcttcaatgtctctggctggcgggctctgtaaagcagcttcctgcaaaccgccctcatgcggtttcctcctcttcatcagcagttccggctcccagtttgtttgattcgccattgcagggagaacaaccggtccgaactttttcgatacaatttgatctagaaaacgtaagccttctgaattcgtaatgctcaacaagccgctgtcccgatacgcttgatttgtcacttcacccataccggtttctttccagttcggccactgaacactgatgatcggcgcatgtttctgatgtgcttctgcaaaataatccatatagctattggccatcgcatagtcagcttgtcccgccgaaagctccggaataatggctgaaacagaagaaaataagacaaaaaactgtaaaggctcgttacacacatggcgatataacgttgtaagacctgacaccttaggttccagcacccgctggatatcatccgaagtttttcggataaatgccagcgtatccatatccgtcagacctgcacaatgaatgacaccgccaatcggtcctaatgttcgcttgatatgttgcagcgtttgctcaacctgagcatcatcagataacgtcagcgacagcatctccacctgtacacccttcgcttccagctcccgcactgcctggattttctctgccaatgatgtgtttgatgtcttaaaacgagcccactcctctcgcggaggaagctgttctcgtccggtcagcaccagttttttcactccatagcactctgcaaaatgacgggcgcataatagtccgatgcctcgtgtgccgcctgtaatgagaagtacatgatctttcgggaagaccgcgctctgttccgtggccttacctgtttccggatgagcttttagaaaagcttgataccgtaaaccatccctgtagcaaacctccgcatcataagaatcggaataaaactcatcagcgatcaacttcgcgagacggcgatgatcagtaacctcctcagcatccatatgccttgatataagatggctgtactcgcattggagcattcgatacaacccagcccgtgaggcgccagccatccggacagatgtgttttgaaacgattcgagccccttcgtcacacaaagcagcctgagcccctctttatgcccgaattcaaccagtctttgcacccattcaatccaatccagccggccctcatcatcccaaccgcatccgatgacatccactaggccgtcaaactctttccaatcaatgtctgactgatcattttctatccggctcacatctattaagagatgattcggaaaatacgaagacacttctgctgctaaatctgctgtctcttgacagcacaggatggcaacagttcttgtccccggcactgctgatccaattggactcaaactccattgtttcgtcaaaaagcatgcggcgcgatcttcaatcgcattaaccagttcttttttgtctctttctgaatgttcctttgccggcacccaatagtgatccttcgcaaacggatatgaagggaggctgatcaggcgcggtttggtctctccgtataatgtgttccactggattgagacccctttgacccataaatcagcaagtttggcgtattttcttttctgatccaagcatcaagtgccaacgccatatcttcatctgctgtaaaaatagtctgggtctctttatttcgatgagactgtccccggaaaaattcgtctgtttcttccttaccgtcaacaaacgcctgcagtttctcttcaagctcctgcattgtccccgcaacacacgccagacgctcatccatttcttcgcgcccgacctgcagggtgtaagcgatgcggtgcaaatcctgatcagtatattttttattgcgaatcacctcaagcaattgcgaagcacgatctatcagcctgcttttatttttagccgacagcacaattacgtttggctgttctgtagccgtgtgttctgaattggcttttggcatatattcttcaatcacaatatgcgcgtttactccgccaatcccaaacgaactgattccggcacggcgcggaagctcgtttccgtcacgatctgtgacagacttccattcctgtttttcctgaacgatgtaaaacggactgtcagtcagctgaagataaggattaagcgtctcgcaatgcaggcttttcactaacgttttatgcttcatttgcaaaagcaccttgatcaaaccggaaataccggctgctagctctaaatgaccgatattgcttttaactgagccgatgccgcaacggtgatccggaacatccggctggctctcgcctctcatattggatagttccttaaacgcggctttcagcccatttatttcaatcggatcgcccaattccgtccctgttccatgtgcttcgatatatgtgacagtgcttggatctatgtctgcttggcgatatgcacgcaccaacaaatcagcttgtgctttcggattaggcgatgtcagggtattggctcttccgccgtgattttccgccgtgccccgaataacgccgtaaatatgatttccgtcgcgctcggcatcttccagctttttcaacatgaccattccgaccccttcgcctctgacatagccattcgcatcggcggagaaggttttacacctgccgtctgtgctgagcatccccgccttgctgtagctaatatgcgcctcctcggttaagatcgtattcacgcctccagcgatcgccatctcacaatcaccgttttgcatcgcagtcacagcacggtgaatggctacaagagaactggaacaagccgtctctactggctcgctcggaccatgaatatttaaaaaataactcattctattcgggcctaccgaaggaatcatatgacctgtagcagcatggccttcaattggaagattcgctctatggaatagatctttataaccggtgtttcccgtaccgataaagataccggtccctgtacccgaaaggctttgcggcgagcaacccgcatcttccaatgccttccacacgtatgtcattaacaagcgctgctgagggtctacataatcagcttctcgcggcgaaataccaaaaaacaacggatcaaactctgcgacaccatcaataaacccaccccatttgatgtcggttttattgacgtcagtgtctgggtttccataatgctcccgccaatcccatcgatcttttggaacttctgtgatgctgtcttttccttcttctaggtttttccaaaattcgtctatatccatagcgccagggaaccggccgctgatgccgacaattgcaaccggctcaaaatcggcagcctgctttttgtttctttctgcttttgcaataataggctgtgtaaagcggcgctttctacgtgatgtgattttcggcgcttcagaagattttgtctgtaactcttcctgcccctctggtttttctcgctcctgaaccagggtgtcaccatgttcaacggtcaaatactcagccaggctgtggaggcttccatattcaaagaaaatggtcggcgttagctccaactgaaattcttcgttgatcttgtttgtaaagaccgtaaatgtaactgaatcaaatccgtattcactcagctctgtattgacatcaatatcttcactatttacttttaaaattgcactgaccatgttgcttaatgatgcctccaggctgcttaaactgtgcactaagtttgttctttcatctttgcctttagcagtagcatcttgattccattcgccctgatacgcagcaactacatattcagccaggctttggacgctgccatattcaaagaatatggtcggtgttagctccaattgaaatttttcgttgatcttgtttgtaaagacagtgaatgtaactgagtcgaatccgtactcactcagctctgtgttgacatcgatatcgtcagtgtttactttcaaaattgcgccaaccatttggattaaggctgcttccaattttctagtttgtccttgatcctgatccgcctttctctgatcgttccgcttggctttcgatcctgcggaaagcagtttttgcttcattttctgaagctgtccttccatcacaaaaacttgcggcttatcagatactatcccttgataaaatgctttcaagccactatctgtcggcatcgggaccattcccgtcgttttcagcattctcttttcatcttcagcgccgacttgcataccgccttcttcccataacggccaattgaaggaaatggtggagccgaatctcttttttgatgccgcaagagaacggcggtattcagcaaatgcatccataaacgaattggctgccgcataatcggcttgtccagcgtttcctaaacatcccgaaacagaagagaagaaaatgaaaaagtccaatgggaaatccttgctgcattcgtctacatgtaacaacccgctcacttttggctgcaacacttcttgaaactcttcattcgttttatgaatgatgaagcgatctttactgctgcctgcaccgtgaataattccattgagagtgccatatctttctttgatttcctccaaaagatgacgaaccgcatgctgatcacttacatcagcctctcgatagacaacctccgctccgatgcttcgaagagcctccagctcgttttccttatcctcacttaaaacagatcgtcccgtcagcacaatagtagaccggccagttcgattggcaatttcctttgcaaacagaaggcctaagcttcctgctccgcctgtgattagataaacaccctcgtctctccacggcatgtgaagcgtatcagctgaaggaagcaccatttccctccagcctttcacaaaacggtatccagcctcatatcgaatctgtttgtcaaatggtctccggctgtcgtctttcagcttgaggtgaaggtctatcatctcttcaggtttctcaatttcgatgacctgagcagtcagtttgctgaactctatttctgctgttttaaacagaccggaaacgccggcaaacaattgcttctctttttccagcggaacaatcgcttgaatgatgatacggcctgcagaaagcttacggaccttgctttgcaggagttcaaaaatgttctgcatgtaacattgataacgttcagcaatatgtcctacagcttcgtttagagtaatcacacgggcatctttcatgtgggaggcaatgctgtctgtgacacttcgttcagtttcgaagagaacaatgatatgctccgtgtacgaaagatcttcgtcctctcgttcttcattctgtttttcccacaccggttcaagcattaagcgttcgtgccgtgttgaaggctttgaagtatgaacctccccttctaatactctcgttgaaaatcctttgatcctgacacatacggttccactctcgtcaatgacatcgatatccgctttctgaacaacccctccggagtgatcgctgtcacttaagcgggcataagcccacatagaagaagaacaccctttgatcacttcaagctcctcaagcgcaaatggcaaaatcagcttttgatccgtcaattcctgcatgatgcatattgttgctgtctgcaaggcggaatccatgatacttgggtgcagcacaaactgttcattcgttccagaaacgatttctggaagctgcagctgcgccaaaacctctctgtttcctatattcacattcttaattccttgaaaggccggaccatggaacattcctctgcttctgccttcttcgtaaaattgatcaggcgacatctttcctttgccgcaacggcgtgacatttcagtgagatctgcgactggcgtttcggcggcagatgccagctccgcactgccttgactatgaataacagggtcgtccccgtcttcctgtgtactgtaaatgtcaaaggtgatttttccatcttcttcaggaaagagactgatatccacttgagctgaatgtctgtcaaccacaacaggctgaacccagactgtatgattcaatctgattctgacatcttggccaatttcacttcctgccgcctggtttatagccgcgtacgccatttcaaggtacgcaacaccaggaagcacaggctttcctcttaccacatggtctctcaggaaaaattcgtcaccagtgaaaaccgaactgaatttctgttcagaaaaatcagatgtattctgatgaagcaatggatgaatagagccgatccctgtctgatttccggatatctgcgccaccggtttgcggtcatcctgcgacggccagtatcgttcctttgcaaatggataagtcggcagactcattctgtttgggcgctctcccttgtaaagctgcatccaatctatatgcgctcccttgctccacatttctgcaagcttgtttacttttcctttggccatccacttacgtatgagttcagcgctgtcctcatcctccgtcagccatgaaacctctctggcattgtgcttacttccttgaaaacagccttcaatcgctgtatttccattgataaaatctgtgagcctctgttttaactcatttacatgatcggcaataaagacaacgcgatgctccatcgcttcgcgccccacctgaagggtatacgcaaaatcaggcagctggctgttctcaaaccctcttctttctaaataggccagaatgtcttctgcatactcttgcagcctctctttatttttcgccgagatcgggacgatgcaggttccgtctatctttcccttatctgaatcccttttgaattgttcaaaaatggcatgggtatttgtcccgccaagcccgaacgagctaagtgcagccctgtgcgttttgatctcacggcttaacgttttcttttgatcgacgacgtaaaaaggagagctggctaagtctgtatttggattcggctccttataattgacactcggtgcaagctcttgatgataaagactcatcacaaccttaatgcagcccgcaagaccggcggctgtatctaaatgtccgatattggttttcaccgacccaatgccgcaaaattgcgttttatttgtatattgcctgtaaacgtttgttaaagccgccagctcgatcgggtcccccagcttcgttccggtcccgtgtgcttctacatagcagatggattcaggctgtaccttcgtttgattcatgacctgttggaccacgtcagcctggcctttaacgcttggagcataaaagccgactttgtcagcgccgtcgttatttacaccaatgcctctcagcaaggcatagatatgatccccgtcctttactgcatcagctgcttttttcagcaatacaacagcaacgccctcaccgcctatcattccgtcagctgaagcgtcaaaagctttaatatgtccatcactcgaaaagttcagcccaggctgatgcacatatccgatatttgactcggtatgcagcgttgcaccgccaactaaagcataatcagattcacccgacaggaggctcttataggcagaatgcaatccaatcagagaggatgagcagttggcatggacaaaatagcttggccctctcagcccgagcttatgagaaatcattgtcggaatcgtcccgctctgtgcaagcacccacgaaacatagccgtccggcgtctccaggctctctgttgtatctgacggcagcagcgcgcgataagaattattgcttgccgacataaaaacactggtttgcggaatctgcctcgcagcataaccggcatcttctattgctttccatgaatgagtcagcagcatccgaagctgagggtccataaattcagcgtctttaggagagatttgaaagaagcttggatcaaatctgtctttcccatcaattgaagctttagcagggacatagtcggcattctccgctatctcctttgaaatgccaaagcgctgaagctcttctttattgaaaaacgcaatgctttccttgccgtctctgaggttctcccaaaattcatcatgattttttgcccctggaaattcacacgatatgccaataatcgccacactatcgtcataatagtccgggagatcactcatctcggtagactgatcttctatatgagctgccgggtctgtcggtatatggtcacttgcatcgcccattcgctgttcagtgatgtactggctgatatttttaatcgttgaatactcaaacaggtctgtgacagaaaactcacaggatagttcatgtttgatacgatcagccacagtgaccgcgagaagcgaatccccgcccacatcgaaaaatccgtcatcccattcaatgtcactcgttttcagcacttcctgccaaatggtaaaaacagtatcctgaatgttcttaggagaggtctgcctttgctttagctgctcccctgataaatcgatattcttaaggctgtttctatctatctttccgttcggagttaacggcatatgatcaagctgaataaaataagaaggcaccatataggcaggcaaagcgtttttcacaaaatgacgcagctctctcgctgtgagagaagcatttgcatgtttagctgtataataggcagctaggttatccatatctgcgaccacaacgcattccagaatgccgggatgctcactaagcctgctttcaatatcaccaagttcaatacggaatccgcggatttttacttgattatcgatgcggcctatatattcaattcgccctcccgtaagccaacgggccatgtctcccgttctataaagcttagacccaggctcaaaagggttgtcaatgaatctcgaatccgttaattcttcctttttgtagtagcccttcgccacaccgtctcctgcaatgcacagctcacccggaacacctgccggcactggcgcgagctgagaatccgtaatatagatttgtgtattggcgattggccttcctatcgtggcatgagagcattcaacgttaatgcgctgaaccgctgaccagatagttgtttcggttggcccgaacatattccaggcttcgctgcccgtatctaagaaatatcgttttaatgtctcaggcaatgcttcgccaccgcataaaattttcacgctctcttcattttcccagcctgaataaaagagcatcttccacgtagcgggggttgcctgcatcactgtcggtttgatcgcgcggatgtcccgtttcagtttttcaacgtcttttgtatgctccgtttgacaaatatagcagtgtgcgccctttattaaaggcaaaaataattccagagctgcaatatcaaaacagtaggttgtgacagcaagcattttatcctctgccgtaagacctggtgtttcccccatcgaaacgagaaagtttgtcaaagctttatgtggtatcatgacaccttttggctttcctgtgctgccggatgtataaatgacatatgccaagttctctggcgtgacagtgcgtgtaagcacttttcgatcagaggctgtttgagcaatttcatcccaatcttgatctaaaagggctgttgtgacaccgttccaactcaacgtatttactaattccgatgtcgtcagtgtaatgaaaacttcactgtcctcaagcatgtattctaatcgttcagccggataggacgggtctagcggcacatacgctcccccagccttgaggatcgctaataaacccactagcatgtccagcgatcgatccacatagatccccgccagacggtcaggacccactccatgcgcctgcaaataaatggccagctgtgtgcttttctcatcaagctcccgatacgtcaatgtttgaccttcatagctgacagccgctctatcaggcgtctttttcgcctgctgctcaaacaactcatgaaaagttatatatggatacgtttttcctgtggcgttccatgttttgagaatcatctgcttctctgcctcaggtaataaagaatactcttttaaaggctgagaaggattcaacatcgcctgctctgttacataaacaaaatggtcgaacatggcggatatagaagccgcatcaaacagcccagtattgtacttgatgttcagctccattttttcttctgtttcccacagttcaaatactaattcgtattcgccctcttggtgaatatactcaacgaaatcgacagaaaagaagtcagcatagcggctcagcaagctttgatagcttccggattgaagaaaattctgatagaaaaaagcggtttgaaataccggtgaacctgcttgactgcgaggaatattcagatccctcaccatttttggaaaaggatatgctgcatgatcaagcccatccaatatcgttaattgcaattttgatataaagctagaaaaagtgtctgccgggttcagctcactccgaatcgggagcatattgagaaaatgtccaatggcatcatcaaatctttcttccggcctcaccatggccggcatgccgacgatctgttctttttggcctgtgtaacggccaagcagcatcatatagcagcttaagaataccgtcgtgacatttacagaatgctctttcgcaaacgttctgacctgattcatgaagccgctggacaaccgcctggtgtatgtatcctctctaaactgagaatcgactgaacttgcgctgacattaggcagctgaagattcggcaaagttcccgatagctgtttctgccaatatgtacggtgcttcacaccgtctttgccggcaagcatgtttttctcccatgccgcaaaatcatgataaatggcaggagaaacagctttttccggctgctgtccttttaaaagaagctgataggtatcaaacagactgcgtataaatgtgacagacgaaactccgtcaaaaatcaaatggtgaatgacaactaataaaaaatgctcttgttcagatctggaaaagctcatgacacgcactaacgggctgttttcctttacatacggttcctttactttctttctaagaaaagcaggaatatcagactctttcaaacttgagatattttctgtcttgatttcaattgaaagtgctggctcatttttaagaaatggcactccgtctttctcttggatgacgtgctttaagattgggtgctgattcaatacaaggccgaaagcctgctggaatgtttcatggtgaagccctgacgaaaatttaaaacagagaggtacgtgatatgcacttttttcgggtgacattttttgcaatgtccataatcctttttgaacctcagagagaggctgaaaagttgcctgactcctttccggttcggttttatatgtgtccgtgccctttttgtcagcagacaagctgctgaggtcttcatgttctgatagatagctggctaagcgttcaattgtaggatattgatgtatctctctagctgttagtttgatatgatagtttttctcgatcgatcgaatgagcttcatcatcttgatagaattcacaccaagactttggatatttgcatttggctccacccaatcgtgggaaacgtgcagctcctcagtcaaacaggtgagcagatgcttctgtatttcttcccttactcttttcacctggtctgcttgctgtatcccctcatcctggactgcatcgttcatccgattgggtttatgtagcaagtggtcgaactctccattttcaaatgaagtttttagctgggtgcgctggatctttccgatagccgtttttggaatctcttctttttgtacaggcagcaaatattccggggtgactccgatcacctgtgagacatgggattgtatgtttctaagaagctgagacatctgctcatcatttaattttgcggaagtaacaaagaagatagccagctgatctgttgaattctggcccagacggacagcgcaagcagcagtataagaagtttcaatttcaggtaattcttcaactgcagactcaattgcatgactgtaataattaatgccgttaatgataattgcatctttcgtacggcctgttatggttaagcgcccgtttcgcaaaaagccaagatctccggtttcaaaccagccgtcttctgtaaacacactctcattcaaatcaggccgctggtaataaccgctagtaacagaaagacccgagacttgaaaacggccgatctcaccctcttcaaccaattcattatggtcattcacaattctcatagagaagccggggattggagagcctatttcaacaaaatgatcatcatcacttgttccagcccgggtaaattcatgagaaaaaataacgcccgatgaagtttcggacattccccaggcaggtcggatggcgtcagcaggcagtccatgtggttctaaaagctcaagtattctacgccctaccttggctaccattgcttcaccgccattgagcatgtatcgcattgaagacagatcccatttcttatcttttatttcttctgcaaaatcagtaaccagaccaaacgcaaaattcggcgcccacgtaacagaagctcggtaatgatcaatccaatccagccatttcaacggctccattaagatcgtttcgcttgagacgttaatttcctgacagccaagataaacatcccgcaaatgcagcattccgatccctccgacatggtcaaacggcatccagttaaacgtaatatcctctctggtgaagccttgcatttgaataatccctttcaccatgctcataatgttacgatgattaagcataactgctttgggcgttcccgtactgcctgaagtcagcaataaaagcgctaagtcttcaggactggattgatgccaatctgtgtccgcttcagcgctgagcagatcctctacaataattgccctgaacccttcaagcccttgttcttttgcccaatcgagcatttcctgatgcatcccccggtccgtaatcaccgctggcttatcaagaagcgtccatgcgtctttcagcttttgagtgccgctgctcgattcagcatacgttggcggaacggctaatggagccggaacaacccctgttaacacacacccccagaacgcagggagaagctgtgaattgtcaccaagctgcaaaatcacgctttgttttgctttcaggcctgattggcgaagccccttcgcaatgcgcaatccatcatcccataatcgtctgtatgattggtaaacttcagttccatccggctgcaaataaatgattccctttgtatccccaagctccgtcgccgttctgtataaaacttcaggtattgttgccggctgcttttcagatatatgtaaaggctccccatgactgacagaaggattagttaatatgcggatattatcattatttctcatcacgctgcctccatttcacctgcaaaatttatatatattttcagttaattaccatataaacctttgattctacttttgacttcttcatgatgaaatgttttctcatgcatcatcaattcctgttcaatgacgcgcggcagctgatcgcgaagcggggcaaccaaatgatctttcagtgtaaccagtgagtttctcggcttttccgccagttcttgcgccagctccactgcataatctaacacttctgcacggggcagcaccttaaaaggaacccctcttttttcaagatcagctccgcggtagctgcccgcattcaataatatttcctgggccaggctgaaacccagttttttaggaacgataaaggtagcgcccattccaggcgtaaatccgtatttcataaaattagccgtatacacgctttctctgctcagaatgacaatgtcagcaaagagccccatgacaaagccgcctccaattccatggccctgcattgccgcaataactggaatctcgcaatccagcgccagagaataaagattgtcatcagtgaacttggtcaatccctgttgaattcgaagcagtccttcttgcgttcctcctgaagcaaaataattatcatatcctgtcaaaatgaccgctttgtatttgggattctgccgtatgtattcaaacgcttgaattaaatcgtctgtaagttcttgtgaaaacgcgtttttatgagtgcgatcttgcatctttacctgaataatggcggattcaatttcgataagctctacaacagaatgcgtcatgatgtcctcctaacggttctgattgtcatttttaaacggttactgatcctcccatgggaattgtcctgtttcaacatacctgatgattcccatttggttttgaggatcagaaaacatgtcttgatttgcagttaaagcggtggctttcgcacgactgacttgatgatcaagtgagctcataaactgtttataatgtgcgattccttttttattcagcctccgcaaacgcaataaatgctttctcagcagcacgtcactttcagcatcaaaagcatctattaacccccattcactggcttcctgaacggaaatcggctttgtcataagcgtcatataatgcgctttctgccggccgatacggcggatcagaaacggtaaaacacaagcagggtacaggccgaatagcagctcagagagactgaatgacgccgtctgatcagcaatggcaatatctgtggcagatacaaatccaagaccgccggcattcacttttcccctgacatgcgaaatcgtgacataagggccggtctgcaatttcatccacaaatcatagagaggctcttgggagcttgcctgttttctgccccttttcatttcctgatagatttcttgaaaatccgctccgaaacaaaacacctcgggaagcccctctaaaacgacaaccgtcaccgttgatgtttcacattggtttaacacttgcaagcattcttctatcagcgtgtcattaatcgtattattcgcttcaggacggtgaaaggtaatatagcaaaccgatgcttgaaagcggacctttatcgtttgataggtcacgagatccacctgtacttccgatgaaactcagaaatttcttctaaaaacaagcgcggcttctcttgagtggactgcatgatgcccggtatcatctcaaagtccagctttacattgcgcgtcccaaaccgcaccatcccgctccccttaaacaatagctcatactcttccatggagagctgataccggcgatccaaatgcttctcaataccaaatgttcgctgacgctcctggccttgcggagttgtaattccgctgtaaaattcagaacagcagccggatccgtaggaaaaacagccaattcgtttaggcgtatcaaatctcccttggtctatcgtgctggccaatgccagaaacaaggctgcccccataatatttccaacccgttgacagtagtttaaacctggttttacccgagttaaaaaatccgtctcaatcccggatgttttcaccttcgctaccttacgcatcattgtccggtgcgcacctttcaccatcccgccaaagggcgtatggtaagcaagatattgaaacgtgtcctgataattggcacccggtacacgcttttgatattccagaaaagtctgttcgcagcaatccaaatatgacattaaagacagatcagaatctcccgcttcactgtcgggaatggggcggcacgtgtccatcacttcatagccgtaataaccatttgctccgggatctatttgaaacacctcgggattttcgccaactaaaacggccaccgctcccgctccggcgctcggttccgcataagaccaatcttcgcttaaagcgtctccgccctcagcgattaaaaaacgtgaaatatcactggcgataaccagtgctttggcacccggagaagtctgggataatataaaattcaccgccatctgaaatcccgctgtccctgaataacacgcctgtttaacctcaaacaaacggcagttgcggttgagacctaaatattcatggatatatgtacttaacgatttcccaaagtcgatcccggattcagagcaagtgatcagcaattcaatccggtccttctctgcttcagataaagcatcaataatcggcttagctgcattgactccgaaggtcacgggatcttcataaggcagtgctaccgctttttctttcattaataaattttcaaatctcgcagtatctaagtgtctgtatttggccagctccatgacatcaaggtatgccgttccgccaaagacattcatcgcttctattccggctgaaaccatttatgattcgcctccacatttctcaatgttttgtatacaaaccgcggtgttcattccgccaaaccccatgcttaagctcagcgcatttttgatgcggtatgaaatcgatttctcatttacccaatgaaaggaatcatcgattggatgatccaaattcctgctcggatgcagggcagattttttcatttgcagcaaaacagaaataatctctacgatgcccgccgcactaagcccgtgtccggttatcgattttgttgcattgatataagcatgggaaagccggcatgcacggagcgcctttaattctatttcatctccaataaaagagcctgttccatgaggattaatataatcaatatcttctggtaaaagcctggcacgctccagtgccttctggatgacatgaatctctccttctaatgaaggatcaggattccggtttccgtccagtttgattgaccagccagacaatgctgcataaggttttagacctcttcgtaaagccgtctcctttcgttctattaccaatgcaccgcacgattctccatagataaacccgtctctgttttgatcgaagggacggcacgcattttcaggttcatcagcatatttgtccgtccccatagcgcctaaagcccttagcgcctcgcattccatataagaaagatccattaaagcaccaagtgctatgcaagtatcaacttcgcctgacaggacttgctgaatcgcatgaatgactgctaactggccgctggccgaagctcctcccaccgtatatgctaatcccgtgatgccaaactgatctgtacatatcccgcaaagatcgctgtccatgaaagacagaccatacgccggagaaataaaaccggagcggtcttgatacctttcataaacttcaaagttttctctctgttgaaaatttgatccgccaacaaccagtccgatacgtgaggaatctgcatcgtccaattcagcctcctcccaagcctctgtgagagttaccaatgcagcgcggctggagaatgatgcttttcgcaacatttttttagagagtcggtcaggataagacaatgacgcaatttcggctccgataaaccggctgtctttttgtctgcctgaacgcttcatgacatcaaaggcatgtctgccggacagcagcgaggaagcaaagtcctctttcccttgaccgatagaggccgtaacgcctacaccggtcaccaccacctcaggcagattgcactttgtcataaagcacctcagctaattcaccgatgtttttcaccccggatagctcaatgcgagggatttttaacgataaatcctctagcaccatcgtgataatttcagctctgtctacagagtcagctcctagctcaactaactgatcttcaggctcaaatctgtgtccgtctaattcaggaagcacctcgcaaatattggtgattaatacttcaaagattctctgtttatccataatgcgctctctccttcaagggattattttaatgatttttataggtatattttcataatattcaaacttttatttttatgttgtctgtttcatgcgacggctgatacatcgattgcatccgttcatgaagcaatactgccgtttctgtcattaattttttcccgatttcatccacatggcggtttcgccaattttctaattgcgaccctttaacccattgattaaaggctcccagcgcgggaccgcagtgaatttgataatcgaccttcgaatgttcgcttccgctgattgccaattttgaactgtatctgaagtaccatcggaaaatcaaagccattttatgcttcgggttttgttcagccttctcaatgtctgccgcgggataatgcaatgcaatatctttatatatgtcttctatactgcgtttaaagtatttctcctcaagctgggccagcatctttgcatccagctcacgtatagacccataccgctgatacagttcatataacttgtttgcccgtgcgggaaagaacacgcctttctttagcacctgcactttactgcccgattcaaacatatcacctgcaggcgcataggctgtatcttgtacattcatctgctgaagcaaatcctttactttatcacttgttgccgcctcaaccgtacattgattgattgagcctgttagaataaaatcagcccctagcataaaagccgccatcgctgcctcaggtgttccaattcctccagctgcaccaactcttatttttttccggtattgatattttttcatcatttcatctcttaaagatgtcatcgccggcatcaggctgtatgccacaccgccatctgtatgaccgcctgaatcagcttctacacaaatatcgtcagccatcggaatgcaccgcaacaactcagcttcgttcatagtgattttattttctcctaaaagcttttgcagcatattctcaggcgcaggactcagaaatgattctgcaacttccggccgtgatatttttgctatgagacgatttgagcatataacgtcaccattttgatttcgtttcactccttttgcgcgataccttactaatacaggagtgacacttaaaaatgctgaagcctccacaatgctcacttgattcctcaataaaagatcgatcattttttcttctgattcagtatgtttcatattgtggaccagattgatgccgtaggcttgtccttttcctaattcaccttgtatagcatggatcgcatcttcaacctctttcaggctcagacctcctgtgccaaagaaccccatcattcccgctcttgacagctttactaccatttctttcgaagcaatgccgcggtacattcctcctgcaagataagcatatgtaagatgataatcttgtttaaattcagcacttcctaaagattctgccgtaatcccggcttgaacattgcgttgctcctttagatgcgcactgatcgcggggttctttttcggtatatatgtcaatggttcagcttcatttttaatccgatgaatgagaccggttaaaacagttccaggcccaatctctgcaaactccatttctcctcttcccatcagaaaacgaatgctgtccgtccatttcactgtgttgtccatttgttcagataatgtatcttttaatctgtcttgatggtatggctctgcgtagacattggagataaccgggatcgccaaaggtgcaaactggaatgagtcaatatattgcttaaatacctgtttggcttcattcatatatctggaatgaaaagctccgctcacatttaatggatgaaacagctttacatccttggtgttttcaaaaacagcccgagctttttcaatctcttttttcgggccagaaatcacaatttgctggggcgtattttcatttgccacatcaatgtcataaagacggtgctcttctaaaacggctgtaacttgttccttactcaggccgatcacagcagccattccgccccctgtaattcgtcccatcaattctcctctttttttgacgagccttaatccggtttcaaaatcaaatgcaccggctgccatcagcgcattgtattctcctaagctgtgtcctgccgcaaaatcaggttttctgccggtctcctccactctcttcaagtaactgagtgcattaacaacatacaaagccggctgcgtgtattcagtatgatttacatccagatatgatttttcggtacatagcttctctattgaatagcccaatatttgatctgcttgatctgtcaaatgctgatactgttcaaatagcccttgtcccatccccttttgctgggagccttgccctggaaagacatatgtaatcatcttgtaaacttcctttctggtgtacggaaatactcaaccgtattcagatttttcagctcctgatgaaatggtgttatgattgagcagcaacggtcagctgaatcacccggaatcagctgtttcacaaaagcagctaaggtgccggatggccctaaatcgataaacttgcatgtatgctggctttccaaatatcgaatcgcttcacgaaacatcattggctttctgaccgcattccaaaagaaattctcgtccattacgtgaaggcagcttcccgttaagctcgatacaatcggtattgacggtttttgaaaagattttgatcttaaaaattctgcataggcactctctgccggatcaataagcgaagaatgaaaggcataggacacaggaagcagctggcaaagaatctgcttctcctttaaatcctccataatcttccttatatgatcttcttcaccagaaatgacgaagtgcgaatcataattgatagaaatgagttcactatttccaaacagttgcggatgatcattcagcaattgcggtttgtcaagaatggccagcatttttcctttatcgcaggaattctggatgataatagcctgttcaagtatgcaatccagcatatcctctgcgtctgacacaccagaaactgccgctgctgcgaattctcccagacttgatcccaatacgtaatcaggataaattcccctgtcttccaaaaccttatataaggaatactcaatcataaaaatggcggggtgggaaaaaagaatactgtcaaacggatctgacacacgtttacctggatggtagatttcttcaacaatggatgtgccgattcgccgtgctgcaatggcatccatttcaagcattgattggcgaaacacggtattttccttaaatagttctttccccatgtgatagtattgggaaccttgcccggaaaacataaaaacaagcggttcattcatgtgtataaccttctttttttatatttatgacggctattggatttctcatttccatgcatgttgttaaagcacatagcagcgattgaaatgaaattaataaatggaaaagacatatgtgaaaaagtaaaggagattcaacttggaaggattgctattggtgctctggatgtggttcatttatgacgtgatcgtagatgtatgttgatatctcaaaattgatgtaacatgataacaggatcagcaaagaacatcgactctatgattggtgggtgcggtttaaaaatggaccatctagatgtgggagcgatggtttgacagaccggctgacatagttcaaatgtctaacttaatttatcagcctctttatgtaacagtatataaagttattcaattagaaacagtgtcaatcgaacgattgaatctttaaaactttataccttaaatgaaaggaaatctgtgtttagacctgattgatgagatacatggccataggggcaaatgctttagcggggcattgcttccgcatctttctttatgcgatgaattaacccagttaaaacatttccaggccctacctcctcaaactccatatggccttttttcattaagtagcttatgctgtcagtccatttcactgaatgattaatttgatcagccagcgtctgtttcatgaattcgtatgtatacggtttggcatacacattagaaataaccgggatagacggaggcgaaaaataaaaggcatgaaggaactcctcgaattcttcttttgctttattcatgtatctggaatgaaacgcgccgcttacgtttaaggggagtaccattgtaacttcagtcatcgtttcaaaaagagatgcggctttttcaatctcatctttttttcctgaaattacaatttgatatggggcattcacattagcgatatcaacatcatgtaaatgatattctttcagagcctttgcaacctgctcttcatttagtcccataacagctgccataccgccgttgcttatcagactcatcagctcgcctctttttctgacaagctgtaaacctgtctcaaaatcaaaggcttcagctgcaaataacgcattgtattcacccaagctgtgcccggcgacaaagtcaggtttaacttcttcatccctgatttttttcagatagcttagtgcgtttaccacatataatgccggctgagtaaattgcgttttgtttaaattggaataaggattttccaggcaaagacgtttgatagaatatcctaagatctcatctgcctgatccgtcagttctttaaattcatcgaataggccgctgcccattccctgtttttgtgaaccctgacctggaaaaacatatgtgatcattctctcaaagccacccttccgattagtagatgtgtttcacttctgtatgattttataatagtgatgaccggataaatagtagcatgttcatgttgatggtaacctctgtaaatattatccgtcaagttaatttttcctacagtttgctccattgtttttctgcttttttccattgaggaataaaggatcaggagatataacagaacataagaaaaaagacccggattacatatagggcgccatatcatgataatgcgcttcattttctttcaaatgagttttcaaaataaataacaccttctatgtaatcattttcgaaaataaaaatcatttagatattcgaagaaaaataggataatagattcagaaggattatttaaaatcaaaaatacctttttggtttttacgagtgcgaaatttcacaaaatattctttcttatcaatttgaaagtaaatattatgctgataaagatcctttatcgaatggccgggcgatttgccaaatgagtgaccaggatacacccgtacatggggtgaaacctccgactttattctttgaatgctatcaaacatctcttccgcagagctgccatcatcctcacatatgccgcacccttctgtaaacaccgtatctccggtaaaaatactctcagaaaacaaataacacattccgccggctgtatgccccggtgtgagaaggcactgtgctcttgtgtttcctatgctgatcgtctgatgatcatctaggctaattaaatttctgcatcggaattgataataatcaatttcttttttcgacatataaacttgagcgttaaacatcttcgtcagcgggtctaccagatttacatgatcataatgagagtgtgtcaatgcgactgcctttaattccgcttcgagttcggaaagtgtagtggttatcttactcaattcccatgagggatcaacaacaattgcagatctgcttacaatatcttcaatgatatagcaataattcgtccagccctgataccttgttttaattggatgcaccttgtaagtaagattcatttataccatccctatcatgtaaagttcttaaacgatggaccagtgttcacccctcagtccgtctttcattccactttaccaaacagcatgattgttttccatttttttcagagatccttgttctttgaaaataaaaaagcgactcttttggacgcatgcccaacaagaatcgcttttcacactagtgccttaaggatgtcgtttttgtgtctcacgtgtatcttccacgcaaattgactctacatgctgcataatgacccgcttgattcggtctttattcacgcgcacagggtcaagcatggcatgtaaagccaagccgtcaacaagcgcgtaaagtctctcagcttcaatgtctttatcagcattctgcttcagtaaatcggattcatctaaataggcaatcagattccgcatgccgctgaaaatcccgtcatgactcgcatcaaacatatcctttttatgtctggcgtaagcagtaaaagcaaaccaaacctccatctctctaatcgtttcttcattcgttgggaccatttcaagcaaaatttgcaacactttttccttagggagcaaatccctcactgcaatgtccttaattcggtccgttaccttttcttggacaagtttcattgcaaaagcaagcaattcatcctgtgtagagaaataatggcgcagcgcacctaatgacaatcctgcttcctttgcaatatttctggctgatgctccctccatccctcgttctaaaatgacgcgccacgttgcttctgcaatttgttttcttcttttctcatggtcaatttgttttggcatagctttattgtaacaagaaaaaaatgagagggcaatttttataatacagttgtgttacaaaaacaaagatggtaacatattatttaaataatacaactgtattgaaaagaggggaatggattgaacggtatcgcatggatgattgttttctgtgaaattgcgttttgggttgtcattgttttggggcttgctgtacgctacgtattcaaacgacatacattaggactgctattccttgccttaactccagttatcgatttgatcttgttagcggcaactggtgtggacctttaccgcggagcctcagcgaccgcagcccatgggattgcagctgtttacatcggtatatcgatcgcttatgggaaacaaatgattcaatgggcagatgaaaagtttcaatattatgtgacaaaaaaaggaacaaaaccgctgaaacgttttggaatggaccatgccaagcacggtgcgaaaggctggctaagacatgtgctggcctacttaattggtgcgggactattggcagggatgatctattttatcaatgactcttcccgaaccgaggcgttgagcggcattcttaaactgtggactgtcattataggcattgactttctcattacagccagctattttatttggccaaaaaaagagaaagcttcggcgaatctcaggagttaacatgatgaaaaaggcccttccccagtggaaagggccttttttggttttgttaaaatatgctatactattttcgtcagaaaacagacttatagatattttgggctgattcaagggtgctgtttgtatgagtaagcaggtgaagggagtgtcatacatgaaccaaaaagaacagaacgagcactctaaagattttaacctgagatcaaaattaatcggaattgtatctattacttttatcgcggccatcgcgcttgcagtcatcttcggcggctttttcttcgggatgaaaggcttattctccatacttggcatcacatacgcttccaatcaaacattagctttatttattttagcctgctttgctgtaggtttaatcatagacccactcacaaagattatctctatcattttggcaaaatcactttcattgaaaaagactgcactttttgcttttatactgtattttatcagcaatcttataacgatctgttttgcagattactttatgcagtctatttatattccagatgtcttgcttgttgtgatatcagctttcatggctatcattgaacttgcttttgataaccagcctaatagagaagcagcttaaagccgatggcagatatggaaaattcataacaccctatatttggacatcaccagttatataaacgaaaaaatctccctgttcacacgaacagggagcaaaacacaatgttgtaatttaaattctgcattctaaaatgattctcacatttggatcatcaagttcatccaaaaagataatgatcttcggaccacatgccatatgtttccaccccctcacccaaaatatacattaatcccaattgcctgtaaatggaaattttgttatacggaggaaccatgaagtataatgcgttaacactgctcacacgtttacaaccgtttcttataatctgacactcgaaggagtacaaaaaaagcattgatccattcagagaatggatcaatgcctaccacccccgctacatcacgcgtttgaacatcttttccatctcatatgtcgagtggtgaatgatgatcgggcggccgtgcgggcatgtaaatgggtctgatgtgcttcggaggtcgtccagaagcgctttgatttcgtcgtttctgaggtggcgatttgctttgatggagcctttgcagctcatcataatcgccgcttcctcgcgaagttttttaatatctatatttttggagtcgagcacctgctgaatgatttcttctataagctctgcttcttctccctttggaaaccaggctgggtggcagcggacgatgtaactgttagagccgaatgactctaaaaagacaccgacgctttcgagctcttgtttgtgctgttcaataatcaaagcctcatttgtggagtagtggaacgtcagcggtacaatcatctcctgcacctcaggctcaacctcccccaccttttcacggaagtactcatatttaatacgttcttgggcggcgtgctggtcgataatatataggccgttttcgttttgtgccaatatataagtcccgtgcatctggccaatcgggtacataattggaacccgatcagacgctggctgcggctgttcctcatggcattcctgctcaaatgtttcaggctgttctgctgaaacatcggacacctcaagggtttgttcctgatcaacgataggaggagcatcaaattggagagggggcaatttttcctccgcatcaaccggctcttttacgactgagctgagcttcatcggtgaataagatggcgcagtcgatttttccggaacttttttttccggaggcttttcatcaaaggttataaactgctgctcatttttgatggcaggtgctgattttttcgggacctgggcactaggaatcagctgctgctgtttaaacacatctttaattccgtcacgtattaagtcatgaagctctgtttccttgctgagccggacctcaagcttcgatggatgcacgttgacatcgactaaaatcgggtccatcgtaatttctataaaagtaatcggatggcgtccgatcggcagaagcgtatgatagccttcatgaaccgctttgacgagcgggaaatttttaatgtaacggccattgaccacagacgacatatagtttctcgacgcccgtgtaatctctgggagggcgatatatccctttacttcaaaatccaaggagctcacatgcagcggaagcatttttttggcgacagccgtgccgtaaatcgctgccagtacatggcgcacatctccgtttccgttcgtttgaagcaggtttttcccatgatggcgcaggcggatcgatacctctggatgcgccagagcaatacggttaaccacatctgtaatgtttccaagctctgtatgaacggttttcatatatttcaaacgggccggtgtgttaaaaaacaggttggaaacgacaatttcagttcccttcctgcttgaggaacgcgattcggaaatgatgtttcctccttggaggacgagcttcgtcccagctccttcaccagtgcttgttgtaatctccagatgagagactgacgcgatactcggcagggcttctcccctgaaaccgagcgttctcaccctgaataaatcattttcatcttttattttactcgttgcgtggcgccggaaagctcgcttgcaatcttcattctccattccttcgccgttatccaagacccgaatggatgcaaggcctgcttcctcaatatcgatttcaatgactgtgctgtcagcgtcgatcgcattttccaccaattctttgacgactgaggcgggccgttccacaacctcgcccgccgctattttatttgaaagctcatctgacagttggatgacttttgccacattcatcaccccgttttaatgtaatttcttttgcagcttgtacatttcattcatcgcttcaagcggtgtcatatccagtatattaagtgatttgaaagcatcgatcacttgcttttctttttttgaaagctttggtgtttcagccggcttttccgcttcgtcaaaaaaggacagctgtgccggctcttctttcacctgaggtttctgcaccggcacttccggtttgtttcctgaatgctcaagctcttttaaaatatcttgagcgcgcgcaatcagatctcccggcagttcggcaagctgagctacatggataccatagcttttatcagccgcaccttctttaatttgatgaagaaagacaaccgttccgttatattcttcagcgcgaacatgaacgtttttcagctggggcagcttgtcctcaagaacggtcagctcgtgatagtgtgtgctgaacagcgtcttggcgccgatatgatcgtgaacatattcaataatcgcctgtgccagcgccatgccgtcataagtggacgttccccgcccgatttcatcaaacagaatgaggctgtttttcgtcgcattgacaatcgcatttttcgcttcaagcatttctaccataaatgtactttgtccggaaatcaaatcatctgcagcgccgattcgcgtaaaaatttgatcgaaaatcgggagcaccgcttttttcgcgggtacaaagcagccgatttgcgccataatggaaatgagcgcgatttgtctcatatacgtgcttttccctgacatgtttggacctgtaatgagaagcatttgtctgttatcgcccatcatacagttgttcgggacatattcctggctgtccatgactttttcaacaaccgggtgtctgccttcaatcacttcgacttcatctttagagaactctggtttcgtgtagtggcgattttcactgattgtcgcaaagcattgcagtgcgtccagctcgctcatctgttttgcaagctgctgcagccgcggaatatactgcttcactttctcgcgcagctcggtaaacagctcgtactccagctcacagatgttattttccgcctctaaaatgagcgcttctttttcttttaattcaggtgtaatgtagcgctctgcattggttaacgtctgcttccgctcataacgcccttcctcaagcaaatgcaagtttgcttttgtcacttcaatgtaataaccgaaaactttattaaagccgacctttaaagagcgaatgcctgtgtattcccgctcctgctgttccaggcgggcaatccagtcttttccgtttctgcttgcatcacgatattcatcaagcttttgattataaccatctttaatcaggttcccttcttttaccgataaaggagggttttcgtacagcgcttcttccagcagttcaagtacatccccgcaagggtcaatgcgctttgcacgttccttggccttgtcatgagccagtgaagcaaccagctgtttgatgccaggcacttgctttaacgattccttcagctgaatcaaatcccgggcattgacatttccgaatgcaacgcggccggcaaggcgttctaagtcatatacttcttttaaacgttcacgcagatcttcccgttcaaagaaatgggacattaatgtttccaccatttcttggcgctcttcgatttgattgactctgataagcggccggtcaatccactgtttaagtagccggcctcccattgccgtttttgtttcatccagcagccacaaaagggagccttttttatttttcgaacgaatcgtttcggtcagctccagattacgctttgagtacaagtcaattttcatcgcttcctcaagctcatacacctgcacgggctgaagatgatcaaggctgcgcttttgggttcttttcaaatacgtatataagcgcagaaatgtttttgttatatcttcattatttaagtgctcaatgatcgttacgtgttcgtctgtttctccgtcttcaattgaaatcgttgcaccgcaccgctctctcagctgtgccactgtatcggcatccaagcttcctgaaaccacgatttcccgtgcgccgactgaataaatttctgatatgacgtcttcaagccgttcaatcaaaacagccaaattttctcccgttgttaaatcagacagagcaagtccgtatccgttcgagcaggctgaaacagatgcgataaaattattttccgactcatggatgcctttgccgtccattacagttccgggcgtaatcagctgaactacttctcttttcacaacgccctttgcggctttcggatcttccgtctgttcacagatcgccactttgtatccttttttaataagctgttcgatatacgcggaagcagaatgatacggcacaccgcacatcggtattttttcagccgcaccgccgtctctgctcgttaacgtaatttccagctcttgtgacgcttttttggcgtcctcaaaaaacatttcataaaaatcacccaggcgaaaaaataaaaaggcatcctggtgctctgcctttatttttaaatattgctgtatcataggcgtataaccggccattgtttaatccctcactatgtatcaacgtttctattttccaaccttcattataacataaacaaaaagtgataaaagaatgatatatcaatataaaaaagagacttgggggtactgtctcccctagtcccttttttattcttcaggatctcccactaaaaactccgggttgatgtcttcaagctcttcatcaagctcatcttcccaatcttcctcgtcatcctcttcccagtcaggattgacctcaacaactacctttgtttcccctaccacttccgccaaaaattctctttctgcctgcacaacgattttatttccattcggcgaaatggtcacttcaaggcagtttggctgctgaagcactttggcaatcacttcatgctcatcatctaagtaattattgtctctgtatctgagtttaatgacatctacatattttacccgttctgtgacaacctctgtctttgtgttgtccgcgtaagagtaccatacgtttatatcataatacccttcaatttctaccgtttttccaattttttcagcgtcatacttgtggttaataatccaaccacccaaaatgctgctcggttttttctcaggcgagatggtgttggtgcattgggtgaattttcggcctttcgctactactgccttcgtaataatttccctgtattcagacattccggcatgcctccttgttcttcttcgtgttatcttatgctgggcatttgtctagtgtgcatttttataaataaaatataaaaatacaaagtttctgttccattgtatgcaggggtgcctagaaactttacttataagtgcgataaagtttatacgcggctgagcacagaaaaaccaattgaacatttggtacatagattatttagttcatttttaaccgcacaaatgataaaaaaacacgggcctgtaaaggcaccgtgtttagagagaacagctgttatttgaatgcttcacctttgaaccggtttcccctttcagcaggtcgcctccggttgatgtgatgatttcatttgtgacttggttggaaatggtgtgtgcaacgagctgcagtaggtcatttacttccatttgcgagtctctgaattcctggataacaggaatctcttcaagctcttcttgcagcgcgtcaatttttgcttctacttgtttgagcgcttcatgcttttcataatgcttcagattgacagcctgcttttgcagggctttaatctgattaacgattgtggacactttgtcattctcattgatttgcgcttcagcccgtttgaaaaaatcaacctcttctgtttcagaaatcatttttgcaaggtttcgagcctgctgcacaatgtctttttttgagtagagcgtcatctcatttcacctcgattgcttctcctaccatttctccgtcaagcgaccatgttttcgcttgctggattttcacgcggacgattttgccgatggcttccttcggccctttgaaattgacaagcttgcttttttcagtatagccagcaagaatatcagggttatttttgctttcaccctcaactaatacttcgacaaccttgccttcgtattccttcatttttttagcagaaatttcattcaccagtgcgtttagacgctgcaggcgttcttttttcacacgcatcggtacattatctttcatcttagcagccggagtgccttcacgcggagagtaaatgaacgtataggcgctgtcaaactccacttcacggtatagagaaagcgtttcttcaaactgttcgtccgtttcatttggaaatccgacgataatgtccgttgtcaaagaagcgtttggcattgcttctttaatttttcgcaccagctccatgtaacgctctctgtcatatttgcgggccatcagcttgagaacttctgagcttcctgattgaaccggaagatgaatgtgatcaagcagatttccgccttttgccagcacttcaatgaggcggtcgtcaaagtcgcgcggatgactcgttgtaaaacggattctcgggatatcgatttttctcagttcatccatcaaatcaccaagtccgtacgtcatatcttcaaagtcttttccatacgcgtttacgttttggcctaacagagtaatttccttatagccttcacttgcgagccttctcacttcctgaatgatatcctcagggcggcggcttctttcttttccgcgtgtgtaaggcacaatgcaatacgtacagaatttgtcacagccgtacatgatattgacccagcccttaatttttccatttcggacttttggaaggttttcaataacgtccccttccttagaccaaacttctacaaccatttcttttgaaaggtatgcttctgacaaaagctccggcaggcgatgaatgttatgcgttccgaaaatcatatcgacaaacggatgttttttcaaaatacggttcacgactgattcctcttgggacatacagccgcacacgcctaaaatcagatcgggattgttttttttcagtgcttttaagtgcccgagctcaccaaacaccttgttttcagcattttcacggattgcacatgtatttaacaaaatgacattggcatcgtcaacagagtttgtcgcttcgtaaccgagcgccataaagatccctgccataacctctgtatcgtgttcattcatttggcagccgtacgtacggatatagaactttcttccgtctcccaatcctttaaattgttcagaaattttaaagtcattatgataagtaacggcttccttgcctcgttttttcgcgtcttttaaagaaggcggaatgtaaacagcttcaaagtacttgctgtaatccttctcggattttttgtccgatggatgaacttgtccgctctctaatttttgtttttcattcatgtcatattttctcctttcaaaccaaacttccacccttcagtataaaggttattgaagctctgcacaactggcaacctatcattgtacactcattgagaataataatcaataaggaatcaaaagaggaagagtaaactcttcctcttgttacaatagctggagctcctttgccgtcttttcgatgacatcaagcgcctgatccagttcatctttggtgtgctctgctgttataatcgtgcgaattctggcttttccctttgctacagtcgggaaaacgatactttgggcaaaaacaccgcgagaaaggagctgatctgaaaattgctttgccacaccttcatcacctattaaaataggaagaatcggcgtttcactcttcgtgagagtcagacccattttcacaagcattgctttaaaataggcagtattctcccacaagcgctccatatgctccggctcttcaagcaagacatcaatcgcttccatacaagctgcagtgactgccggcggatgagatgtgctgaataaaaatggacggcctttatggcgcaaataatcgatcagcacctttgaacctgcagcgtagccgccgagcactccgattgccttgcttaatgttccgacctgaatatgcactctgccgtcaagaccgaagtgattcaccgttcccctgccgttttcgccaagtactccggatgcatgggcgtcatccaccatcacaaatgcgtcatatttctcagcgagctctacaatatcaggcagaggagctatgttgccatccatggaaaatacgccgtctgtcacaatcagacgcatccgataattcattgactttctcagcacccgctctaaatcactcatattgacgtgctgatacacctttttatccgcctttgtcagtcgaattccgtcaataatagaggcatggttcaattcatctgagatgacaatgtcctcttttgatagaatacttgaaagtacgccttggtttgttgtgaagcctgattggaatacaagtgccgcctccgtttttttaaaggctgccagctttttctcaagctcttgatgcattgtaaatgtacccgcaatcgttctcactgatccggtgccggctccatactgctgaacggcctcctgtgcggcgttgatgagtctaggatgtgaagtgaatccgaggtaattattagaagatagctgaatgactttttggtgattcactgtgacagatgggccctgcatagattcaagctgttttatgtcttgccatgtatggttttctttcatactattaagctctgcttttaaaaactcaaattccttcgtcatgtttatccccctttatggaattaaaattacttttccgcactgcccgcttctcatcagttcgaaacctttttcaaactcctctaatggaaactgatgggtaataacaggtgcaagatcgatcatgtttgaactgatcaactgagacacctggcgccatgttgaaaacatttttcttcctgtgattccttggatggtaagccctttaaataccactttattcgtcaaatcaattgtcaccggatgttccggcaagctgagaatatgaaatcttccgccattcgcagccatcgcaagaccttgggcaatcgctgagggatggcccgacatctcacaaacaagatctgctccttctccactcgttaaagcgcttacaattttgagcgggtcttctttttcaatagaaacagtacaagtcgctcccatttgttttgcaagcctcagcctgtattcattcttatcaatcgctatcacctgagaagctcctgctgcttttgcaaccgcaacagccataagaccaatcggtccgcatccaatgactgcagtcgttcctcctgcaggctggctctcgagtacggtatgaactgcatttcctaaaggctcttgaatggaagcaatcgacgggtccatatcagcgggatttctccaaatgttatcagctggaacttttacatactccgcaaaacagcctgccgtgtccactccgattatagcagtattggtacacacatgagattttcctgttaggcaagggacacattcaccacagacaatgtgtgtttccgcagacacatactctcccacttttacactgctgacattctctcccacgccctctacgatgccgctgaactcatggccgaaaacatagggtgttttgattctctgacgtgcccattgatcccaattataaatgtggacatccgtgccgcatatggaagcggctttcacttttatgaggacttcatgtttatcaatctcaggaatgggaacttcagtcagcacagcaccgaacgccccgtcctttttcattagagctttcatctttccactctgcatgtacaatcctccttgaaaaattcttgttatattcggattgtaccatgatatggaataagcgtaaacagaactgtcttttccagaaggacaaaagtatctgtcttgaaaaatgggcggaaattttttttgaaacgttttagctcatttctgattttgtatattcgctcatttatgtgctaaaaatactatcgggagaaaatatcacaataaatgaaaaacaacctgtttgcattacgcaaacaggttgagaatgctttatttgtttttagcgaggctccacgattaatttaatcgctgttctttcttccccatcgatttgaatatctgtaaaagccggaatacaaatcaaatcaacgccgcttggcgccacaaatcccctggcaatcgccacagcttttacagcctggtttaatgcacccgctccgatcgcttgaatctcggcggctcctcgctctctcaacacgcctgcaagcgcacctgccactgaatttggactcgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttttactatattcactaaggagttgctatattcctgcttttctttttaatatttttataaaataaccatatgttcaactattcaaagaacatgtgatcatcgttgattaaaatacgctcaattttcacggcttttttcgtttgatcgtcaatgtcaatgacaactccgctgagcgttgtttttccttcagcgacagtaaaccggactggaaggttcgttttgaatcgcttaataatcgtctctctgtccatccccagtataccgtcatacgggccagtcattcccacatcagtaatatatgccgttcccttcggcaaaatgcggttatccgctgtttgcacgtgtgtatgagttcctactacagccgatgcccgtccatccgtgtaccagccaagtgcgagcttttcacttgtcgcttcggcatgaaagtcaataaaaatgtacggtgttcttttcgcagcttctgcgatcaattcatccgcttttaaaaacgggtcatcaagcggcggcaaaaacgtacgtccctgcaaattaatgactgctagttctttgccgtttgctttcacatatgtgatccctttccccggtgttccttcaggaaagtttgccgggcgaaccaagttcggaacgtcatctataaaatcaaatatttcttttttgtcccatgtgtggttccccattgtgattgcatctgcgccggactggattaagctgtgataaattttttccgtcaggccttttccatgtgcggcgttttcaccattaataatggtaaagtgaggcttatattttgtttttagctttggtacatattctttgaccatgtcacggcccggtgaaccgacaacatctccgataaataaaattctcattttgtaaatcctttcttcttgaaaattccttgccgtcaaaaaaataaagtgatgcttagcgcatcactttattttgcatactctacggctcgagtctctctgattactgtcaccttaatatgacctggataatcgagctcgtcctcaattcgcttgcggatatctcgcgccagtcgatgagcctcaagatcattaattgaatccggcttcaccataattcgcacttcgcgtccagcctgaatggcaaatgatttttcaacaccttcgtaggactcagaaatttcttcaagtttttcaagtcttcgaatataattctcgagcgtctcacttcttgcgccaggtcttgcagcggaaagcgcatctgctgcagctaccagtacagcaataatggaagtcggctcctcgtccccgtggtgtgatgcaatactgttaatcacgactgggtgctctttatatttggtcgcaagctctaccccgatctcaacgtggcttccttctacttcatggtcaattgctttcccgatgtcgtgaagaagacccgcacgtttagcaagctttgcgtcttcaccaagctccgatgccattagaccggccaagaatgcgacttccatggaatgcttaagcacattttgaccgtagcttgtacggaactttaagcggccgaggatcttgatgagatctgggtggaggccatgaacgccaacctcaaatgtcgtttgctcacccatctcacgaatatagtcatcgacctcgcggcgagatttttcaaccatttcttcaatccgtgccggatgaatacggccatcctgaacgagtttatcaagagcaattctggctgtctcacgtctgatcggatcaaatccggaaagaatgacagcttcaggcgtatcatcaataatcaggtcaattcctgtcagcgtttcaagcgtacgaatgttacgcccttcccgtccgatgatacgtcctttcatctcatcatttggaagattgacaactgataccgttgtttcggcaacgtggtccgctgcgcagcgctgtaaggcgagtgaaagaatgtttttcgctttcttatccgcctcttctttcgcacggttttcagtttcttttgtcatgatggcgatgtcatgtgaaagctcgttttcaacccgctcaagaatgatttgtttcgcttcgtcacgagtcagactcgaaattcgttccaactcagactgctgcatacgaatcatctcatccactttgctttccatctcttcaatatgttgttgtcgttcattcagagaatgatctttcttctccaacatcgcttcccgtttatcaattccctcatgtttgcgatcaaggttttcctccttttggagtaaacggttttcttgtttttgaagctcatttcgtctttcacgaacttcctgttcagcatctattcgaagtttgtggatttcatcctttgcttcaagcagagcttcttttttcagtgcttcagcatcacgcttcgcatcttcaagaatttgctcggctgcaccgcgtgcgcccgcaattttcgcttcggcaatggttttacgaacaaagtagccaacaactaaaccgagtagaatcagcaaaatggagatgagaaccatcataattggggtcatactttcacctcctcttgctatgaacttggttgttgcttaaaaagtgtcggcatgtacattgtctagttttctcaacatacagaaccttcacagggaatgagtgtgttcatcgcccttgtcaagtttaaatggtttaacaatcatgttaaaaaaacaaatgttacaacttcattgtaaatgtgtcggaaatacttgtcaagcttgccatcttaacgtttgcaggccagtcttcttttcacgtgccgaatgcaattcatccaaaagaagatcgccaatcattcttgatttagaagctggtatattttattgttcacttggcccaatttagcattattttgaatgtttgagaacaaaataacaatggtttgcccagatttgctaaagctgttcaagatattgaagcccggcataacaccatggtttgaatagcttccgggagcaacataaaatcccatgccgtatgtggagctgctccctggcgtaaacatcttttcatagcttttttgcgaatacagttttccgtctatcagcgcttggtcaaatttgtacatatctatagcgctcatataaatatcacccgctccatacagctgggataaatcaggtatatacggtgtaactgttttgctgccctccatcttatacccgacggcaggataaggttctttttcatatgttttgtaaaagcctgcatgcgtcattcccgcaggtttaaaaatatgattctttatgtactgttcatagggctcaccgcttacttcagcaataatataagcaagaacagaatagttggaatccttgtagtcccatacgcccggctgacgtttgattccctgaagttctatatcttttattaaatcgtccggagtaatggcgccgtttccttcaatatgtccgtttatccccgatgtatgtgtaagcagattcttcaaagtaatcgtttgtccgttgggaaaatgaggtaaatacgtgcttaccggatcacttgtctgaagtttccccttttcctcaagctgcaaaatagcagttgcaatcagcgctttttgtgatgaaccgacataaaaagatgtcaatggattattttgaatgtagtgtttacggtcagcatagccaaaacctttatttgttacgatttctccatttctgacaatcatggctgttccgctgaaaccgatctcttttaaataattgctgattttttggtttcgatccactgttttgatttgttcctctgattttttggcagttttctttttgacctcttttttctgatcggtatttgaaaccgctgcagtttcttgagatggttcgttttcttcactatttcgatgaagagcattccaaatcgtaatgcaaaccatcactgctaaaagaccaaacaacagttttcctcttttatttagttttctccgtctgcgtttcgcagttcttctgcgggttgggcttgtcattcattttttcctcccaaaataaattccattttgcacacgttttgttagacgaataaagccctaaaaaagttgtcaaaaaaagcaatatttttatcatttttttgcaaaatacaaaaaagctgagtttttcactcagccttttgtatcatttgaaacttattttatttttattcttcaaattcgagttcttcttgtgtctcttcagcttgctgctgcactactccgttattatccaagccgtaatgttcgcgaatttgctcctggatcatcagcatgatatctttattttctttcaggaattgttttgcattttcacggccttggccaagacgctcttcttcataagagtaccatgaaccgcttttttgcacgatatcaagttcagttcctagatcaatgatttcgccttcttttgaaatgccttctccgtacataatgtcaacctcggctgtacggaacggcggagccaccttgtttttcacgactttgattttcgttttgttccccattacgtcgttgccttgtttcagctgttcagcacggcgcacttcaagacgcacggaagaatagaatttcaacgcacggccgccaggtgttgtttccgggttcccgaacataacaccgactttttcacgaatttggttaatgaaaatcgcgattgtcttcgatttgttaatggcccctgaaagcttacgaagcgcttgagacattaagcgtgcttgtaaaccgacatgcgaatctcccatgtcgccttcaatttccgctttcggaacgagagcggctacagagtcgacaacgacaatgtcaactgccccgcttcgaaccaatgcttccgcaatttcaagcgcctgctcgcctgtgtcaggctgagacagtaaaagctcttcgatgttaacaccgagcttttgcgcgtataccggatctaacgcatgctccgcatcgataaacgcggcttgtccgccctgctgctgaacttcagcaatcgcatgaagcgccacagttgttttacctgagctttcaggaccgtatacttcaataatccgtccgcgaggatatccgccaattcccagtgctgtatcaagagcgagggagccgcttggtacagtagaaattcttgtatctgtcttttctcccagtttcataatggaacctttgccgaactgtttttctatttgtttaagagccatatctaaggctgcctgacgatcactcattctattttttcctcctttatgttaccactacatatactataccctgtttgaagggatttgccaagaaaaaagcgaacgcatattcggattttttcttggcgtgattcctatcaaaatatcataatgtatcagagaaatcatgttttcttaggaggataatgtgctgaaaatattatttttgctctaaaagctttaagattaaatggcagccgtatttagcgccgcgttttctgatccccgttctggagcccgcaaagtgaaactcgtgaacctcttctttaccatttgcggaaatgccgataaacacatgcccaggctcatgcccttcttgagcatcaggtcctgctacaccagtaaagctaatgccgatatcgctgccagtgagtttttgaacacccttagccagttcggatgcgcactccttgctgaccgccccaaaacgatctaatgtttccttcttgacaccaagcacattctgcttcacgtcgtttgtatagcaaacaacgcccccggcaaataattttgaggcaccgctatgatccgtcagccattcagaaaacagccctccggtaaagctttctgccgcagaaattgttatgcctttttccttacatgctatagatagctcttttacaagagaagtatcatcgtaaccatagaaaaattcaccgacacgctctaagataacggcctctgtttcttttaacagacgctctgtttccttttcatcggcgtgtttggctgtcagacgcagcgtcacctctccatcagccgccaaaggcgcaattgtcggattggtttgtgcatcaataatatcttccaaatcggcttcaagctgagattcaccgataccgaaaaagcgaagaacagttgacacaattttttcatttgaacccatctttttcagcagaagaggctttgcctcgttttcaaacattggacgcaattcgctcggcggtccaggaagaagcatataatagcgcgattcatgctctgtgagcattcccggggccattccaaagtgattcgccagcacgtcagagccttcgatcacaagcgcctgttttcggttattaggtgacatcgtgcgttttgttcgtttgaaatagtcctcaatggattggaatgcctcatcatttaacacaagcggacgtcccagcgtatttgcaatcgtttctttcgtcagatcatcttttgtgggtccaagccctcctgaaaaaataatgaagtcagagcgttcttcagcaatgcggatgacctgcttcagccgctccgggttatctccgaccgctgtatgataaaatacgttgaccccgatttcagcgagctgtttgctgataaattgagcatttgtattggcgatttgaccaagcagcaactctgaaccgactgcaattatttctgctttttttggaaattccatgacgaagtccttctttcttagttagatgtttttaacgcttcccaatttttagagaaatattcccagcctgagacgacagtaaagaagacggctacccacagcgccaagtctgcaaacgggaatgacacaagttcaaatggaagattatgaagaagcaatgcagataccgcaataatctgtgcccaggttttgattttaccaagcatgttagcagctacgacttctcctgttccggctaagacaagccttaaacctgtcacggcaaactccctgctgataatcacaatgaccatccaagctggagcgagatcaaattgaacaaggataattaacgctgcggatacgagcagtttgtccgcaagcggatcaagaaatttcccgaagtttgttacgagatttaattttcgggcataatacccgtccacccagtctgttgtagatgcaataataaatagaatggcccccgccaaatgtgcgaccgggatggattcgtctccaacttcgagcctgccccagtcaaacggcgccagcatgataatcatgaagattgggattaatgcgattctagctagtgtgattttatttggtaagttaaacataaagcccctccaatttcatactcggacgtgaagaaaagtcatctggtaattaagatgacttttcttcctttttatttacaatctttatggtttgtgccatcacttttttcggatcaagttcatatgaaagaaccttaccgttgatttttattttcagattaggtgcatatccggtgcggatatcaacttgtttctgatcagttatgtcttttttataggtttcgtcttttttcagcgttccttcttttaaagagctgctgttttcatcgcgcactctaatccaggagctgtctgatgccttcagttccagctcgattttatcagcgccggacacttcataagtcgttaacgatccttcagtgccagcagctttaatctccagcttctcactgtcattttcttttttcttatcttcgttttctttcgtttcttttttagtgtctgtctctttttcagagctgttattttgattctctttcagcgttgaatctttagggatttcgtacttgctctcactttgcgtaattgctttttctgatgccgcattgtgatcatcactgtttttgtgattggcaaattgaatgatcgcgtacacaatggcaatcacgacaatcacgccgagaataacaagtattgttggcagcagctccagcgccttagatgctggctttggcatttccttttgaagattcatgccggagatcttttcagacacatcatcatgatacgtattagggatatcttttttatgctcctcaaacagctgatccgcatcaagcccaacggcttctgcatattgcttgatgaatgcccgaacataaaacttccccggaataatgtcatagtttccttcctccaaggcggttaaataccttttttgaatctttgttgccgcttggagatcatccaatgacattgctttttcctctctggcttctttgagccggattcctagttcagtcacaacaaacaccttccaattttaaaaatcaaagcttgaaaacccggattgatcaaacatttggggttcctcggcatgttcatatgtaataacctcatcagggtcatttctcagttcaataatataatcaaagtcatctagtgtatactctgtattttgaacgaatatgtccggatgctccaccacttttgttgcaggcagccgcatgatttctcggaccagctggagatggcgttctgaccctcttcgtgttgacacaattccgtcaacgataaagacattttcagtgctgtattcatcggcaatcagctggcttcttatcgtctgcttcagcaaggttgatgacacaaacagccaccttttgctcgcacacacactagaggctacaatcgattccgttttcccgacacgcggcatacctctgattccgattaatttatggccttcttttttgaacaattcggccataaaatcgactaataagccaagctcgtcccgttcaaagcggaacgttttcttgtcatcggcatcccgttgaatataacggccgtggcgtacggcaagacggtcgcgaagcctcggttctctaagcttcgttactttaattgtttccatcgtttttaagattgattctaatcgtttaatttgatctatatggcggcacctgaggagcattccccttctggaaagatcgacgccgtttatcgttacgatgttgatagaaagcatcccaagaagagatgaaatatccccgagcagtccggggcggttcacttgaatttcatattcaaaataccattcaagctttgccaaatgatatacccccttcattgtggcaaaattttaccttcctttatcataaagcatttttctctaattagaaagaagaatgttgctgtgatgaggaaaacataaaaaagagaggaaaaatcccctctcttcctagtgagtgctgttattttcaacaagcttaaccatcatattggcaatggcgtgctgttcatcttttgatgctacactccaaagatctgccagcactttttcctgctcgttcttagattccacttcattagccaagtagctgccgatttctgtcgcaagatctgtaatcgtatcctggctcatacctttatcttgcgcatagttcagacggtcgccaaggaagtttttccagctatcccagttttctaatactgacatgcttgtttcctccatttcatgtgaagttacaagattattgtgtccttcgcaaaagaaactatacaccgaatattttcggatcagcagtgccagccgccattcaccgacagaatttggccggtgatatatgacgctttttcagacaggagaaaagctgttgcatccgcaatttcttgcggccgggccagccggccgatcggaatctcatcagcgatctcttctttttcagccggggtaaattgattcatcatatttgtatcaactgcacccggcgctacggcgtttactctgattccgcttggcgccagctccttagccaatccttttacaaatgaatgctgagctccttttgccatgctgtacaacacttcacaggatgctccagtctctccccaaatcgagctgacagccacaatcgctcccgatttattccgaatcatgcctggcagaaggtttctcgtcagcatatacggactcgccacatgaagctgaaccatttcctggaccgttgcgttatctacatccgtaatcagcccaaaatggcttcgtccgctgtttaaaacaatcgcatcaatcggctgaacaattgaacttgtcagcttatctgctccatcttgcgcggacaggtcagcttgtaatatctccgcatttacgccaaacatctgacttagtttttcagcaagctccgctgccgcgttttgatttgtattgtaatgcagcagcagattgtatcctctagctgcaagggtttcgctgatgcttttgccaatgccgccgcttgctccggtgattagtgctgttttgttcatcctctttccttctttccgcagaaaaacacccctcacactggagggatgttttgtttatgatttaggaacaaccttgcagacagtcagtctgtctgcagcgatttcctcttgtattacgttctggacatcctcgagggtaatctgctcgagtaccgttacaacatcaaacaggctcatatccaagaacgcataacgggtaaattgattggcgatgtattcaggggaattcagcgcttttaagaatgtgccgatctttttctttctggcaagttcaatcttttcagcagtaatcagttcaccggcgcgcaaaagcatgcttgaaatgtcttcagccaattgatcaggctcaggcgtatctccgccgatcgccgcaaaaccgaacccatattcagcagtaaaatcaaagctgaacgtttcgtcaatatatcctttttcataaagtgattcatactgggcagagcttttgccaaaaagagcttcaagcaataagttcattgaaagttcatgctttaagagctctttgcctaatttaaacggatttttggatttcagcccaacaaggcatttcggtccctgcacgttcattttgatctctttttcttttcggaaaaccgcttcttgctctttcacttcttctcgtttgatctccggctgatcagtatacggctttttcccctggttttctcttacctgagaaataatcgcttcaggatctacagggccgacaatgaaaaggagcatgttactcgggtgataaaacgtttcatagcattcataaagaaggtcttttgtaatatgtgaaatgctttccactgttcccgctatgtcaattctgacaggatgctctttgtacatgttttcaatgaccccgaagtaaagcctccaatcagggttatcgtcgtacatattaatctcctgcccgataatccctttttccttttcaaccgttttttcagtaaaatatgggtcctgtacgaaatcgataagcgtctctaaattgcgttcaacatttgatgtgcttgagaaaaggtaagccgttcttgtaaatgacgtaaacgcattggcagaagccccctgtttgctgaaatcttgaaaaacgtctccgtccgctttctcaaacagcttgtgctcaagaaagtgagcaatcccgtccggcacgtgaaccatctcgtttttacctaaagggacaaaccggttatctatcgagccgtactttgttgtaaagaccgcatatgtcttgttgaagccttttttcggcaaaacgtaaacatcaaggccgttggacattttttcatgatacagcgtctcctgaagctgttcatattcgattggtttgatcaagatgcaccctccgtcccttttaagaaataagtcgtatcaagctgaatcttttcgccggctttaatgatatcctcttttgtgacattctcaatattggcaagaaagtcttcgataggaatctcgacttgagcagcggcctgctgatataaaaactcagataaaccgtatgctgtatcaatcgtttccagcacttgatttcgaataacggcctttgtctgtgctatatcctgctcactgaaatcgccatttttcattgcctggaattgctcagcaataatcgaaaccgcctgttcaaaatttttcacttcaatgcctgacatcaccattaacaagcctttaaaactttctatacgcgaagccgcgtagtaagcaagactggctttttcccgaacattaatgaaaagtttagaatgagagaatccgccgaacaatccgttaaacacttgtaaagcaggataatcctgatctgtataagtgatgctggtgcggtagccgatattcagttttccttgcttgacatcctcttcatcaattacttcttttggctgaactttttcatcagcgtgattgttttcaatcatgccaagagtgcgctcttctgttttgaaatacttatcaattgccgattgtacctggttactgtccacgtcgccaacaacatatagatcaagctggtctttttggatagcgctttggtatgtttcgtataattgctctgccgtaatgtcatcgacatcgtcgatttcaccattgacatgaagcgcgtaaggatcatttttgcacatttcctgtatcagccttaaattcgaataacgcattttatcatcatagacggcttggattctttgcttaagcgtccgtttttcttgagccacatattgtgactgaaaagcgtctccctccaaagcaggtgaaaagacgagttctgcgagaagctggagccctttctcgagaagcggcgtttggtcttttaaatatttttcattcgggatttcaagcctgaacgtaatgacatgccgctctccttttttcgtaagatcagccgatactgacgtgccgtacagctcatccaagtatgaacgcaattctgcggttttcggatggcttttcgttccgcgaagaagcacatgcgggagaagcgctcttttggtgacttgatcctttgtcagcggcgcaagcatcttaaaaataagcgagacggttttgaatttttctgtttttacaatgtgtgcggttaaaccgccgtgctttgatttgagttcattaacatatgacatatggaacctccttcgttcatttcttaattagtatgtattatgaccaattttcagcatccgcagaaacactctttcatgtaattatagcaactgtaggatttataaggaaacaataacctccgcatgctgtataggtacagttgtaaactgtgcaagaaagcgcaaaaaaagacggctggctagaccgtccctaagtttttttcttcttcactttttttagcatctacagtaaagagcactaaaaataaagaaacgatgctgcaaaacgccgagagtatgaaaataatccagtttgcattagacattaatgcagcaaaaacaggtggaccgagagctactcctataaagcgcatgctattgtaaaaggaggaaatggttccgcattgttcactttcaatcccttcggttatcaatgcatctaaagcaggaagagccattccaatcccaatcccgccaaagcttaaaaagacaaataaaaaataaaaactgtggttccaccacaaggcaataaacgaaagggttaacagaatcattcctgtaacaacgcaaaatttcattcggcctttatctttaccgatctttttgccagctataaaagaactggttgacaaaaacaaaagtgggattgccagtaatccgcctttagctactccgtcaatagcatacttgttctccagcgtatctgataaataaaataatacgccaaataacaaaaacataatgacacacccgataatgaagaccgtataaagccagcgaccatcctgtttaaaaattttcttcacactcttaataaactcagaaacagcaggcgcatcttcatcttcttcaggcttggccaccaaaaacaatacgagcaaaaagctgatcaaacagaaaaacggaataaaccaaaacggtacaaaccaataccaagaagccagtaaggctccaagtatgggactcagtaccttccctgacgtgttggcggtttcaatatcgccaagacccgcgctgaccttttcatcgtctcctttaaacaggtcgccgataaacggcatgacaatcggagcggcacctgcagaaccaatgccttgaagaacccgccccgccaagatcatagcataaggatttttcatataggtcgaggcaaaagcagctacggctccccccaatcctgcaatgaggaggcatggaagcaatattttttttctcccgaaacgatccgacaaatatccggcaatcggaatgcaaataattgctactactgaatatacagtaatgattaaagatacttgaaatgaagtcacagacagctttttctccatcatcggaagaacaggaatcagcatggagttcccgagtgtcatcacaagcgggacagaagacaatgcaataatatttttcattccatttttctctctcaacattttcacccattcactttcttgtcatcccttatatattgcgttaaccggaatgaaagtatgtacaaagaaacatgaatcagtgcaaataaaaaaacagacacatacaggcgtccgtttttagaatcgtttacgcaaaacatgaaatctgaatttatccgctctaaaataatttaaagaataaagcaccggtttatcgtgctgatcgtaatgggtttgttttaacagcaaaagagctgtttccggatcgcattcaagcactggagaaatggtatcgtgatagccgatcggttctatatcagttactgcatagctgattacggagcctgaatttttctctagcaggtcaaacatagattcttgctgatgagaaaaagaattcggcaaaatattcatcggaattttgtctatacaatacacaatcggctgtccgtcagctgtcctgactcgttcaaggtaaaaaagttcttgcccttctgccaagtgaaatctcttcgtatcatcttcagacggcataagcacttgtgatgatagaaaaatcgtgccaggggtcatattcgcctgttctatcatcttggttacactgttcagctgttcaatacccgaaagaaataacggcttagaatggacaaaagtgcctacaccatgccttctgataatcacatgctcttcttccagtatccgcaaggcttctcttagcgtcgctctgctgacaccaagctttttggaaagctcaaattcagaaggcagcttttccttctcagtgtagatcccattttttatatcctctttaattcgttcaattactttcaaatacaagtgccgattatcagcttttgtagacatgtttcccctccgtaaaccactttcgataaaaattattgaacaattgggacaactatatcatgttttgtcgaaaaaataaatagaaaggtgatcagtttacataatatcattattgacaactatagaaagcggaactcccttcattaagaagagagctcatcatatttctcttttgataataatacttccctaggtttgctgccttcatacggtccgacaacaccgcgttcctccattgcgtcaatcaggcgcgccgctctcgtatagccaattctgaatcttctttgcagcattgaaacagatgccgtctgcatgccgacgattaattcaacagcttcatcataaagttcatcagtaacctcggaatgagtttccgtcgtctcctcaggaatcatttcttcttgatattgcgctttctgctgtgtaatcacatggtcgacgaccttctccacttcgtcatccgacaaaaatgctccctgcacacggacaggtttgttagcccctacaggtaaaaacagcatatcgccgcggccaagaagcttctcagcgccacccatgtcaagaatggtccttgaatccgtctgtgaagatacgctgaacgcgattcgtgacggaatgttcgctttgatcacccctgtgataacatccaccgatggccgctgtgtcgcaataataagatggatgccggcagcccgcgccatttgggacaatctcgtaatcgaatcttccacatcagatgaagcgaccatcatgagatcggctagctcgtccacaatgacaacaatataaggcagctctggctgtttcgctccttcttcattgttggcgcgttttatataatcattgtatccttcaatatttcttgtacccgtatgagaaaataattcgtaccgccgctccatttcattgacaacctttttcaaagcctgcgacgcttttttcggatcggttacaacaggagcaagcaaatgcggaatcccgttgtagacatttagctctaccattttaggatcgatcatcatcattttcacttcatgcggtttcgcccgcattaaaatacttgtaataatgccgttgacacagacacttttcccgctaccggttgcgcctgcgaccaaaaggtggggcatcttgtttaactcagccaatacagcttcacctgaaatattgcggccgagtccaattaacagcttcgcatccggtctgtcattcaatttagactccagcacttctttcagcgaaaccattgccacttctgcgtttggaacttcaattccgattgctgatttgcctggtataggcgcttcgatcctgatatccttcgcagcaagcgcaagcgctaaatcatcgcttaaattgacaattttgctaaccttcactccgacatcaggatatacttcatattttgttacggccggtccgagatgaacctgtgtgactttcgcctttacgccaaagctttggaatgtgcgttcaagctttctcgcattttcataaatattctttttatcagcctgctggccggtatgcttcggatctgccagcaaatccagtgacggcatctcgtaatccttattttcgagctctgtaaaggtcataggaggagcagaaacagtttcctgatcacctgtctccggttggatgtcctgaagcggcttcgacacaggttcggcgcgcttttctataactggagactcttcctcttcattacgatcagaaaagcttgagataatcggctctgaatgaataagaggcgatactgtttcataatccccctcttcatcaggaggctccggttccatttgctgttttttgcgggccggtttttgttttttgctcggcgctttcgtttttttcgatgactgcatatttgatttgaaggatttcatgtcatcaataaatgctaaccattgttcttttataaaacgtccaatcgggctcatccacttttttagcgtttcttgcagcgagcgtcctgttactaaaatcattccgatcaaaatcatgacaattgccatgatctgagaaccagtcgacgcaaacaaaaagtgtgaagccgcaaacagcagcgcaccgatcatccctccgcctaaatcaggtgaagcagagctgccattcatgtccattaaaaacaattcccacgtattgcgcaccacgcttgcagactcaatagaccctttgtgcgtcaaatttttaaatagctgcacgtgagaaagcagcaatatgcttgcgataatacagtacaacccggcctttcgtctcgttaaaaggcttggggttttttcttccaaaacagtgagactcctaacaccaataaacctaacaagcataaaataaaccactctccagcaaaaaagcggaacaaatagataaacgtttgcccgactacccccagctgcaagattgcgataattgaaatggctatacacagcaatccgttgagctcgtattttatattgagctgtttcgcctgtttttttcttgattttcgttttttctttgccacactcatcaccttactgcgttaaaaaatgtaagttcatacataatgaagaaagcagccgtttacaggctgcgttttttctgtaggattcccctattatagcatattttgcccttaaaaaagggttggattcttatacgtttaatttcagcttttgtcccggtgaaatgtccggatgcagaaaatgcattggattggtgctcatgatttgaatgacttccgcttcattccctttcatttcgactagaagcggtacacctttatattcaatttgctcatgtgcgcttgtctcttggttctgttctgcaaacacaatttcctgaggcatcacggtataaagaatcattgaatcatccgtccttcttctttccttgcttcatcgatgagctcattcagtttattgattgcctgtccgacaccgcctgcgtgatcgatcaatccgtatttaactgcatccttaccgactacatttgttccgatatcgcgtgttaagtttccttttgaaaacattagctctttaaacttctcttcggttatattggaatggcttgtcacaaatttaacaactctttcttgcatcttatccaggtattcaaacgtttgcggcaccccgatgaccagcccggtgagcctaactggatgaatcgtcatcgttgctgtttcggcgatatagctgtaatcacaggatacagcaatcggaacgccgattgaatgccccccgccaagcacgatagaaacggtcggtttcgataaagatgcaagcatttccgctatggcaagaccagcttcaacatctcctccgacagtatttaatatgatcagcaagccttcaattttgggattttgttcaattgccacaatctgcgggatgacatgttcatattttgttgttttgttttgcggaggaagctgaacatggccttcaatttgtccgataatggtcagacaatgaatatttgtatcttggggcagctgcggaagcgtcgtttcaccaagctgctgtattttattcataatgctgtccttcgcatcatttttttcaggacgctcttcttctgtgttttccatacgatgatccatctcgctttcatcctttccgagtttctctttgtattatgaacaaagatacttcattcaatcccggcttgaaggacaaaaaataaagaccggagcagctccggtctttagtcagtcattatacttccataataattgggatgatcatcggtttacgtttcgttttttcataaaggaattggttcaaagcatcccgcattgcctgcttcagcgttgaccattcgacatttgatgtttcagtcgcttctgtcacgatggaccgtacaagctcagtagcctgtacgataagaccttcagactctcttacataaacaaagccgcgagtgataatttctggtcctgatacaagatgtttcttttgtttatcaagtgtaatgacaacgattaaaattccgtcctgtgaaagcaagcggcggtctctcaatacgatattgccgatatcaccgacacctaaaccatcaattaaaatattgccgtaaggaactttatccccaatttttacgttttggccgcggaattcaacgacgtcgcctttttcaattaagaagatgtcactgcgcttcatgccggtttcttcagcgatttttgaatgagctttttgcattctgtattcgccgtttacaggaatcaaatattttggtttaagcaggttgatcatcagctttaactcttcttgtgagccgtggcctgatacatgaacacgcttttgggcaaagatgacttgtgcaccggctctcgcaagaagatctactgttttagagtaaatgagttcctgcccgggaatcggagttgacgcaatgaccaccgtatccccttcttcaatgttcagctgtttgtgagctttgtttgccattcttgtcaaagcagctaatggttcaccttggcttccggctgtaataatggccacttcgcgcttcggatattttttgacatcctgtacagaaataaacaattcatcatctgcttcaatatatcctaactttctcgccagctgcaggacagattgaagattttttccggctacggcaatctttctgccattttgagccgctgcatgaatgacttgctgaatccggttaatattggatgcgaaaacagcaataatcacccggttctgtgaattatacagcgcatccgaaatttctccgctgacagccgcttccgaaggggtgtaacccggccgttccgcatttgcactgtcagaaagcagagcgagcacgccgctattgccgatcttggcgatctcgccaatgtcgcacgtctgattaagtgcaggtgtttggtcaaatttgaagtctcccgtgcatacaatagatccaagtgatgttttaaagctcacacctacagaatcaggaatgctgtgaatcgttctaaagaacgatacctttgttgattcaaatgtaatgacagatttggagtgaatttctcttaaatcagtttttcggttatgtccgtattgttttaatttctctcttaacagtgcaagcgtcagttttgttccgtacactggaacggacagcttgtttaataagtaaaaaacgccgccgatattttcatcgtgcccgtgcgttaaaaagattgccttgacgcggtcagcccgttcaatcaaatatgatatgtcaggaatcactacatcaataccgagcatttcgttttctggatgcataaggccggcatcaacgacaaatatgtctgagtcaatttcaatgacataaaggttcttcccaatctctccgacaccgccaagggcgataattctaacgttttctgtatttttctttttcaaaatctatatcctcctagtctcatacccgtccatcatcacttgttcctattataactgaaagtaaatttagaaaacaagataaagcagaaggtttagggaaaaccaatatgtaaaagaaacggtcaaactcagctgaatgtgagaatgaccgcgtttgtttcactgtatgaaattttcttacagttcgctgatcgtgctgcttaagctcagacgttcatcctcagttaatgggactagaggcagacgcacagaaccgacatcaagacctctcagctgaagcgctgttttgactggagcaggattaggcgctttaaacagttccttcataatcggcagcagtttctgatgaatcagtgccgcattagctgtttgcccattcgtataatttttgatcatttgctgcatatcagtgcctgcaatatggctcgccactgacacaactcctctacctccaactgaaagaattggaagcgttagagcatcatcccctgaatagacatagaagtcttcaggtgtttcagcaataatttttgtaatcgcttcgaggtctccgctcgcttctttaatcgcaaccacattcggaatgtctgccgccaaacggatcgtcgtttcaggagcaagagaagcaaccgtacggccaggaacattatagagcataaccggaagagatgtctctgccgcaattgctttaaaatgctggtacattccttcttgagaaggtttattgtaatacggggtaacaagcataacagcgtccacgcccgcttcctcagctttttttgtcagcttaatggaatctttcgtgttgttgctcccagtaccagcgataacgggcacccgtccgtttacttcttttaccgtatattcaaaaagcgcaattttttcttcagttgaaagggtcggagattctccagttgttcccgctactactaaagaatccgttccgtttttcaacaagtaatcaatcagtgtagacagtttttgaaagtctacgttccctttattgtcaaagggtgtaatcatcgctgtagacacatttccgaaattcattttattcacctcatcatgattcaatcacatttacttcgaaagttcaaacacttcatgcaaagcgtttacagcaggaaccatatccgcttcatggacgagcacccatatcgtcgtatggctgtcagccgactgaaggatcggaatttctttttctgaaagagccgatacaattttggacgtaacaccgggaacacccataatgcccgcgccgaccgccgataccttcgcgcagtttctcgtcaccattggatcatagcccatatccattaaaatacgctgagctgtttctgttttatttccggctaccgtatagacgatttcactaggtgtaatgttaaagaaatcgacactgattccagcgtttgccatagccttgaacacttcagtctgaacgttatactggccgattttcgcaggcactttgaactgcgtgacatctttgacatgggcgattcccgtaatcagcctttcaaaaacatcactgccgaccttggaagagtgatgtgatgtcaccaatgtgcctttatcattcgaataagtcgaacggacgcggatcggaaccttggcctgcattgcgatttccacagcacgcggagaaatgaccttggccccctgatacgccaggttgcagatttccgtatacgtcacaacaggaagcggttttgcattttctaccactcttgggtcagcagtcatcacgccttctacatcggtgaaaatatcgatgtattccgcatcaacagctgctccgagtgcggctgcagacgtatcgctgccccctctgccgattgttgttgtatcacccttttcagttgcgccctggaagcctgcgacgactaccgcatcatgattggcgagcacactgaataaacgctccggtttcatttcaatgattttcgcattagtatgctgatcattcgttaaaaagccagcctgagcccctgtcagcgcagctgctttcacaccgttatcaagcagcatgcttgtaaagacgacagaggaaatagtctctccgcaagataaaagcaaatcctgctccctaggagaaatcgctgactgatcgccgtaaagcagcccgagcaaagaatctgttgcatacgggtccccttttcggcccatcgctgaaacgacaacgacaaccttatatccttcactgattgcttctttaatatgccctaaagccagtttgcggcctttatcatcttttactgatgttccgccgaacttttgaacaattatcttcactgttttcactccaaattattcggacgtaacagaagagagcaggctgatagcgccttactctcttctattcgtctttagaaaattctctcttttatacgaggtttagttttttcaggctttctgcaatttgaacagagttccatgccgcgccttttaataggttatcagaaacaacccataaatgaaaaccgtttgctctgtccaagtctttgcggatgcggcctacaaacacatcgtttttgccgacagcatcagcaggcatcggataaagctgctggcttggatcatcctgaagtgtcacgcccggagcttctttcaatagatttttaatatcttcaactgtagcgtcatcacggtctatttcgatgtagacggactctgagtgcccagtttggattggcagtctcacacatgtagccgctacttgaaggtcaggcatgtgcatgatttttttcgtttcatttatcattttcatttcctcaaacgtatagccgttatcttggaatttatcgatttgcggaatcgcgttgaaggcgatttgatagtgttttttgtcaccttttacaggcatgatctcaggctctatttcttctttatttaaaatcgcctgtgtttggctgtaaagctcttttacagcttcattacccgctcctgatactgcctggtaagttgatacgatgaccttgtttaagccatatgctttgcggatcggttcaagtgccgcaaccatttggattgtagagcagtttggattggcaataatgccgttgtgttcatgcaagtctgcctcattcacttctggcacaacaagcggtgtattttcatccatgcggaacgcactcgtattatctataacaatagcgccgcgttttacagcttctggtgccaatgcttgtgatacgcttccgccggcgctgaacaaagcaatatttaccccttcaaagctctcaggagaagcttcctgaacagtcagctcttggcctttaaacgtgacttttgtccccgcagagcgttttgaagatagcaatgtaagtgtgtccatttcaaagtttctgtcttcaagtgttttaagcatttgttgtcccacagcccctgtcgctccgacaacagctacgtgtaaacctcttcccatctgtaaaactccttccgccaatcagcttcattgaattgatttgactatgattttacgttttattttaccatagaatatgcgggtgatgaccgaattttttagtttgggaaagattttctgtaaatttagtcatttccctgataattctcaactagaatcggctgaagctgctggtgcatgagtgccttttcaatcgtttgcggaagcagatccattttggctaccattgaattcggttttttaaatggatcatcttgcccgaatggaataaaaaagatattttttgttgacatgagcctcattaaatttgttccgtttaaaccaagagcatcatttgtcgagatacccagaacgacaggccgattgttccggattgtcgcttttgccgccatcagcaccgggctgtccgtcatggcatttgccagcttgctcattgaattgcctgttaaaggcgcaatgaccatgcagtcaaggggcagcttcggcccaagaggttctgcctttacaatcgaatcaatggcctcatatccagtcaggtcttcaatttttttaacccattctgcgccctctccaaatcgggtatttgtagattttacattaaatgtgacaaccggacggacttcagctccttcgttgaccaactcctcaatttgcgggaaaaccgcttcatatgtgcaatgcgacccggtcagcccaaacccgattctttttccttttaatgacgacatccttatttcccctcctcagcttgtatttcagccaaaagcttgctcaagacgtttgcaaggatttgcccagctgttttaggagcgacaatccctggaagcccgggagcaagaagtgctttaatcccttgtttctcggcatatttaaaatccgttcccccgggacgtgaggccagatccaatattaaggtttttggtgtcatgctagaaagtaccgtttgatttaaaatcatactcggtatggtattaatgcaaatatctatatcttttacatgctctttcagctcatcggtatgaaaaggaacgagccccatttcagtgatacgtgccagatgcgctgaacttcttgcccccacttttacattcgccccgagcgcggcaaatgtacgggcaatcgtcatcccggtgcgccccagaccgagaacggccacctgtgatccgtgtatcgtataatccgtgtgctgaatagccagcatgatcgttccttctactgtcggaatagagttgtatatcgcaatgtcatcccgctcaaacagcttaacaagttttctttttgcctgagctgcaatgttttctaaataggcgttagaaattcctgagaaaatgacacaatgtgcaggcgttctgtcaagatggtcctgttttaacacaacttcttcattcgaaaatacagtcgatacgacaccttctcctgttgtcgcggatactggaagaatgatgctgtctatttgctgaaaaggaatttcatcaatattgcattttactgccccggtaaaaccgtgatccaattggtcaaaaccgacaagatagatgtcagcctgctgttcagtgagctttcttataatttcgagctgtcttgcgtcaccgccgataactgcaattttcaatccggttaacattctaaacgttcaccttctttgtatatactggatctctagttgttaagctccccttcatcttatgatcaaaaggaaataccggtgaatataaaagatgcgctttttccatataaaaaaacatcggctccggcagccgatgtttcagatgttttctttagagcccgcttcacagtcaattgggctatttactcttgtcgaggaggcatttcctcaggtacatctaatataatcatatctgaaccgatcttttgaatatggtgccatgggacacgaatgtcatgaccttgctttctcaaaccaaaccacttaactgtgggaatgaggagtgctgtaatctgtccatcctgttcattgatttccaaatcggtctggccgagcactccgagccgttcagctcttttgatgtctacaatttcctttcccgataattcactgagccgcatgtctgtcacccccttgtactatgtatgatgaaagggattaaaaaatgcctgctccattatggggcaggctttcctttttaagacggcatattgccggaagggctgataagtgctaatgcatagtcttcggtaaacaattgtctggcaaggccattaacacgctctaagttcacggcgtttaattcattgataatttcatctaatgttttatgtttgccgagcagcagttcattttttccgtttcggctcattttgctgtttgtgctttctaagctcagcattaagcttcccttcatttgctctttgctgttttccagttctttcgaggtaatgccgtcacgttttaatgtggccagggtttcttgaattgtttccgacagctgctgaagctgatttgcacccgttccgccgtaaatcgttagcattccgctgtcctcatatgagctgtgatagctgtaaacagaataagcaagtcctttatcttcacgcacatcttggaacagccggctgctcatgctgcctccgagcacattgttgaggacgattaaatcataaatacgttcatggccaacctctaagcctttaaatccaaggcacaaatgagcctgctctgtttctttttttctcgtcagtttttccgtgtggaactcaggcttctcaaggcctgtcgctttgcctttcgcctcgtatgacccgaaccatttttctacatctttgataaaactgtcagatatattgcccgctaccgaaatcaccactcggtccggcgtataataatcatgcatgtattgtctgagagagtcaccgttaaaggaagcaagcgtttcttccgttcctaaaattgggtagcctaaagaatgattgccgtaagtggctttgctcaataaatcatgtacaatgtcgtccggcgcatcttcatacattttaatttcttcatatactacatttttctcttttttcagctcgttttcatcaaacgttgaatgaaagaacatatctgctaatacgtccagcgcgtaattcgcatgctcgtcaagcacctttgcatagtagcaggtatattcctttgaagtaaacgcattgacctggccgccaatacgatcaaaagattctgctatctcgcgtgcagattttgtgctcgtccctttaaagaacatgtgctctaaaaagtgagaaattccgtttatctccggcgtttcatgtctcgaacctgtgccgatccatacgccgatcgcaacagaacggactgtcgggttattttccagcacaattcttacaccattttgacacgtatatcgtttaatcaaatttgttcctcctattcaaagacaagctgccttcatctgttacttcaatagtcttgtttcatccattagttcagtgactgttccaagcgcatatcctttgtcttttatctgtgtaatcagcgcttcaagactttccgccgtagggtcagtcggatgcattaaaatcatggcaccattatgtatcttgcttaacactctcgtctgaagtacagacggagccggcttttgccaatcgattgtatcaactgtccacatgactgttcccatctgtttctctgctgcaatgtcgataaccgcttttctgaaacttccgcttggcggagcgaaccactttggcttaacgccgatcgtttgttctatttgttcattagtcttgtcgagctgctcggaaattcttcctgtagtcagtttgctcatatccggatgattgtatgaatgatttccgatttcatgtccgtcttttgcaatcttcttagcgagctgtacattgtttctcacccaattgccttctaaaaagaacgtagctttaacctggtgcttttgcagaataggaagcattttttccaaatactcatttccccatgccacattgattaaaaaagccaccatcggtttgtcaggatttcctttataaataggctcaggctgaagtgactcaagatgaacacttggttttacttgactgtacaccaaatctttttcccgaaacttaccatgctgtttcatttttttatatgattgttcaatattgacctttaatccattgtagcctggaatgcttttccacactttatcaattcttgcattctggggcttaacttcgtactccggcgctttttgaagcaattcttcatataacgggtcttttgacgccgtgacagtcaccgtatcttttttcattgcccctatataatcaagtgcatgcggattttccatcatctcaaatgagacaaaaaaagaaataaaaaaacggcaaacggtacaaattttttgtacatgttctgtcccccctcacctcacattatgaaggagaaggacaaggtagaacccgcctgcttttgaaaagcttcaaaataaagaagccgggtctcccaggctccttttatgttttcatttaagattgttgttcttctttttctttctcttcacggagcaccgctttgcgggataaattcactcgtccttgtttatcaatttcagtgactttgacaagaatctcgtctccgattttcacaacatcttcaactttccctacgcgttcaagcgcaagctctgaaatgtgcaccaaaccgtcttttccgctgaaaatttcaacgaaagccccgaatttttcaatccgtttcactttacctaggtaaagttggccgacttcaacctctctcacaaggtcttcgatgatttttttcgctttttggttgccgctttcatctgtagaggaaataaagattgtgccgtcctgctcaatatcaattttaacaccggtttcttcgatgatcttattgatttgtttcccgcttggtccgatgacatcgcggattttatcaggattaatggtcattgttaagatcttaggcgcatatcgagaaagctcttttcttgattcgcttaatgttgcaagcatgctgttgaggatttccattctgccctttttcgcctgctgaagcgcttcttcaagaatctctctggaaaggccttcaattttaatgtccatttgcagggccgttacgcctttttcagttcccgctactttaaagtccatatctccgagcgcgtcttccatgccttggatgtcagtcaagacagtgtaatgttcgcctgatttgacaagacccatcgcaataccagcaactggcgctttaatcggtacaccggcatccatcattgcaagtgtgcttgcgcaaatgcttgcttgagatgtagaaccgtttgattcaagcacttctgaaacaagacggacagtataagggaagtctttttcagacggaataactggctcaagcgcacgctcacccagtgctccgtgtccgatttcacgacgtcccggtccgcgcatcggtcctgtttccccaacgctgaattgcgggaagttgtaatgatgcataaaccgtttcgactcttcgacacctaagccgtcaaggatttgcacatctcccagagcacctagcgtacatacgctgagggcctgagtttgtccccttgtaaatagacctgaaccgtgcgttcttggcaagaggccaacctctgaagagagcggacggatttgatcgacaccgcggccgtccggtcttactttctcttcagtaatcaggcggcgaacttcatttttcacaagcttggataaaatctgcttcacttgcttgattgtgtcttcatcatgttcttcatcctcgaattttgccacaactgcgttcttcacttcgttaatggcatcttcacgggcatgcttttcatgaacttggatggctttcagcagatcctcttctgccaaagcttttactttttcattaagctcttcatcaatttcaaagagcttaatttcagatttctctttgccgactgctgcaacaatttcttcttggaatgcaatcaggcgtttaatctcttcatggccgaacataatggcctcaagcatgatttcctcaggaacttcgtccgctcccgcttctaccatgttaatcgcatctttcgtgccggcaacgacaagattgatatcgcttttttcaagctgatcgactgtcgggttaatgataaattgatcatcaatgcgtccgacagtaacccctgcaatcggtccttcaaacggaatatccgatacagaaagtgcaagagatgaaccgaacatggcagccatttctgaagagcagttttggtcaacactcatgacaatgctgatgacttgaacttcattacggaatccatcggcaaacaaaggacggatcggacggtcaattaaacggctggcaagaaccgctttttcacttggacgtccttctcttttaataaatccgcccggaattttccctaccgcatataatctttcttcatagtttacagtaagagggaagaaatcaagcggtttaggttcttttgaagcggttgctgtactaagtactgctgtatcaccgtagcggatcatcacagcaccatttgcctgtttggcaagctggccggtttcaacggtaagcgttcttccggcccaatctatggtaaagacatgtttttcttgtcccatacaattacgaactcctctcttcgttgtgtgaaataatcaattactcctattatgaacgaaatgaattgaacatatcaatgtcaaagtagtatgtaaaaggatttcaatgatttgttataagaaatttcgctttaatacgataaaaaagcgggaatcctcccgctttttacgattatcgacgtaagcctagtttgttaattaactcacggtaacgagttacgtctttattacgcagatacgtaagaagattacgacgcttacctaccattttaagaagaccgcgacgtgagtggtggtctttcttgtgagtacgtaaatgctcgttcaagttgttaattgagtcagttaggatagcgatctgaacttctggagatccagtatcagattcgtgtgttttgaactcattgatgagttggtttttacgctcttgagtaattgccatcctgtttcacctccaaatcatatttagccccagttacctagcaaccgtcggtgacttcggattgccaagcaatggttttaagactacgaaaactatcatactaaaaatcgtgcctatatgcaaatattttagaataaaatttgcgtgcgttgcaagttatttccgcaaattgctgaaataacggatggcttcctgcttatctttctcaatttgctcagttaattctttgatgccattgaatttccgctcgctccgaatccgtttgtaccattcgatttttatagcggctccatatacctcttgattgaaatcaaacagattgacctcgatggaaggctgttcagggcgcttttcataaaacgttggcttatagccaatattgcaaacgccattgtaaacttcgccgttcacttccgcttttacggcatatacacctgtgggcggaacgatatagctgttatttaaaccgacattcgctgtcggaaacccgatggtccgccctcttttatcaccatgaatgacaattcctttaataaaataaggttgtccaagcaagacattcgccaattcaacatctccgttttgaagcgcggtacggatatacgaagaactgatttttttatcctgctccgttaatttttctaccattgtgcacccagcttttccgtctaaatcatccggcatggtcttcattgttcccttgccgtatttgccgtacgtaaagtcaaagcctgccactgcgtgctgcacattaaggccgataatatactggtctataaactgcttaggagaaagagaagcaaacacttcattaaatttaacgacatacagaacttctgtgcctaattgttcaatttggtttattttgtcttcaagaggcgtaatcagatcctttggttccttatctctgcccaacacgtgagaaggatggggatgaaaggtcatcacagctaatgtcagacctttttcttcggctatttgcttcgctgtgccgattaccttttgatgcccgagatgaacgccgtcaaaataacctaacgccatcactgattttgcctgctcctcttttattaaatgatgaggatgtgtaatatgtatcgtcttcacagaacggtcaccttttttctattgttcgcttttttgcatcaatacttttgccggctttaacagccctttttttgcaggatgagggaaatagatcgccaagcaggttccggattcagtaaagacggcaatacggtctccacttgtcatttcagaaaactgctcgggcgtctcaagcaaagccccattttctactttcttagctaatgtatcacttatgatccatttcggcaaatgattgagcgcacgttcaataggaactgtatgctcttccacggttccggattgggcctgtgcttcgagttcatcaaaagtaaagcattcgtcgagagaaaaatctccggatgccgtacggattaaatgagacatatgggccggatatccgagcttttctccgatcatgaccgccagcgtccttacataggtccctttggagcaagtcactgtaaaccggaagcttgcggtttctccatgatgtttaatctctgttgtcagggcaatgtcttcaatggttatcatacgtttcggacgttctacttcaatccctgctcttgcgtattcgtataattttttgccgtttacttttacagcggaatacatgggcggaatttgttcttgtttcccctttaaactgtttaaaaccttttctacatccgctttatcaatgtcgtgattgacaggctttgtttccaccgtttctccggtttgatcctctgttgtggttgaaaagcccaatgttatttctgcatcatacgttttagatttttcagttaagtattcgactatttttgtcgctcttcctacacaaatcggaagcacgcctgatacttccggatcgagcgttcctgtatgtcctacttttttgtttttaacagctttcggatcttcatgacacagtcgtgcgatgtcatgccaacaggtttatgtaaaaggagaactccgttaaccatttgcctttcactccttcttttgagtttttttcttataaacgaagaaagaggacagacgatatacgcctatcctctcttttttattcagatggtttctctgaatgtaattcgtgaatcagtgtttcgatccgattcccgtaatcgattgattcatcgaactcaaattcaatttcaggcgtttttcgaagtctgatgcggctgccgatttcggatcggataaatcctttcgcttttgccagccctttcagcgcttcttcccgttttttctcgtcaccgagaaccgagatatacacctttgcaatttgcaaatcacctgatacacgtacatccgttactgtcagaaaaccaattctcgggtctttcagcttgcggctgataatatcaccgagttcttttttcatttgctcgccgacacggtttgctctcatactcaattcaatcacctctaagttaaaaccactctgtcctagtgatcgtccgttcaatttcaggaaaagaatcgataaacgctaggacgcgctgcagttctttttctgtttgaacgcgagaggaagaaacagcggcgattccgaagctggttctttgccaggtgtcctgatagccaatctccgaaatcgaaacattgaacttgttttgaaccctggttaaaatccgcttcagaacggcacgcttttcttttagcgatcctgcatcataaatgatgcattcacactccgcaaatccgatcacgttctttcaatttcttgcatgacaaacgcttcaaggatgtcaccttcacgaatgtcattgtatttcttaattgtaataccacattcatagccttgtgaaacttctttcacatcgtctttaaagcgtttcagaacatctacttcgccttcaaagatgacgacgccgtcacgaattaaacggaggccgctgtcgcgcgtaatggttccttcagtaacatatccgccggcaattgtaccgattttagatactttgaatgtttggcgtacttctacttgaccaattactttttcttcatattcaggatcaagcatacctttcatggcagcttcaatctcgtcgattactttgtaaatgatacggtgaagtcgaatatctacattttcagcttcagccgtactcttagcatttccgtccggtctcacattaaacccgataacaattgcattggaagcagatgccaagataatgtctgattcagtaatcgcaccaacgcctgtatggatgattttcactttaacgccttctacttcaattttttgaagtgcagccgttaaagcttcagcagatccttgaacgtcagcttttacgatgaggttgatgtcttttacatcaccttgcttaatttgctcaaataaatcatcaagactgagcttcgctttatcgctgcgctgctcttcaagctgtttcgaagcacgggcttcaccgacagaacgagctgttttttcatccttaaagacaaggaattggtctcccgcttgagggacatcattcaaaccggtaatttcaaccggagttgacgggccggcagttttcacacggcggccaatgtcgttgaccattgcacggacacggccaaatgtattgccgactacgatcggatcaccgacatgcagtgttccagtctgtacgagcaacgtcgcgactgaccctctgcctttatcgagttcagcttcaataaccgttccttttgcctgacgattcggattcgctttcagttcctctacctcactgacaagcaaaatcatttcaacgagctcatcaatgccttttccagttaaagcggaaagcggcacaaaaatggtttctccgccccaagcttcagggacaagtccgtattccgtcagttcttgcattacacggtcagggtttgcggattctttatctattttattcacagcaacgatgattggaacctctgctgcttttgcatggttaatcgcttcaactgtttgcggcatgacaccgtcatcggcagctacgacaagaatcgtaatatcagttacttctgcaccgcgtgcgcgcattgttgtaaatgcggcgtggcccggtgtatccaagaacgtgattttcttgccgttctcttcaatttgataagcgccgatatgctgagtgattccgcctgcttccccttcaacaacctttgttttacggatgctgtcaagaagcgttgttttcccatggtcaacgtggcccatgattgtcacgacaggaggacgaatttcaagatcctcttcattatcaggctcttcgtatttttccagctctgtttcttcaagcacaatgacctcttctgtttcaacaccatattctgatgcaatgagttcgattgtgtctttatcaagctcttggttaatggttgccattacgccaagaagcatcagctttttaatgagttctgaaggctctttgccaagctcttcagcaagtgcgccaactgttaaagtgccagagaatgtaattttctcaggaagctcttttttcggctttacaggcttttgctgatgttggtttttattattgttgttgttgcgtttatttttttgttgttgttattcttcttgtttttgttaaattgattattctgcacgtcattcttctttccgtctcgaattttatttggttgatttccagctgattgctgattaaccccttgtggctgtttgtttttgttcgtttctgctggcttttgagatttagcagctgcgccgccttttttatatttggcatctagctttttaatggccttttcttcaagcatggccatgtgattattcacttctaaatccatgttcttcagtgcggtcaaaatttccttacttgaaacatttaacgcttttgcatattcgtatactctcattttagccattcgttcacccccaaaaatattaatcgagcaagctgatcagcttattcgcaaaaccttggtcagtgacggcgacaacgacacgggcttctttaccgatagagcgtccaagaaccgcgcgactctcgacttttttataagggactttataataattgcacttgtcagttactttttttgctgtgttagatgatgcatcctctgtaagcaggacaagctttgcacgcgcattcctgatttcttttattaccaagtcttcgcctgacacgaccttacgagctcgattggccagacccagcaagggaaaccattccattccagacattttattttttcaccttttccgccagttccagcaattcatcgaaaatctggtcatcgatttgtgattgaaattgattttgcaaagtgtttttcttttttgctgctaagatgcactctttatccagcgttaaataagcaccccgcccattcttttttccggtcgggtctactgagatttcgccttctttcgaccgtacaactcggatcagttcctttttaggcttcatttcaccagtcactacacatttgcgtaatgggatctttttgtgtttattcacctaaagtcacctcttattcatccgattcagcagtttcaggctccgtaaagagcggctcatcatcttcttcaagttctctcggatagattccaagttctcttgcgtccgtttcgctcttaatatcaatcttccagcctgtcagtttagcagctaagcgtgcgttttgtcctctttttccaattgccagagacagctggtaatcaggaacaataacagttgtcgctttttcttcttcattaacaatgacatcaagcactttggaagggctgagcgcattcgcgacaaattctacaggatcactggaccagttgacaatgtcaattttttcaccttttaattcattgacgattgcttgcacacgctggcctttaggccctacgcatgaaccgacaggatcaacgtcaggatcatctgtgcgaacagaaattttcgaacggtcgccggcttctctggcaacagattttagctcgacagttccatcataaatttcaggcacttcaatttcaaacaaacgctttaacaggcctggatgtgttcttgacacataaatctgcggacccttcgttgttttttctacttttgtgatatataccttaatgcggtcatggggcttgtagctttcattcggcatttgctcattaaccggcagcaaggcttctattttgcctaaagacacgtagataaatttattgtccagacgctggacgatccctgtcatgatgtcttcttcacggtcgataaattcagaataaatcacaccgcgctcagcttcgcgcacacgctgtgtgacgacctgcttcgctgtttgagcagctatgcgcccgaaatccttaggtgtaacttcgatttcgacgacatcgccgaccatatattccggatggatgccctgtgcctcttcaattgagatttctaatctctggtcgtatacttcgtcaacgacatcttttcttgcaaatacacggatggagccagtttcacggtttagatccacccgtacattttgcgcttgattaaaattccgcttataagcagaaattaacgcagcttcgattgcttcgatgataatttctttactgatgcctttttctttttcaagaatcgtgagagcatctaataattcactgctcatttaacggtctccccccttaaaacatttgtattcattagaatgtaacagctaatcttgcattagctatcttttcatacggaatattgatccgtttctttcttgttttgatcgtgatctcaactgtcactgtttgtccatcaaattcagccagttcaccttcaaacacttttacgccgtcaataggctcatacgtcttaatgtatacgttttttcctagtgatttttcgaaatcggcttttttctttagcggacgctcagctcctggagatgagacttcaagaaagtaattttggctgattgggtctgcctcatcaagcttttcgcttaaagcttcgcttactttggcacattcctcaatatccacaccgtcatcggaatcaataaacacgcgaaggaaccagctttggccctctttgacaaattcaatgtcaacgagttccagctgaaggctgtctacgattggctgagccatttcttgaacggtgtcagtcacttttttgctcatgttcttcctccttgtgctgtcgatctcatattcgtctcgtcactctgcataaaaaccctgcttcaaaagagcaggggctaaaaagtaaacgatgaacatgtcgagacaaaattctcctgttcaatacaaaagagcgggtttccccactctttgcctcggtaatcgttagcatttccaataaaactataccataaccatatttttattgcaaatggatatacgcttaccttcatacctaagcaagtgacagaaactctaatattacgatggcactttttgcgcttatgtatgcatagaagcagaatttctgagaaattctgctttccatattagaacagtgacaattggttttgatcaggcagtgactccagacagccatggcgatctaagtactctaaaatcgtttttgatactttccctctcttttgcaaatcttcttttgagaggaattcgccttcttcgcgagcttttacaatgttcaaagcagcgttcgtccctaaccctggaatagagttaaacggcggaataagactgttgccgtcaataataaactctgtggcgctggagcgatataaatcgactttttggaatgaatagcctctctcacacatctcaagcgctaattctaaaacagtcagaaggttcttttccttcggtgaagcatcaagtcctttagcgtttatatcctccattaccgctctgattgctgtagagcccttgatcattgtatcaatatcaaagtcatctgcacgaacggtaaaataagccgcataatacaaaagagcatgatgcactttaaagtaagcaatgcggactgccattaagacatatgccgcggcgtgggctttcgggaacatgtatttaatctttttacaggaatcaatataccagtctgggacattgttatttttcatttcttcttcccattcaggcgttaatccttttcctttacgcacgaattccatgattttaaaggcaagggacggctcaaggccttgatagattaaataaaccataatgtcatcacggcagccgataacctcactcagctcacaaatattattgtggatgagctcctgtgcattgccaagccatacatcagttccgtgagacaagcctgaaatctgaacgagctcagaaaaagtggtcggctttgtatcttcaagcatctgccggacaaatcgggttccgaattcaggaattccaagagtgcccgttttacagccaatctgttcttcagtcacaccgagtgattcggttccctggaagatcttcatcacttcaggatcatccgtcggaattgttttcggatctattccgcttaagtcttgaagcatccgaataacagtcgggtcatcgtgtccgagaatatcaagttttaacaggttgtcatggatggagtggaaatcaaaatgagtcgttttccactctgaacctgtggcatctgccgggaactggatcggtgaaaaatcataaatatccatataatccggaactacgataataccgccagggtgctgtccagttgtacgttttacacctgtgcatccctgtacgagccgatctatttcggcaccgcgcatatgaagattgttgtctccggcatagccttttacataaccgtaggctgttttttctgccaccgtgcctattgttcccgcacgatatacattgtcttctccgaacaatacttttgtgtaattgtgtgcttgcggctgatattcccctgagaagttcaaatcgatatcaggtactttgtcccctttaaatcctaagaacgtttcaaatggaatatcatggccgtcttttttcaaaggcgttccgcaatgagggcatgtcttgtcaggcaggtcaaaaccagaaccgacagaaccgtcattaaagaactcagaatgctggcactcaggacaaacatagtgcggcggcagcgggtttacctcagtaatctcagtaagtgtcgcaactaatgaagatcctacggaaccacgggaaccaacgagatacccgtcatctagtgaacgttttacaagtttgtgagagatcaagtaaataacagcaaatccgtggccaataatactctttaactctttttcaatccgcgcttcgacaatttcaggcagctcttccccgtaaatgcttcttgcacgctgatagctcatttctctgatctcttcatcagcgccttcgattttcggcgtatataaatcatctttaatcggcttgatgtcatcaactaaagaagcaaccttttgggtattggtgactacgatctccttcgctttttcttcacctaagaaagaaaaagcttcaagcatttcgtctgtcgttctgaaatgcactttcggcagttcatgcctattcagcggatttgccccgccttgtgaggatattaaaatctttctgtagattttatcctcatcattcaagtaatgaacatttcccgtagcaacaaccggtttattaagcttttcccccagcttcgtgatattcgcaataatttctttcagcgctttttcatcacggaccagttcaagctccagcaagtgacgatacacttcaggcggctgaacctcaaggtaatcatagaatgacgcgatatcttccacctcttcaggcgatttttgcatcattccctcaaaaacctctcccctgtcacaagcagaaccgatcagaagcccttccctgtatttctcaagctgagatctcggaatacgcggcactctgtaaaaataatgaatatgagaaagtgacacaagcttaaataaatttttaagtcccgtgctgttcacggcaagtaatgttgcatgatacggtcttgatctttgataagcattggactgacccatattttcattcaactcatcatggtactgaatacctttttcagctgcgtctttcagcattttcagaagcaaataagcggttgcctcagtatcatagatcgcacggtgatgctgtgtgagctcgatatcaaactttttacaaagtgtgttcaaccggtggttcttaaattccggatagagaaaacgtccaagttcaagcgtatcaatgactgggtttttagctttttcgacttcaagaagttttttataggctacatttaagaatcccatatcaaagcttgcattatgagcgacaagaatatcatcgccaatccattctctgaaatctcttattacatctacgacatccggagcgtcttgtagcatatcatctgtgatccctgtcagctctatgattgtggcggaaagcggacgatgcgggttcgcaaacgcctcaaatttatcaataatttctccgccttttacttttactgcagccagctcaataatggtatcgtatacagcagacaatcctgtcgtctcaacgtcaaaaacaacatatgtttcttcttcgagcagacgatgtgcggcattataagcaattggcacgccatcatccacgagattcgcttccatcccgtaaatcattttaattccatgctttttggccgcagaatacgcatcagggaaggattgaacgacagcatggtcggtcaaagcgatggcctcatgcccccattttttcgcctgttcgacaagctttccgatacccgtaacagcatccatttggctcattggggaatgaagatgcaattccactcttttttctccttcaggtgctgaatcttcacgggtttttgcttttatttcgtttacgtcatttgcgatcatgacaaggtctctgacaaatgtatcattttgaatgcttccgcgtgcttttacccacattccttttttcagagacttcatcagcgccgcatcttctttttcacgtgcaaacattttgatcaaaatactatttgtatagtctgtaattttgaagatacacagcgtgcgcccgctcttcagctcgcgcgtctccacatcaaacacataaccttggaccgtaattctccgttcttcgtccatgatgctgtcaagtgttcggatttcctcgttatctttaatttgataaccgataacaagaggaccagatggtgcttggtcttcatcactttctttatctttcttctccatttcaatcaaggcctgcatagcccgctcttggtcttccgcaagcttttgctcccgaaacttttgaacttcttgctcggatacaaatatttcagcatcaagctgaagatccggaaagccaaattgacggtattctgcttgaatcatggaactgtatttgttctttagcgcagccgcttctgtatctgttttggttttgacaatcagtttattgcccttcagcttcggtttttgctggtttaaaagactgataatcggcggcgaaatgccctgcagttcttcaatgcagcgtgaccagtagtcttgaacgatactttcactgacctcggcatcctgaacttcaattgaagatgtcacttttgctatgtgggcaaacgattgcgtcagcctcgttgttaatgtgtcatatatttgaaaaggcagcaaagatttaaattgaaaatgaaaatgccaagacttagaagctttgtgaattgtcagctttttaatctcgccatgttcaaagtatgtcatgaaggtatcatctgtcatattaatctgctgcagaagaatttgaaactgccttctgtttactgataactgttccattaagacagtatccctccctaaaaacatcataagtgaaggtacctcaggcaatgaggtaccttctattatttctattttaacatgttttttgataaatcgttatggtgattactgcttgctgataaacgcagataattcgtctactgaaatctcagttgactcaccagtttgacgaattttcacttcgacgattccttcgtcagctcgttttccgacagtgatgcggattggaaggccgattaaatctgaatcagcgaattttacgccggcacgctcagcacggtcatcatagagcacttcatagccttccgcttttaaatcggcatacagcttttcagcaagctctctttgcccatcgtttttcatgttcaaagcaagaatatgaagatcgtacggcgcaacgctttttggccatattaagcctttttcgtcgtgatgctgttcagcaatagcagaaagcgttcttgacacaccgattccgtaacagcccatcagcattggctgcgcgcgtccgttttcatctaaatatgtcgcattcatcgcttctgaatagcgtgttccgagcttaaagacttgtccgacttcgattccctcagcaaaacggatcgttcccttgccgtctggtgaaggatcaccttctttaataaaacgaagatcagcaaattctttaatttgcgcgtcacgattcacattgacatttttataatgatgatctccttcatttgccccggcaacagcattaaccattgctttcacagcttgatcggcatatacttccacatcctgatgaataccgacagggcctacaaagcctggctctgttccgagctgctgaatgacctcttcatgtgtagcaagctctacaacttctgcatgaagcaagtttttcactttaatatcgttaacttcatgatcccctcttacaagcactaagacaaaacggtcatcagctttaaacaatactgacttaatgcacgcttcagccgaaacctgtaagaacgcagtcagttcttcgattgttttcacgttaggcgtatgaaccttctctagagctttaggctcttcatctgaaggaacttcctggtgaagaacttcagccatctcgatattagccgcgtactgtgattcatcagaatacgcaatcgtatcctctccgatcgcagaaagtgccataaattcgtgcgtatcctttcctcccattgcgcctgaatcagcgataacaggtcttacattaatgccgcagcgggcaaaaatattagaataggcctcgtacattttttgatacgtttcatccaggctctctgcagatgcatggaaagagtacgcatccttcataataaattcgcggcctcttaacaaaccgaagcgaggacgtttttcatctctgaacttagactgaatttgataaagagtcagagggagacgcttataagatttaacctcatcgcgaacaagcgaagtgataacctcttcatgcgttgcccctaaagcaaattcacggccatgacggtcttttagtctcatcagttcgggaccatacgtataccatctgcctgattcctgccatgtctctgcctgctgcaatgcgggcatgagcatttctacggcatcaattttctccatttcctctcgaacaatctgctgaatgttttgaatcaccttatacgcaagaggcatatagctgtataccccgctcgtattctgtctgataaatcctgctctcagaagaagctgatgactttttgcttcggcatcagctggaacttcacggagcgtaggaataagcgtcaagctttgtctcatttcttcgcacctctgattgatttacttttcgtttacaaaaacagccgctggatatcgttccatgtgacaaccagcataagaagcattaagaaagctactccgataaacacaacaaatgcttctttttccctgttaatcggtttgccccgaatcgcttcaataaatagaaacaacagtcttcctccgtcaagtgccggaatcggaagcaggttgacaatcccaaggttaatgcttaaaaacgccgcaaactgaaataagttcacgatccctgttttcgccacttggtctgtcatgtcatatatgccgacaggacctgacagcatatcgagtttaaattggcctgttactaatttgctcagattggttaaaatggctttggtgacatcaactgttgatgtcgcgccgtaagcaaccgctgagagtacgcctttttcagtcggcgcataggaaccgaaacgtccgattgttttttgttctcatctttaacagcttccggagtcaccgaaatatgaagcgttttgttatctctttttactgcaacgtccatttctttctccgggttttcttttacagcggagacaatgtcagtccaagacctcattttctctccgttaatgctttggatataatccccttcttttagccctgcttcagccgcccgtccattgtctgtcagctgcccgagcataggttcatttgacggtacgccttgaatcagcccaagcatcactaaaatgacgtaagctaaaataaagttcataatcggccctgcagcaattgctttaatccgctgccatacaggtttggaaccaaattggcgattatacggcgcaatctgcacttcttctccgtctacaataaaaaaggatgtttcgctgacagtaaagctggaaagttcgtcctctttcccctgttcataaccggtgatcttcatgtcatgctctagatccgctgtttccacttcaatgactaaagcatccggatatttttccttttgattgatgatgactttctcaacttgatcttccttattaaacagaagcccgaccgtgtatccgggtttcacctcaatcatttccggatcttcgccggccatacgaacaaatccgccgaccggaagcagcctgatcgtataaactgtttcatttttttgaaagaaaaaatctttggaccgaagccgatcgcaaattcacggcagagaattcccgctctttgggctagcaataaatggcccagttcatggaagaaaacgagcgttccgaaaataatgataaacgctataactgtattcacgaacataccaccttatgtgagtattgaattgacgtatccccgggtatctttgtccacttcttgaatgtccgccaggctcggttttttcagtaattgatggcgggttagtgccttttcgatacagtcttcaatagccaaaaacggtatcttgccagctaaaaaggcagcgacagctacttcgtttgccgcatttagcactgtcggcattgttcctcctattttacctgattcaaaagcaaattgtaagcatcggaacctgtcaaaatcagctttctcaaaatgaaggctgccgatttcccataattcaagccttttcgcatctggtaatggcaatcggtcaggataagtgagcgcatattgaatggggactctcatatccggagttccgagctgtgcgatcacacttttatcatggaactcaaccattgaatggatgatgctctccttatgtaaaaccacatcaatttgttcataaggtatatcgaaaagccagtgtgcctcgatcacctctaatcccttattcatcattgtagccgaatcaattgtaatttttgcacccattgaccagtttggatgttttaatgcatcttcaaccgttactgattcgagctcctcccgcgtcttgtcccgaaaacttccgccggatgccgtaatgatgaggcgttcaatgtttttagcctgttcgccttgaagagcttgaaaaatggctgaatgctcactgtcaacaggcagcagcggaacatcatatttcttagcatgttcttttactatatgccctgcagtgacaagagtttccttatttgcaagcgcaattgtttttttctgttcaattgcctttaatgtcgggataagaccgacgcttccaagcaaagcgttgacaacaatgtcaacctcctccatcactgctgcttctatcagtccttcttctcccagcccgatttggcattcaaaagaaaaagacatttgttttaatttatgatatgtatccagatcaccgacagagacaaacttcggctgaaagacctcaatcattggaacggccttatcaatatttctgccaaacgacatagataccagctgaaattggtcttgatgtgcacgcagtacatcaagagtctgttcgccgattgatcctgttgctcctaaaagacaaatatttttcaaagttgccactactcctattcttattgctgcatgatcagtctcatattcatattagacttttttatgaaaaaagggcaagcagaaagtacaagaaaggcatgacaaacaagaaactgtcaaaacggtctaatataccgccatgcccgggaagaatattcccagaatcctttacatcgtaatgtcttttcaaggcggattccactaaatctcccagttgtccaaaaacagacaaaaacagcgtgatcaacagcagatagatatacgggatcggaagttgtgcaacaagctgaaaaatcgtcgccaatacaagtgcgatgacaattccgcctgcaaacccttccactgttttattcggactgatttcaggccacagtttccgcttcccaagcgatttaccgacaaaataggcaccggaatcggtggaccaaatgacaacacacgcataaaaaatgtatgttaatccgtattggtcaagatttctgatttcgataaaataatgaaaacacattccgatgtaaattgctgcaagcgtaataaacccgacttcatcaaaagtaaaggtgttcttgaccaacactgtgtaagtcagcaatagcagtaccgcaaataaagcgatttccattttggaaatcccgtccgcttcaaaaaacgaatactggcttggtaataagaacatccacaataataaaagaccgatcaaacccggcagtgaaaccagcttcagctttttcatccgtaaaagttcaaaaagcgccacactgcccatagcataaattaatatggtgaacggcaatttcccgacaataaccaaaaataaaaatacaattgctgccagaacacctgtcaaaattctttgtttcatgtccaccatcctctaaattccgccaaacctccggcctctctgctgaaactctcctaacgcctgcaagaagtgatcttctttaaagtcaggccacaagacgtcagtaaagacaaattcactgtaggcaacctgccatagcataaaattactcagccttatctcgccgctcgttcgaattaaaagttcaggatcctgcaaagattcagtcatcaaataagtagaaaaaagcgattcatcaatgtcttcaatattcaaagagccttccttcactttttccgcgagtgattttgcagcactgacaatttcagtacggcctccatagttaagagcaaaattaaggatcattccgtcgttttgcgccgtgtcctgtacagctttttcaatcgcacgtaatgtgtgcgccggcaaagccgtttcatccccaatgatccgaacctgtacattttcctcaacaagctctggaagatacgtattcaaaaattcttccggaagcttcattaaaaaatcgacctccattttcggtcttttccagttttctgttgaaaatgcatacaatgtcagtactttgacacctaattcgtttgcgagcttcgtggtcctttttaccaccttcatcccttcatggtggcctgcaattctgggaagagagcgttttttagcccaacggccatttccatccatgataatggcgatgtgttcgggaatttctcccttaagtatgtcttcttttgtataacgttctaagttggaagccgcagtttgctgattcttccaatttttgagtatgttgagcatgagattcctccgtcacccaaaaaggttacattccctgctgataatcaatgtaatcaacagtattaacaaaaaaaccccctgtaaacatgagagggtcttttcactattatctattgtacatagtttttcattaaacttccatgatttctttttctttgtcttttgtgacactgtcaatttttgacacatattcatctgtcagtttttgaacgtcttcagtggaagcacgcagttcatcctcagtaatgtctccgtttttctcaagttttttgagatcatcgttagcatcacggcgaacgttacgaacagctacttttgcttcttcagcatatttttttacaactttcactaattctttccgtctctcttctgttagtgccggaattgcaattcgaatcatattgccgtcacttgttggtgtaagacctaaatcagcttttaaaatcgctttttcgatatcaccgattgctgttttatcgtatggcgtgataacgagcatacgagcttcaggcacgttaatagaagacaactgatttaaaggtgtctgcgctccgtaatattcaaccgttactttatctaataatgatggatttgcacggcctgcgcgtacagtagccaattcgcgctgataagcagcaattgctttttccattttttcttttgtttgagttaatacttcttttgacacgttatttccccctcacgatcgttccgattgattcaccgataacggcacgtttgatatttccttcttccataatagaaaagacgataagcggaatgtcattgtccatgcataaagaggaagctgttgaatccatgacttccaggccgtctttaagaacgtcaagataagaaagtgattcatacttaacagctgattcatcttttctaggatcagcattatacacaccgtcaacgttatttttagccattaaaataacgtctgcctcaatttcagcagcccgcagtgcagctgtcgtatcagttgagaaatatgggtttcctgtgcccgcagcgaaaataacgacacgttttttctctaagtggcgtatcgcttttcttcttatgtacggttcagcaacttgtctcatttcaatggatgtttgcactctggactggattccgagtgtttccaagctgtcttgaagagcaagcgaattcattactgtcgccagcattcccatatagtcagcagtcgcgcggtccatgcccaggtcacttcctgtttttccgcgccataagttgccgccgcctacaacaacagccacttcgacttcaagctcagcgatttccttcacttgctttgcaatggattgaatgacagtcgggttaattccatttccctgttctcctgccaatgcttccccgctaagctttaatacgatacgtttgtattttggtttttccatgataacctccaagtgtaaacattgccgttttctattatgcaagagaaaaaaaggtttgtaaatatagttttaaaaatagggaacacaaaatgtgtcccctatactgcctgaaaagacgcgacttagccgcgaaatcttttcaccattattttttcacttggttcattacttcttcagcaaagttttcttgacgtttttcgatgccttctccaacttcatagcggacaaaagtttgaacagtagcgtttttcgctgcaataacttgtttcactttttcatctgggtttttaacgaacgcttggtctaatagacaaatttcttcgaagaatttgttcagacggccttcaaccattttcgctacgatgttttcaggtttgccttcttggagggcttgctgagttaagatttgacgctcatgatttgtttcttcttcagatacttgatcacgagaaatgtaacgagggttaactgcagcaacgtgcattgcgatatctttcgcagtttcttcatcagttgtaccgttgagaacagttaatacaccgatgcggccgcccatgtgaaggtacgcaccgaatgcagagctgtcgtcttttgtaagaactgtaaagcggcgaagagtgattttctcaccgattttagcaactgcgcttgtgatgtactcttcaacagttgagccattttccattttttggcccattgcttcttcaacatcagctggcgtgtttgcaagaaggtggtcagctaaagtgttaagaagctctttaaaaccttcgtttttcgcaacgaaatcagtttcagagtttacttctaggataacgcctttgttgccgtcagttttaataagagtagaaccttctgctgcgatacggtcagcttttttcgctgcttttgcaattcctttttctcttaaaaggtcaattgctttgtccatatctccgtcagtttcagttaacgcttttttacaatccatcatgcccgcgccagttttttcacgcagttcttttacttgctgtgcagtaattgccatttgtattcctccttatatgtttaaacaagagtatgtatattacacatttttcttgaaaaaaggtgataaaaggcagtccctcttatcaccttttgaataggttacgcagttgttgtttctgtttctggtgcagtttcttcagcaacttccgcttcttcttcgccttgcttcgcttctaagattgcatctgccattttagaagttagaagtttaacagcgcggatagcgtcatcgttcgctgggataacaacatcgatttcatctggatcacagttagtatctacgataccgatgatagggatgtttaatttgcgagcttccgcaacagcgatgcgctctttgcgaggatcgatgatgaataatgcatcaggaagatccttcatatctttaattccgcctaggaatttttcaagacgctctaattcttttttcaattgaacgacttcttttttaggaagtacatcaaacgtaccgttttcttgcattttttcaatgtctttaagacgtttaatacgtttttggattgtttcgaagtttgttaatgtaccgcccaaccagcgttggttgacatagtacatgccagagcgttgagcttcttctttaacagaatcttgagcttgtttttttgttccgacgaaaaggatttttccgccttcagcagcaagatttttagtgaagttgtaagcttcctctacttttttgactgttttttgaaggtcaatgatgtagattccgttacgctccgtgaaaatgtaacgcttcatttttgggttccaacggcgtgtttggtgaccgaagtgaacaccagcttcaagcaattgcttcatagaaatgactgacatgttatttcctcctaatataatggtttttttcctccgcttaggtcatttttgtacagaactgccgcctgcagcaccctctgcataaatcgttaagcgtgtgtatttaacaccaagacataatataacacagctttatccgacaatcaagaatcctttacacctttggagcgaaattttaaaaatagctcgatttctgtctttccgctcttcattttctgggcaatttgacttgccgaatatccctgttcatataattctatgacctggtcttcaaatgattggacctcactgtttacgagctcttcccgacggtcaacctctgtaatcagaccttcaatatgttcaggaagattctctgcctcttggactggatcccgctcttgatatgtttcagaggtctgaaggcctgacttttgggattcttcatctgattgacttgcagatgaagctttattttctatcagtttctcattttcttcttttaattcaagcagaaatgccgccaaggtgttttccgtctcttcaagtatctgtttttgctgtttttctgtttctttcactgcagcgagcctcgtatacaggataatgacagcgtacagaagaacgccgtggagcataaagcttaaaagccataatagtgttgacatgtttttcactcgctaaccatgaaattcattattgtatcactttttccagcagattctttaatttaaataatgcctttgaatggatctgagatatgcgggacgtagaaagatttaatacttgtccgatttctgtcagtgtcaactcctctttgtagaacaaactgacaaccagctgttctttttcagagagttcgtgaattttttccgcaagctgtgcaatcagttcatccttcataatcttttcttcaggcggaacatttttgtcatctctgatcatgacttgaatgttttccccgtcatcttgatcatggagcttttcatcaattgacagcagatttgcaaaaaaaccttcattcattgttgacacgacatcctgtaccgtcattccgagttcctctgcaatttccgcgggcgatacattccgaagataccgctgttcaagcttttcaattgctgcttcaaccttttttgttttttcgcgcgaggttctgggcagccaatcttctttacgaagcccgtctatgattgcgccgcgaattctaaacgaggcgtaggtatcaaattttaagtcccggctggggtcaaatttttcaagggcatcatataaaccaagcataccaaggctcataagatcgtctttatgcactgatttcggcagtccgacagaaattctgcctacatgatatgtgacaagcggcatgtaacggcgcattaagtcgtcaccggctttaggatctttccactctttccagcgcgtccaaagcacctgatcttcataattcaaggattgcattgttatccccctaataccttaattaaatcgttttttcaccttgtttaacagttcgaatatgcagcatgcaggacttcggttcaaattctatcgtccggccgcttgagccgcccgtatcttcactaataataggaatattaaataaagacagctgttcttttatcgctaatacatttctcggtccgatcttcatcaaatcatttgtcgatttaaatttaaacatctctgatccgccggccagctttgcttttaatgcaaatttccggcatcccgcttctatcagcatatcaatcgtggtctgtacggcggtgtcagcgtacttagcccggttgagctcggcagttttcgataacgtcgaatccggaagcatgacatgaacaagacccgccgtttgcttttctttatcataaagcaccagccccacacatgagcccaaaccagaggtccggatggtatccgggaagcgggcgatcttcacgtcagcaatcccaacctttataacaacagcctcagttgtactcataatgatgcacctaaggcgacaaagagcttttcaaatgaatcatagtccggcagcataaacatatgcgctttcagctcctgctgatggctttggtcaaaaattgacgtgtcgacaacaatggcgtgttctccaacctgactgagctccatcagcccttcgctgatcacagctccgaacatgtccaatgagacttcaggaacacttggatagagctggagtttcgtcaaatccgccaaagctgttaaatatgaccccgctaaaatattgcccagttcatgcaaagcggatgagctcatgtggtcttcacctaagtcctctatgtcaaaatcggggtttccaatcagctctctgataaactgctccgcctgaaaaaaaggcattataaagaacattgaacccgttaaatcgccttccattcttaaaaagatgctggcaaccgggacatcggcgccgccgaaaaaatcaacaagctcatcaaaagacagcagctttgcaaatgggacttccatatctatctttctatttaacagctgggccattgcagaggcggagtggccggcgcctatattgccgacttcccgcaaaatgtccatctgctcttctttgattccattaaaaatactcatgtcataacccctttaagattaagcttgatcgggcacagcggactgagatgattctttatccaaaaccgcgttcgcatcaataatatttaagagtctgttctcttgtttcacaatctgttcgatcgacacatccgtatctttctgaacgccttctggagcagattctatttcactttcgtgtacggtaatcacatcattcgcttcatccacaatccagccgacttcaatatcacgataagcaataatgataattcgtgtttcatctgtaatttcatactctggcaaattcaggcgttttcttaaatcaataaccggagtcaccaccccgcgtaaattgattaccccgcaaatatatggttcgacgccaggtaccctcgttggcttttgccatttttcaattgatttcacctgagtgacggaaatggcatattctttgccatttaccataaagactatcattttttcgcctgttttaatttctgcagtcatgtgagacacctcctcgaatggttaaataatcagtgcattacaatcaataatgagcgctacttctccgtctcctaaaatagtagctccggaaattgcaaagacgtttgttaaataatctccgagtgatttcagcacaacttcctgctggccaataaaggagtccaccacaaatgcagtaggtttgtcgccttttttcacgacaatgatatggagctgttccgcatcttttcttgtatcttctattttaaactcttcttttaaataaacgacagggacaatatgccctctaaagtcaatcacttcacggtcatgcgtttgcaaaatgtcttttctgtcaataactgctgtctcaatgattgaagaaatcggaatggcaaatgtctcttcttccaacttaatcagcagaactgaaataatagacaaggtaagcggcagctggatgctgaatagagagccttgaccctcggctgatttcacactgactgaaccgccaagagactccagtttgttttttacaacgtcaagtcctacaccgcggccggaaatatcagaaatttggtcagcagttgagaaccccggagcaaaaatcaattcgtaaatttggttgtcttctaaggtttcagcttctttttccgttatgaccccgcgctcaagcgctttttccagaattttttttcgattaaggcctgcgccgtcatcctctacttcgataaagacatggttgccgctgtgataagctttaagcacaacttttcctgattccggttttcccttttgcaaacgtgtttccggcgcctcgataccatggtcaatactgtttctgatcaagtgaacgagtggatctccgatttcatcaattactgtacgatccagttcagtttccgcaccgatgatcgagagttcaatttttttattcagctctttctgaagctggcgaatcattctcgggaatctgttaaaaacagtttcaaccgggaccattctcatattcagaataatcgattgcaaatctccggaaattctcgtcattcgttcaaccgtttcagtcagttcattatgctcaagctctttcgcaatctgctcgagacgcccgcggtcaatgacaagctcttcaaataagttcattaaagaatcaagcctgtcaatgttgacacgaattgttttagatccgccggctgaatgcttcgcctgttcatcgtttttagcaggctgtttttgtttctcctgcttcgcaggtacagctgctgctggtgaatcttcttgcttagattcttcaggcttttcagctgatgttaaaggagccccttgaatgacttcaacatgctcaatttccgacacgccattgattaattgttcaatgtcttccgctgattgatgtgttaagaaacaaacttgaaagtcagttccaaaatcttctgtttcaagcacttcagcacttggaattgttttggctacttctccgacttcatttagtttttcaaacaccatatagacacgaactgcttttaacatacagttttcgttcagagaaatcttgatttcatatcgtttgaagccttgctcctccgcttcttgtataactgtgcgttcaaattcatcatattcccaatcagatgctgaactctgtgcttctgcaggttcagcggaggcagcggattcagcgtgcgcaccattcacatcaagcttggcactcacttctgagatatctcttttaccatccccgccatcaataatagactgaaccattgtttccaggtgatccagagcttcaaacaaaatatccagccagtctgaggtgacttccatgtctccgtttcggattgcatccagcacgttttcaagcagatgggtaagatgtgctaaatccgtgtagcccatcgttgcgctcattccttttaatgtatgggcagccctgaatatatcatgtacgagctgaagatcagtcgggtctttctctaaaagaagaagcttttcattacatgtttgtaaatgttctttactctcatcaataaagacatctaaatactgattcatatccatttgaatcacaccctctcttttttcacacagcttgtgatggatgctgcgatatcttccacatgtttaatctcatgaatgagacccgctttaacagcagcttttggcatcccgtatacgacacaagattcttcagactccgcaatggctttcacattgccggctgttagcatgtcctttagtccagcagtgccgtcactgcccattccggtcatgataaccgctactttttcataatctgtcagtttcccgacagaacggaataaataatcagcagatggtttatgacggcttggtgtgtcatggttatcaagcacaacctggagtccttcgctgtttttaataacggatatgttttttccgcccggtgctatgtaaacacagccgttaagagctgcttcaccatcttttgcttcttttacctgaatgtcagataaatgattcagccgatcagccaaagaagcagtaaacccttcaggcatgtgctgaacgacaaccactggtgcgttcaaatccttagggagcttcggtatcaccttttgtaacgcccgtggaccgcctgttgatgtgccgatacacacaatttgtctgcccgtgccaggtttcggtttgcttaattcaggcttaacgacagcacgcacaataggttcgggccgaactgtctgggaaacaggacgtttccgcttgccggaaagtcctgccgcgacgacacgctcaactagttgttctttaattttgtatagatccagagatattgagcctgatggctttgtgataaagtcaaaggcaccgatctccaaacaattaattgtgcattctttacctttctcggtctggctagacaccataatgaccggcaagttataaatctcaataattttgcggagcgtatctgtcccattcatgaccggcatttcaacatcaagagtaataacatccggttttaataattcaatcttcttaagcgcttcttctccgtttctcgcagttccgattacttctatctgcttttcttcggtcagaaaatcacttatcatttttctcataaaagctgaatcatcaactacaagcacacgaatcaaattaagccctcctcattaaaaaagaagataatttctcaataaatgtctgtttgtcttctttgtgtctcgtttcttctctttcaaacaaggcgtccgctaaaatacggactgaccggctggcttttgcctgagggctttttatgaaaaaaggaacctgttcgacaaccgctttgctcacgatcacatcgtcagaaacggaaccggcaaactgaacctgaacatccaaaaacatatgaattgtacgggagaggcgggcaaaagcgtcaagcccttccttttggtcacggcaccgattgacagccaccttcattgaaagcttattttctgtcaaaaccaagtgcttgacagcgctgtatgcgtccataatggccgtcggctcgggagttgtaataatcaaaatatcttctgctgataaaataaaaggcagttgatcttttgataagcctgctcccatgtcaaacagcacataatcgaactggcttaatgcatgagaaagttcattggcaaaaaacgtccattttctctgatcgagctgaaacatcacatcaagaccggttccccctgatatataccgcaaaccctttgggccaacggataatgactgcagcaaaggcttacgatcggttaaaacatcgattatcgtggcagacgatgaatttcctattaatatatcaatgttccccatcccgatatcaaggtcgatgagcagcaccttcttacctttatcctgcagcgcaagtgccatatttaaggtaatattggattttccgacaccgcccttgccgctgatgacagcaagtgtcttcgctttttgtgaataaaccattggcagaacgcgctcacgtttttccattttcgcccgtaaagttgctgcttggtcatatctgttcatctgcacagcatcctcacaaaaccaagtggagatacagtctgtatatcctcaggcacattctggccgttagtcataaacccgacacctatttttgattctgccagtatattaaatacagaacctaaggaagtcgtttcatctattttcgtaaaaatatactgattgacagggacggatgaaaaccgtttgacaatatgcttcatatcttcatattttgcagtcgcggataaaacaagaaatgactgaatgctgctctcaaaaggaatcgtttctttcagttcatcaatgtattgcgggtctttgaagtttcttccagctgtatcaacaaacacatgatcatactcagaaaatagctccttcgcctgctgaaattcttcttttgtatagcaaacttccagaggagcctgcagcagttcagcgtatgttttcaactgttcaacagctgcaatacgatacgtatctgttgtaataaaagcgatttttttatgtttttcaagcatagatatggctgcgagtttagccagtgtagttgttttaccagcccctgttgaaccaaagagaacgatatattttgaatgaattggctcctgccacttgtctgctgagggcagcatatcgcatagtatttcctgaagtttgccgacaacattttcttcagtcaagccgcctgcttcaacagagaagcgaagcaattttttcagagtgttcgttttcgtagactctttgatccctgtttcttgcaaaagcttttctgcttttcgcagcggctcaggaagtacagattgatatgctgaaaaatcacctagctcctgttgcgccggaatttgagggggatatgttctctcctctatttttggactgctgaccggagtttttaatgtttgtttcggttcagctgccttctgaggcgtttttttctcaagaaagtcctgatccaatacggcgattacttcaacagcaggcttgttgacgaggccaaaccattttcgctttttaatttttttcgaatttaatatgaccgcttcattacctaactcttttctgatgagaagtgccgcttcttgcattgaagcagcagtaaatttttttattttcattaaatatccaccactccaatgctttgtacctcaacattcgcctcaagttcgttataagagagtaccggaagatcagggaagtaccgttccagaagctgcttcacatacattctgacaggcggcgagcaaagaagaatcgcggtttcctgacgtaatgagagctgttcagcttctttggcgacagagcgcactatactttctgaaatatctggttcaagtgataaatagttcccgtgttccgtctgctgcacaccgtctgctattgctttttctacacggccggaacaagtaacaaccttcaacacttcattttctttggcaaactgggctgtaatttgtttagcaagcgcttgtcttgtatactctgtcaagagatcagaatctgttgttaatttcccatagtcagcaagtgtttcaaaaatcgttactaagtttcgaattgaaactttttcttttaaaagcttagcaagcactttctgaatatcaccgacagacaatggattcggcgtaacctcttcaaccaggactggatacgattctttcaagtgatcgatcagctgttttgtctcctgccttccgatcaattcgtgggcatgctgcttaattttctccgtaatatgcgttgaaacgactgatgcaggatcaactactgtataaccaagcatgtcggcttcatcctttaccgcttcgctaatccatttagccggcagtccgaatgaaggctccactgtttcaatcccttcaatgagatcgtcctcaggagtaggcgacatcgctaaataatgatcaagcaacagctcgccttttgctacttcgtttcctttaattttcaatcggtattcattaggctgcaacgctatattatctctgattcgcacgacaggaatgacaagcccgagttccaaagccaactgacggcgtatcataacaattcggtctaataaatcaccgccttgattggcatcagcaagcggtatcaggccatatccaaactcaaattctatcggatctatatgcagaagctgaacaacactttcagggcttttaagctcgtccacctcagcctcttcctcaagaatctcatccacttcttctttttccttacctgatttagatagtgtatatgcgccaaaagcaagcaatcccgcaagcggccccgtcagaaggatgccgatcggagtgaaaatacctaaaagcatgatcgtagctgctgcgacgtataaaagctttggatacgcaaacagctggcctgtaatgtcatgccctaagtttccttcagatgcagctcttgtgaccacaatacccgtagccgtagaaattaacagtgccgggatttgcgaaacaattccatcccctacagtcagcatcgtaaagtgtgaagcagcttcttgaatggacatgccctgctgaagcattccgatcacgattccgaaaataatattgatcatcacaatgatgattccggcaatggcgtcaccttttacaaatttactggcaccgtccattgctccataaaagtctgcttctcttgccactttttcgcggcgatgcttcgcttcctgttcggtaatcatccctgcgtttaaatcagcatcaatactcatctgcttccccggcattgcgtccagcgtaaaccttgctgcaacctcggaaacacgttcagcaccttttgtaatgacgataaactgaataataataaggatgataaatacaacgagtccaactaatacatttccgccgacaacgaaatttccgaaagtctcgacgactttacctccctcaccgtgtgaaagaattgaacgggtagttgagacgttcaagcccaaacgaaatagggtcaaaagcagcaacagtgacggaaaaatcgaaaactgaagcgcttcctgcatattcattgtggtgagaagcacgatcaacgcaagagaaatattaataatgatcaaaatacttaacagccatggaggaaatggaatcaccagcatcgccacaatgaggacaacacttattaaaacggataaatctcttgttgacatgctgttttttctctccttttaaatcgaaaaattcaatatactttttgttttgttttatatacgtaagccagaatttctgctaaaactttaaaaaattcttccggcactgcctggtcaatttccacttgatcatataacgcacgggcaagcggtctgttttctaccatcatgacatcatgctctttagcaattttcctgatttttaacgcaaggtggtcgacgccttttgcaacaatataaggtgcgtccattttttcttcatcatatttcaaagcaatcgcatagtgagtcgggtttgtgataatgacatctgcttttggaacttcctgcatcatccgcctcatcgccatttcccgctgtctttgtttaattttagacttgataatcgggtctccttcagattttttgtactcatcttttatatcttgttttgacattttgatatttttctcatagtcaaatctctgatataaatagtcgagaccagcaagaatcaacaatgcacctgcaccgcttagtcccatccacaaagtgagttttgaaacgaaagaaagtgcctcttcgggtgtcaggagaggaagccggagaatttctccataatgcagccaaagcacagcaaaagccgcaaaaccgacgactacgattttcaaaattgatttaatcagctctacaatcgccctcatactgtatattcgtttaaagcctttgatcggatccagtttttcaagcttaggctgtatcacttcagcagaaaacaagaacccaacctgcatatagttgcttacgactcctgcaacaagagcaacaagcaagatcggtgcgagtatcatgcccatatcctttaataagctgacaaacaatgtatgcacatttgattctgagagcttcattgtgagcgattcggtataaaatgtttctatgaatgacagcagcctgtctctcatatacggaccaattgcaataagcgaaaggaatattaccagtaaagaaacggcggtattgacatccgagcttttggctacctgccctttttttcgcgtatccttccgttttttcggagtggctttttctgtcttctctcccgcaaaaaactgcaggtcaactctaagcttcattaagaaacaccgaccaatgctaaaagattccgcatcgtttcaatcgttaaactgaaaacattccggacaacgacgaagataacggacatacatacaatgagcataatgaaactgacagcgatctttaaaggcagaccgaccacaaatacatttaactgcggaacagttcgagccacgatacctaatgctaaatcaactagaaacaaactggccacaaccggcgctgacatttgaaaagcgataataaacattgcattaaagcttttcgcaataaaataggcaaacttttcatcgccgaaattcggaaatgcctgatcaactgaaatatactgaaagctgtagtaaataccatccagcaacaaatggtgggcattgacactcagcataaacaaaagtgccatcgtatagataaactggccaatcaacggactttgtgcaccggtttgcggatcaataacgtttgctattgaaaatcccatttgaaaatcaataaacgagccggcaatctgcactgcggcaatcatcatataagcaattaaacccagacataggccgaccaaagcttctttaaacgccaaaagcatatagtgctcatctatctccaaagagggcggtttatcaatggtgctgaaacaaatgaccgcaagaaaaaaagcaaaacctatgcgatgaacagctggcacatttcgatgtccaaatagcggaatcgttacaaaaaaagcagagattctaataaaaaccaataaaaaagcaggaaataagtcaataattgaattcatctctacattaccctgcaaaacgatttaaattagaaaacagctctgttgtaaatgaaagaatcgtcgacagcatccacggaccaaaaaaaatgagagccaggagaaccgccacgattttcggaataaacgccaaagtctgttcctggatttgagttgtcgcctgaaatatgctgacaattaaaccgaccagtaaagcaatagccaataatggcccgctgatcatcagcgttacgtatacggctttttccgccatagaaattacaaattctgaactcacgtttagcacctaccctaaaagctctgaagcaaagatttcacaattaaataccagccgtctaccaaaacaaaaagtaatattttaaagggcagagaaatcataactggaggcagcatcatcattcccattgacatcaagacgctcgccactaccatatctataattaaaaaagggataaaaatcataaaacctatttgaaatgctgttttaagctccgatatggcaaaagccggaaccattgttgttaacggaatatcctttaatgattcaggtttatccattttcgcgtaattcataaacagcgccagatccttctgccttgtgtgtttactcataaattctttaatcggttcctcagctttcgtatacgcttcatccaagctgattttgttgtccattaatggggtcagcgcttctttattaatttctgaaaaagtaggagccataataaaaaatgttaaaaacagcgcaagcccgattagaacctggtttgggggcatagattgcgtcgcaagtgaagttctgacaaatgacagaacaatgacgatgcgagtaaaacaagtcataagaatcaatattccaggcgccactgaaaatacagttaacaataatagtaatttaacagtcgaacttacgttttccggatcgcttgaactgaaaatatttataaactcattcatgatgacgtgggcctttcttctttccttcagaacggttttgttttaactcttcaagttgctcttttaatgcttttgaaaatgaaggcagtttttgctgcggctgatgttcagaactcttaagcggcttcacaaacttttgccactctattttgcttgacattgcctcttcatgctgactgagaatgacttcaatctctttttcatcctcaatttctttcagcagctggatcgtctctcctacaccgacgacgagcacacttttcccgaccttgatcaattgtatggatctgttctgaccgaccgatgtgccgccaatattttcaacatattgaaaaggctttaggagccgatttcttttgttcatgagcttaaccagcccgtaaatcagcacgataacaaacagtaaagcgaaaatcatctttacaaaatcaaaagctgagacagaaggagcagccgctccctccgtctcatcagcagtttttgttgttttttctttcttttgctctgattgatctgcagttttttcatctttcttttgaaaccattcgtttacagttgaattatcagagtctgccgcggcagcagcaatcggatgtacactgaataaaacgaaaaacaaataaaaacaataaaatattgactctttttcaacagtcgtacaccctttaatttaatgttttgttgattgcttcaagcacacggtcagcctggaaaggtttcacaatgaaatccttagcgccggcctgaatggcatcaataaccattgattgctgtcccatagcagaacacatgatgattcttgcctgcgcatcaatttgtttaatttcttttaatgctgtaataccatccatttctggcatcgtgatatccatagtaacaaggtcaggtgaatgctctttatatttctctaccgcttgtgctccattttcagcttccgccacaacttcaaaaccatttttaaccaaaatatctttaatcatcattcgcataaatgctgcgtcatctacaattaaaattctatgtgccataatctatctctctccttgtgtttcgttattttaaattattaatgcgctctgcctggcttaaaatgtcagtgactctcactccgaagttttcttcaatgacaacgacctcgcctttggcaacgatacgctgattaactaaaatatctacaggctcaccggctaatttatcaagctcgataatacttccggcagaaagctctaaaatctcttttacgcttctcttcgttctgccaagctcaacagtaatcgaaagcgggatatccaaaagcatatccagattatgaataggggcttgtacagcttcgtttggatcaaacgcggaaaattccaccggtgaaacctgaactggcgctgctttttttgctgttccctgcctttttggcggctgctgctgttgcttcggttcaatacgcggctctggcgtcacaggctctttcggctgttcgtatgtaacttcaggctgcaccgtttcttcttcctctgcactttctgagttcataaggcttgaaattaaatctttcgcaaatgtcaatgggtaaagttgcataatgctggagtctattaattctcccacctttaagttgaaagaaactttcaccagcatttcatcatcaggaatacggtctgtacccttttcttcagtaacatccagcaattcaacccgaggaggtgaaatatcaatttttttactgaatacagtagacattgatgtggcagccgatcccatcatttggttcattgcttcttgaaccgcacttaaatggatttcacccagtgaagggtccgcaccttttccgtctcccccgatcattaagtccgcaatgatcgccgcgtcactttgttccacgactaacaggttgcttccgctgaagccctccgtataattcacttcaatcgctacatacggttcaggaaacgcatcgctgattttacttcttggaatgaccgttacgcttggagtcgtaatatcgaccttttgatttaaaagcgttgacagtgctgtcgcagaactgccgaatgaaatattaccgatttcaccgatcgcatcacgctccatttccgataagtcatctacttccggaatctctggctcatcaagcgtgctgccagtaccgttaagaagcgcgtcaatctcatcttgagataatctattattctccatcttgttcacctcttatgtcgtgatctaaaatttgcactgcctgttttcgattcacccggccggcttgtcctaaaaatttcggcttatctccgaccaatacagtaagaggatccgtgactgatttgtccaaagttatgcagtctccgacttctaaacttaaaaactcttctatcgtcagttcagatgtgccgagctcggccacgacaggtatttgtgctgtcatgatacgtttttcaagcgactttgtttcctcaggctttggctcatttcggtctgattgcatccaatagtggactgaaagcttcggtatgagcggctcgagtacaatatgcgggatacagagattaatgacaccgctgatttcaccaatttgagtattgagcgagatcaccacgactgtttcattaggagataccatctgaacaaattgcggattcacttcaaactcagtcatttccggttcaatatcagcaattgactgccaagcttctttataattacccagtgcattttcaaataaattagaaatgatttttgtttcaatttctgtcaaactgtcaaccttgttatgactgattccaatcccgcccatgactcgatccatcatcgtataagctatcgtggggttgacctccatcataattcttccttccatcggatgaacatcaaatagattcagaatcgtcatgtttggaatcgatctgataaattcctcatacggaacctgatcaacagaactgacagatatgtgaatataggttctgagctgagcagaaaaatgagtggtaagaagtcttgcaaaattgtcatgaattctcgttaaactgcggatctgatccttagaaaaccgcagcgcacgtttgaaatcataaaccttgactttcttctctttttcttcttttttcagctcttcagcgtccatttcaccagttgatattgcagagagcagtgcatctatttcattttgggagagaacttctcctgacattttcctcacctccgtattctgtcaaattatgctttattgcagattaaaggaggtaatatacactttttctacttttccttcttggaggtagctatttattttatcttttagttccttcttaaaggtttcttttcccttgtctccctcaatctgatcagcattcgtatcagccagcagtgatataacagcgtctttcacttggaaatcacgtttctcaagttcttcttttgatttatcagaatcagtttcaagtttaatagcaagacggataatgttatcagactttaaatttgttgtgatctcttctacatcaacagaagacgcaacgatttcatcaatactttttttcgcttcacttttttcggactttccgcctaaaacaaaataagccgccgccccgagagcaccaattacgataagaataattagtaatatgatcattaactttttcttcattccggttcctctattccttgatccattgcaaatatttgtatttttcggtagaaagctgcgatcttttccagaacagcttcttcatcttcttttactacaaacttcttaccatttgacagagtaattgtagtatccggaaaacattcaatctgttcaataaatagcgcattcagtgtaaagggctgcccgttcaaacgggttactttaatcataaaacagcggagaagcgattactcgcctcccctccctccttaacgtttaaggttaaccagttcttgaaggatttcatcagatgttgtaataatttttgagtttgattggaatccgcgctgggctacgatcatttcagtaaattcgtcagttaaatcgacgttagacatttcgagaaatcctgatttaagagcaccagttccgccgtcaccaggctggttcgctgcactggccgttccagagtttaaagattcacggtataggttgcttccgattttatccaatccatcactgttggcaaaagtaacaatcccgatttgtcccccgtcttgtgttttcccctcagcatcaacaattgacacctttccatcagaaccaatgctaaagctttgagcatcagtaggaattttaattgttccgccattcatatttagtacatggtagccatcacctgtaaccagtgttccagtattatctaaatagaagttccctgctcttgtataagctgtcccgtcacctgtatcaattcggaagtaaccgtcgccgtcaattgctaaatcaagtgttcttcctgtgctttgtgtcgcgcttgttgaatgaattgtatcaattgtgccagatgatgaacctaaaccgatttgcttagagtttgttccgccgattgttgcaccagcagcagaaccgccggcaatcgtttggcttaccatatctttaaaggtcacacggctctttttgaatcctactgtatttacgttggcaatgttgttaccgattacgtcaagctttgtttgaaagtttttcataccgctgattccagaataaagtgaacgtaacataatatattcccccagatgtttttatttagatgattgtcccacagacatgacattcgcaggactgatctcggtcccatcatcaagaacgagataataatttcctttaaaatgtttaacagagcttactgtgcctgttttatctgttgcacttttaccatcagtccaagatacttcttttcccatccaatcaacatacgttgtaaacggatcttggttttcaacgaattgagtcattgtcgtattcagattcatcatttgctccaagcttgaaaaagtcgccatctggctgataaattctttatcgtcaatcgggttaagcggatcttggttttgaacttgagtcattaatatttttaaaaactcgtctttccccaagctgctgttgttcgtcgacacagtgttcgttttttcaggcagtttatattctgaacttatagaagtcattcttcttcctccatttcaaccatcgacacttcatcgagcagatcgccaaaatcatttgattgctttttctgtctttgctgtctctgcccctcttgctgctgtttctgttcatcagcaagctggccgtatatcggctgatccccgctttggaccggaagagtaaaacggtcaatttggacggccatattcggcaatgattgcttcagctgaggaagatgctgttcaagcaattcttttgctgattggctagatgctatgattttactctgaaacattccattttcatttgtcagcttgattgtgacaaatcctaaatgttcagggttcagccgaatagtgaaacttcccgtcgatctgccgaaaggcgtatatttcatctgcttccacgcattaatcacttgatcagccaccgtttttgtttcggcatttggtatatcagatgacatctgctgcagatcaagtgtttgaactcctcctatgccccgataccccgaaaacagcatttggagtcctgatttactatctacaggctgaatacttccagaaacatccgatgcatttttgctggatgaactctgcgagagcggtgtgagaacactcttcccaaagtcttgtgatgattcggatgatttcgataacaagaaggctttcagctggctttcagctaaactccattctttggtccctttttgaggaagcatagacatttgatccattaagctttgaaaacttttcagctctgacgctgtcatcgagtaaagttttgaacttgactcagctttagtgaatatttgctgtttaagatcctgaattagttgttgagatacacccttcttttctaatgcagaaaggaattgatctccattttggtaaatggcatgagcttcattgccattcccgagatcagtcagcttattcccttctacgagctggctaatgaacatctggatatagataagctcttttgcaggctcggatacttcattttcctgatttgattgctctttatcagacttcagtgctccattaatgtcagaagcagaatcattggcactcagagccgttttagcttctgaaaagattttctccgtttctgtgagcaattgatccgtcccgcctgacatttttgattcaactgcttgcaaaagattttgcaacatttgcagagcattcgcatccaattgcttccctgtcagtttgcttaatgtttgcaaaagatccgcattttgtttgtcttgatcttcaggacttgcatttagccattcaccgatctttttaagcgcatctgctaaaagctgatcttcagaattaggagttccctttccttgttctgaaagttccttcaatccagcctcagacataagccagttttgaaaaactccctggctacttttcatgtttttagcggcagaacccgttgtggtttgcagcaaaggtccggctaattcaagcagcttcacctttcattccccctattcttggctggcagcaattttttctgtataggttgctgcttgctcaggagtcattttcgccaatatgtcagcaagctgctttttgcttaggccattcaatattttcagtgcttcttgctcctttaattgggcaataattttagcagcctttccgctgtccatgcttttgtacacactgatcactttgtcattttcagaagaagctttcgagtctgctgatccttcagtatgatcttctgatgactttttttgatcctcagccgtcttttcaagtgaacggatcttttgattgagcctgtcgatttctgatttacttgtttctaaatctttattcaatatactgatttcacttttttgatccttaatggtcttttccagagctgccgtattactgctatccttacttgatgctgcgccttttttattttcggtttcagggaccaattctttaagaaccggcgtttttgccgcagcatcctgtatcggctttaagacattgataccagcagcccaaagaacaatcccccctgcgattaatagaaacatcagcgggaggataatgataagcaaaaccgaacggaacttacctgattctttctttttgccggacattacattcgctcctaatggccttgaatcataaactgcttaatcgaaatatcgtccatttctttcatttctgcagctttatcttcaagagcaaacattttaaactgtttttcacgcattttttcaaactttttcacttcaatgtttttctctgtcaaaatttcttgtttttgattcatttgatttcttttcataatgacaagcttttgatagtgatagatcgtattatcaagatttgagacaaattgttggtagtgcctcatttcttgtacactcatgccgctttttaatttcttttccttattttgttccagcaattcctttttgctcatattctcatataatttttcagcaacgttttcaaattcagaaactgattgctgatattcggataaggattggtctttttcattttcttttagttccagcagcttttggaatctaaattgataagccacgtttattcctcatttcctgtcaaactagttaatgcagcaatgctttcttccaataaagccggttcgtctgttccctgctttaaaaattgaataagctgcggataaaattgtatcgcttcatcaatttctctggatgatcctcttttgtaagctccgatattaatgagatcttccgaattttgatatgtcgataaaagttcacggaatttatttgccgcatccagatgctgttttgttgaaatgtttgacatcaccctgctgatgctttttagtacgttaactgcaggaaactggcctttattggcaagcgccctgtccaacacaatatgcccgtctaaaattccgcgtacggtatcggcaatcggctcattcatgtcatccccatctaccaacactgtataaaatgccgtaatggttccatgctcgtttgcacctgttcgttctagtaaacgaggtaaaatagcgaacactgaaggtgtatagccttttgtcgtcggaggctctcctgcagccagtccaatctctcgctgcgccattgccacccttgtaacagaatccatcataaacatgacattttggcctttatctcggaaatactcggcaattgcagtcgctgtatatgccgctttcaatctcattaatgctggctggtctgaggtggcaacgactacaatcgatcgtttcagcccctctttccccagatctttttcaataaactcccgaacctctcgtccgcgttctccgacaagtgcaatgacgtttaagtcagcctctgtctgcttggcgatcatccccattaaggtgctttttccgacaccgcttcctgcaaaaattccaatccgctggcctttaccgactgtcagcaagctgtcaattgatctgactccaacacccatcttttcacggataggcggccgtttcatcgggttaggcggtgattgctccgttgatacaggcgaaagccctttcggcagaagctttccgtcaagcggttctccaaaagcatcgatgacttgtccgatcagtccggtcccaactttaacccgaagtgattccccagtagcttctacaatgctgccaggtgcaatgctcgcagcctctaaataaggcataagcaaaatattttcttcctggaagccgactacctcagctttaatgactttcccagactgtccttttgcataaatcaggcacaggtcaccaattgagcttgctggcccttttgattcaatcatcaagccgattacccgcttgacttttccgtaccgtttatacgagtctgtcatttctatacaatctatcagactctgtgtcttcattcagctgcacctgcttccagcgctgtcagaagtttatctttcaattgcatcaattgtgtgtcaacactcgcatctaccctgccaaaaggagtttcaatataacaggttcctttttgagctttttcatcagcatatatgccaagccgacattctttataaagaagctgctggatttcatctttttgctgaaagattgtctcatagtaatatggatcaacataaattgatatatcgtcatattccttcacttcgtttataacctgttgtacaagcaggaggaaagcctctttatcatcagacttttgctgccaaactttttttgctagggcaacggcaagctcaacgatttcttcattagcgtcttcaagcttgtcctcaacagcttttctggacatttcagttatactgtttgcttggccgatcagttctgcatactgtttcattgcctcagctttgcccagcgctactccttgttcaaagccctcggcttttgcttcttcaataagcttctgtttttcagccgcccaatcgtttttctcctgttcaatttgacggcgaatattttctatatgactgtttgcctgctcagaaatccggtcagcttcctctttcactcgggccataagcgcctccgggttctcttcagcctgcaaaaggtgagaatgatcaatacgcacctcttgtatagaaagttttctttttccttttgtggagaaatagatgattcttgtttaatgatattagacaataatatcatcccctccgcctcttgctattacaatttcaccggcttcttcaagctttctgacgatgcttacaattcttgattgagcttcttctacatctttcaaacgtacagggcccataaactccatttcttctttgaaggtttcaaccatacgctgtgacatattgttgaacacaatttctttgacttcctcgcttgcaacctttaatgaaaggagcaaatcgtcgttctcaacatcgcgaatgactctctgaattgcacggttatcaagtgtgacaatatcttcgaagacaaacatccgctttttaatctcttcagcaagatcgggatcctgaatttccaatgaatccaagatcgtcttctctgtccctctgtctaccccgtttaacacttccacaacagcttcaattccgcctgtttgtgtataatcctgagtaaatgcagaagataatttttgttccagaatccgttctacctcgttaattatttctggagacgttctatccatgaccgcgattcttctcgcaacctcagcctgcacttcagggttcagctcggataaaatttgcccggcctgcactggatctaaataagacaagattaacgccatcgtctgcggatgctcttgctggataaaattcaaaatttgttctggctccgcttttctggcaaaatcaaatggtttaacctgcaaagaagaagtcagcctgtttagaatgttctccgccttatcctctccaagcgccttttccagaacttgtcttgcatagcttaaaccgccttgagaaatataatcttgcgcaatggctatattatgaaattcttctatgatttcatcctttttttgatgatcgacgcttcgaacacctgatatttccagagtaagcctttcaatttcttcatcggttaagtgcttatagacagaagctgacacatctaaccccaaggaaatcatgagaatggctgctttttgttttcctgtaagcttatcttgatcacgtctcgccatttctaattcctcctaatcctcggccagccagcttctcagcagttttgcaaaatcttccggcttgtctttcgccatcttttcaagctgttttcgtctgactgattccgctgtttcattttcctcttcgttgatatcaggcaaattgattggttcttgaggaacctcatactcatattcctcaaattcatcctcttgcgcccgtttctttctgataagcataatgatcagaacaatgatcgctgcgattaaaacaccgcctacaatatatgcccacagcgggatacctgaggattcttccgtatttgtatccaaattgacttttccgtcgaatggctgaacggaaacaacaatcttattattgatatcagcatcagataaattctgattttgcgtttcatctttatccaaagatgttctgactacagttgaaaggattttttgtatatcatcctgtctttcagttgatagcgacgcagtgtttttggcatcaggcggctctaccattacttgaatccctaaatctctgaccttataaggactttcagcgatttctttatgaattcggttaacctcgtaattgattttgttgctgtttttttcgtagttcccgctttcggtattttcaccgtcagccttataatttgtaacatcttcctcgccggttccggcagttccgccgttggctgcaccgtcgccctgatatgtttcagataccttttcagcgctgactgcaatgccttccatgttttctttatccacaggttcgacaatgtcttctgtccgattttcttttgtgaaatcaatgtctgctgtaacggagacaacgactttatcttggcccatcatcgtacccagcagtgactgtacatgtttttgaatgtctttttcaacttgagacttaattccttgctgagaagaataactatccgcgtaggaccctgcatcgctgtctgatttgtcgtagtatgtagaattttggtccatgatgacgatgttatcttcttttaggtttggcacgcttttagataccagatgatataatccgttgatttggctttgatcaagtgtataacccggttgaatctgcaaaacgattgatgcagatgctgcagattgctcttcaccgacaaacacagcgtctttcgggagattaatcattacttttgaatttttaataccgtccatttcattgatcaagtttgacagttctgtctgtgtagctttcactttcaccatatcaaactcattgtctgtcaaaccaaagccggcattctgtccaaaaaacgaataatcaattgatcccgttttaggaagtccttctgcagccatctgcactttcaaagaatcaacctgatcctccggaacactaatcactgtaccgccattcgaaagttcgtttggcactttttttgcatccaattcttctttgatttgtcctgcttcttcggcagacaaatctttgtacagcggcgccattttagaatttgaagcaaaaacactaataataattccaataataataattgccgctaaagcactaaccattaaaatcttttgtaatttagatctatttttccaaaactcactcgttttgtttttcatttgcattagagtacgattcatgttaacccccggtcattccactctttctctaaatcgtcagaccccctacatttgcattctcataatctcctgataagcttccacagctttattgcggaactctgttgctgcagttagagagatgctagctttttgagcagcgatcatgacctcatcaagatttacatcttttcctgcagccaaggcattagtcatgttgtcagaagctacttgggactcatttaacgaactaatagagttttttaaaagctccgaaaagcttgtttgatttgaagaatctgttttttggctattgtttacttgatttgttgcattttgagtgttttgagtattttgaacctgaaaaggagaaattgcattaatcacattcattcacctactttccgatttctaacgccttcatcagcattccctttgtggcattcatcgccgtgacattcgcctcgtatgatctagtgctgctgacaagatcaaccatttcctttaatggatcaacattaggcttttgtacatatccttcagcgtttgcatcagggtctgtcggatcatagacaagattaaaatccgaatcatcctccgtaatttttgaaaccttcacaccgtttccagcattcccgcttccgctcatttgagaattgagaatggaagagaacgattcaccttttgactgaagggaaaccatttttcttctgtaaggcacccactctccattcacctgcttagctcttgtcgtatccatatttgctaagttagatgatacaacgtccattctgactcgctgagctgttaaagccgatgctgaaacatttaagctatgaaaagctgtcatcattttcctcctgttaatacggtcttcagcgaattaaatttaccgttcattctttcaaccaaagcttgatagttgatttgattttgcgccaattctgtcatctctttgtcaacatcaacattgtttccgttttgctgatacgatgtatctccgctcgcaacaattgaataattcgaatcagtatcagaaaaatcaacatgacgatagtctgtttttatcgcttcaagacgcgaggattcttgatctaataaattttggaaagagactttttttgccttatagttcggtgtatctatattggcgatattattagttatgactttttgcttaatatccgctctgctcaaggcattttcaagattttgtatcgttccagaaaataagctcaaatccacttacctccatttcagtttttttcaccctcaatatccttgtcgagaattgtaaaactatatgcttattgtaagaaataacaggcataaagtctatgaagttcgtgtaaaaaaatgtcctcacaattatctattttgcaactaggtataaagtcctagattgttagaactacatttctcgccttgatataagcctgaaaatagcagaatttctgttttttctcctttcttttcggcatttttgaaactttttgaagaaaaatgcaaaatttattaaaattattacatagaaagactttcaacccaggaaataaagcttattgatttcctttatttgaaataaaaaaagaaccctcaaaaagggttctttttgtgattaatgagattttagattttctaattcaattaggaatttgttgtttagtaccttgatataagtacctttcattcctaatgatctagactcgataacaccggcgctctccagctttctgagtgcgttcacaataacagaacgggtaatgccgacacggtcagcaattttacttgcaacaagaagaccttcatttccgtcaagctcctcaaaaatgtgctcaattgcttcaagctcactgtaagaaagcgagctgatagccatttgtacgacagctttgcttcttgcttcctcttcaatttcttctgctttttctcttaggatttccattccgacaactgttgcgccgtattcagctagaattaagtcatcgtcattgaattgatcttgtaaacgcgaaagaataagtgttcctaatctttccccgcctccgatgatcggcacaattgttgttaaaccagcttgaaacaggtctctgttctcaacagggaaagcagtatattcactattaatatccaagttagaagatgtttcagggacattaaacagatttttcgtatattcttcagggaattgacgatcctcaagcatttttttcatacgatcattttcaatttgctggttaattgaatacccaaggagtttccctctgcggcttacaacgaaaatattggaatcaattacatcccgcagcgtctccgccatttccttgaagtttaccggtttccctgccgcagcttgcagcatggagttaataattcttgttttttgtaataaagccatgataaataatcctcctaaacattcctcatattaaatttttcacaatataaattgacttaaatctttgtttttggctatcgttccgagcttttcttcgacatactgtggtgtaatcgttattttctccatcgttacatctggagcttcaaacgacaaatcttctaataggcgttcaagtattgtatgaaggcgtctcgcaccgatattatctgtgtcctggttcacatgataagcaacttcagcaatcttatgaatagcttcgtcagaaaattcaagagatataccttctgtctgcaataatgcctgatattgtttcagcagcgcattatccggctcaaccaaaattctcacgaagtcgtctaccgtgagtttgttcagttctacacgaatcgggaaacgcccctgcagctcaggaatcaaatcagacggtttggccatatgaaacgctcctgctgcaataaataatacatggtctgtttttacagaaccatattttgtgacaacggtagaaccttcaacaatcggaaggatatcccgctgaacaccttctcttgaaacatcggcagaagaagatgcaccgccgttctttgcgattttatcaatctcatcgataaagataatcccgctctcttctgctctctgaacagcttcctggccgacttcatccatatcgatgagtttgcttgcttcttcattcgtcaggacttttctggcttctctgactgtcattttgcgccgcttctttttctttggcattaatccgctcagcgcatcctgcatgttcatacccatctgctccatacccgagccctgcagcatgtcaaacatagaaggctgctgttcttcgacttctactgttacatagtagtcttcgagctctcctaaagccagctgatgcgccattcgttttctttttcttcgatgtttgcttcttcctggctctccgcctcatcttcaccattcggctggctgcctccaaaaaacatttcaaacggatttttaacaccagattgttttttcttcccaggaactaacagacgaacaatgcgtttgtttgcattttcttctgcctgttcctttacttcattcattttctcttcttttataagccgaacagaagtctccacaagatctctgaccattgattcaacatctctgcctacatagccgacttcggtaaatttagtagcttcaattttgataaatggcgcacctgaaagcttagcgattcgtctggcaatttcagttttcccgacgccggtaggacccatcattaaaatgtttttcggaacgacctcgtccttcagcttttcatccagaagacttcttctatagcggtttcttaatgccacggcgacagcttttttcgcattttgctgaccgacaatatattggtctaaccgatctacaatctgtctaggagttaacggttttttttccatgcgcctcaagtcctttctattcaagctcttccagtatgatttgatcgttcgtgtaaacacaaatttcgcctgctgtttctaacgcggctctggcaatctcacttgcagacatgctttccccggcatgctttttcagtgctcttcccgctgccaaagcgtaattgcctcctgatccaatcgcgagaatgccgtcatctggttcgatcacctcgcctgttcccgatacgagaagcaaagtatcctgattcataacaatcagcatggcttcgagctttcttagcactttatcactgcgccattcctttgcaagctcaacagccgcccgttttaagttgccgttatattcttcaagcttagcttcaaacttttcgaataaagtgaaagcgtctgcaacagatcccgcaaaaccagcaagaactttgccgttaaacagttttctcactttccgtgccgtgtgtttcatgacaacagcctgaccaaatgttacttggccgtctccggacatagcgcttcgtcctttatgctgtacggcaaatattgtggtcgcatgaaaagatgacataaagggcctcctttaatttttcttaaatgctcttggatggtgagacatatatgtgtttctcaacatttccttcgaaacgtgcgtgtatatctgtgtagaagacagattggaatgcccgagcagttcttgaacgcttctcaaatccgctccttcatttaacagatgcgtggcgaacgtatgtcgaagcatatgcggatggatatgtaaagtgcttgacgctttttgaacaagcccgcttaaaatatgtctgatgccacgggctgtaagcggtccgcctctttgatttacgaataatagatcatgaggttcttttgccttcatcagcaagcactgtcttccgctattcatgtataccttcaacgcttcgcgggcataagacccaaaggggatatagcgctgcttcttgcctttaccgtgaacaagcacagtgtccataaataaatcaacgtcgttaatagttatggaacagcattcactgaccctcattccagtggcatagagcagctctaacagcgcttgatccctcattccggccggctggcttatatctgaaacttcaaacagctcctcaagctctttttgatatagaaacttcggtatccgtttctcctgttttggcagatgaacaagctgaaacggattttcttcaataagcttttcccgcatcagaaacttataaaagcttcttaatgcagatatctttttgcttattgttcttctcgataaacctttttcataggcttctgtcaaaaaaatcctagtatcttgatatgcagcttcttcaaatccatttataccttgaacgcgcaggaaagtctcgaattcttcaattgaatccacataattcacaatagtatattgtgaataatttttttcaatttgtaaatattcaacgaataactttacgaaattcttaacattctccatgcctaatacctccccaggaagggcttttaaatggtatcacaaatcgcgctcaggttgcaatcaatacctatattgttttcgaaattgtttgaattgtttcaatcgcacggttcgcgtattgttcatttcgttcttttttatttttaattttaactggcaattctttcaaaagcccaaagtttgcattcatcggctggaagttcttctggtttgttgttgtaatataatgtgccatactgccaattgctgtttcctgagggaagatcacaagctcttctcccaatacaagcttcgccgcattaatgcctgctacaagtcctgaggcagctgattccacatatccttctactcccgtcatttggcctgcaaagaacagatcactgcggtttttaaattgataagtcggctttaacaggcttggagagttaataaatgtgtttctatgcatcacgccatatctgacgatttctacattttcaagtcctggaatcaacttgagaacttccttttggtctccccattttaaatgtgtctggaatcctacaatattataaagtgttcccgcagcatcatcctgtctgagctgaacgacggcataagggcgttttcctgtaacaggatgctctagaccaactggtttcatcggaccgaaaagcattgttttcttaccccgttttgccatgacttcaatcggcatgcagccttcaaagaaaatctctttttcaaattcttttaacggcactgtttctgctgatgttaatgcttcatgaaaacggtcaaactcttcttctgtcatcgggcagttcaaatatgctgcttcacctttatcataacgggatttcaggtacactttatccatatcaaggctgtctttttctacaattggcgccgctgcgtcataaaaatataaatagtcctctccagtcagctccttcagctgggcagacagcgattcagatgttaacggacccgttgcgatgatagtagggccttcaggaatttcagtcacttcttcattaataacggttacgtttggatgatttttcacccgatttgtcacacttgcggcaaattcatgacggtctactgcaagagcgcccccggcaggcaccgaacattcgtcagccgcagcgataatggctgaatcaagcgcacgcatttcttcctttaatacaccgacagcgttagcaagtgtattagagcgaagagagttgctgcagacaagctcagcaaatttatctgtatgatgcgcaggcgtttgtttaactggccgcatttcatacaatttgacttgaatcccacgtttggcaagctgccatgctgcttcacttcctgcgagtccggctccgattacattcactgtttgttggttcatctttcacatctcctagtttattattcaaggccttcttttaacacacaaagaaggtgagcaagaccctgctcaccgctacttctgtggttcttccttataatcgcattccacgcattggacttgtataccttttttgagttttttctcgacgagcatttttccgcatttcgggcattttcgttcaattggtttgtcccatgatacgaattcacagtccggataacggtcacagccgtaaaacacccgtttctttttcgattttcgctcaacaatgtttccttctccgcagctcgggcacttcacaccgatttgtttcacaatcggtttcgtgttccggcagtcagggaagttggagcaagctaagaatttaccgtaccgtcccattttatataccattggagaactgcacaattcacaatcctctccagcatactctggttcaatctcaacttccttcatttccgattcggcttttttgacgcgtttttcaaaatcggtgtagaaattatcgataatcttgacccattcggtatttccttcttcaacatgatcaagatctctctccattttagctgtaaactcaacgttaatgatctcagggaaaaactccatgatcaagtcaagaacgatctgacctaattcagtcggaacgaaacgtttattatccaatgccacgtagccgcgccgctgaatagtatcaagtgtcggagcatatgtggatggacggccgataccgcgttcttcaagggttttaacaagccgggcctcagtatatcgcggaggcggctgggtaaaatgctgctcaggttctatatcttttgataataccgtgtcgccttcttgtaagtcaggcagcatccggtctttttcttccatttgatcgtcttttccttcaacatacaccttcataaacccggaaaacttgactttacttccatttgcacgaaatgtcaaaccgttgtttgtcaggtcgacactcattgtatcgagaacagccggtgccatttggctggcaacaaaacgctcccaaattaatttatacagtctcatttggtctctgccgaggactgcttttaattcacttggttttctaagaactgatgtcggccgaattgcttcgtgggcatcctgggcattttcattctttttcgcaggcttccgttttccgcctaggaactcttttccatatgtctgatcaataaatgcagctgcttcatcaacagccgtatttgaaatacgggttgaatccgttctcatatacgtgatcagaccaaccgttccttctcttcctaaatcaattccttcatataattgctgtgcaatcatcatcgttttcttcgctctgaaattgagcttgcgagccgcttcctgctgcagggtagaagtggtaaaaggcaaagcaggattacgtttgcgttcctttttggttactttttcaactgtatattgattccctttgagctgagaaagaatctcttttacatcagcttcactatttaaaggaagttttttgccgtttttcccgaaaaagctcgcttcaaaggtttcttgaccttttaagaacgtaccgtcaattgtccaatattcctcaggcttaaagtcgttaatctctttttcacggtcaataatcaaacggagggcaacggattgcacgcgtcctgcgctaagcccttttttgacttttttccataagattggactgattttatatccgacaagcctgtctaaaatacgtctcgcttgctgtgcatccactaaatccatattgatcatgcggggatgcttaaacgattccttaatagcgtcttttgtaatttcgttaaacaccacacggcagtctgagttgagatctaaatcaagactgtgtgccaaatgccatgcaatcgcttccccttctctgtcggggtcagctgcgagatacacttttttggcttttttcgcagccgttttcagctcttttaataccgggcctttacctcgaatggtaatatatttcggttcaaaattctgttctatgtcaactcccatttgactttttggaagatcccggacatgtcccattgatgcttttactttatattttttacctaagtaacgttcaatcgttttcgccttagcgggcgattccacgatgactagataatcagacattttcatccccctcaagaggtgttctctctcttttcaagatatttcaattttatttttgcagctgtctttatttggctttcaacatttcattctttatcatgaacgtcattaattaaatagaaaacaatatgcaactttaaatcctcactattattaaatattacaataccgtttgtcaaacgataattcaaaagggttccgtatattgaacgtttctctcaggaagttcctcgaaaatatcctctgctgaccatatggctttagccccctgctggatcagttttataggacctccggcgtaagggtcaaacaatgaaccgggtacggcaaatacctctctcccttgttccaatgcttgataggcagtaatcagcgaaccgcttttttctttgccctgaacgacaataacgccttcacttagtccgctgataatacggtttctcatagggaaatgccatttttggggtttagtttcaggtgggtgctctgacagcaggatatggtgtttagccatgtgatctgctaactgaaggttttctcggggataaatgtgttgaaatccgcctgcaatgacgccaattgtccgccccttcgccttaatacttgcagcatgggacattccgtctatcccagacgccagtccgctgacaatcacccaacctttacgacagatctcttttgtaagatgattgacaacttgtttcccataagctgttggatttcttgtgcctacaattccaatttttctccctttcgaaagaagagtcatatcaccttttgcaaacagtacggcagggggatcataaatgcttttaagccagaaaggatattgctttgaagaaatagggatggtgttaatgccttgctcacgataagcagcaagtacacgcgggagctttggataaaattgttctatttcgttttttaatgcagctgcttttatttgatcacgagtaaccgtttgtaacacgggtgatgtcagcgacatagacggatcggctttccaccattttaatagaagggatggggataataattgattgattctgcaaatcgttaggcagacagcggcctgatccaatagattgacctccttttgttagaaaaagcaggaacagccttgacggctgtcccttttttattaatgcgttttacaagtttcgaacaagttcttctctttcagcaccttgattaaggtttcacccatgacagaaggtgtctctgcaacttcgattccgcatgcattaagggttttgattttttcatcagctgtccctttcccgccggaaataatggcgcctgcatgccccatgcgcttcccaggaggtgctgttttaccgccaataaaaccgactaccggttttgtcatgttggcttttacccactctgccgcttcctcttcggccgtaccgccgatttcgccaatcatgatgactgcgtgtgtgtcaggatcttcgttaaacgcttttaaaacgtcaataaagtttgttccatttacagggtcgccgccgattccaacagctgtagattgccctacacccgcttctgagagctggtgcaccgcttcgtatgttaatgttcctgaacgtgatacaacgcctacatgaccctttttatggatgtatccgggcataatgccgattttacattcttcaggcgtaatgacaccaggacagttcggccctatcagtctcgttttcttgccttccatgaagcgtttgaccttcaccatatccaaaaccgggatatgttctgtgatacaaatcacgagatcaagctccgcatctaccgcttccataatcgcatcagctgcaaacggtgcgggcacatatataacagacgcgttagcgccggttgtttgaactgcttcagccactgtattaaatacaggaacaccttccgcttctgttccgccttttccaggtgttacaccgccaacgatatttgtgccgtattcaagcatctgcttcgtatgaaataaagcggtagaacctgtaatcccttgcacaataactcttgtatctttattaatgaaaacactcattatttggtcccctgcctttcattctttcttaaactaaggatacgattttctgcgcgccgtcagccattgattccgcagatgtaatgtttaatcctgattcactaaggattttcttccctagatccacgtttgtgccttcaagacggacgacaagcggcaatgtcaaaccaacttgtctagtcgcttcaacaaccccttctgcgatgacatcacatttcataatgccgccgaaaatgttgacaaaaatccctttaacgttttgatcagaaagaatgattttaaatgcttccgtgactttttccgcggttgcaccgccgcccacatcaaggaagttggccggttctcctccataatgcttgataatatccatcgtagacattgcaagtcccgcgccgtttaccatacagccgatatttccatcaagggaaatgtagcttagatcatatttggacgcttcaatttctttcggatcttcttcatccaaatctctgtattccataatgtccttttgtcggtacaacgcattgctgtcaaaattcaattttgcatcaagcgccatcacatttccgtcgccagtcacaacaagcggattgatttcggcgattgagcagtctttctcaacaaacgctttatatagtccaagcataaatttagcagcttttcccacgagctcttttggaatattaatagcgaatgcaatttctctggcttgatagccttgaaggccaacagctggatcaatgacagcttttttgattttttctggtgttttctccgcaacctcttcaatttccgttccgccttcttcagaagccattaaaacgattcttgaagtggcgcggtcaagcactagaccgatgtaatattcttttttaatatcgcagccttcttcaataagtaagcgttttattacttggccgtccggacccgtctgatgtgtaactagggtcttccctaatagttcttcggcatacgcttttacttcgtctaatgattttgctatttttaccccaccagctttgcctcgaccgccagcatgaatttgagcctttacgacataaaccgagctggataagctctttgcactctcaactgcttcttctgctgtaaaagccactttaccttcaggaacagataccccatattttctgaggacttcttttccctggtactcatggatattcatttcccatcctcctaacttatgtaacaaaactaaaatagactgcgctttcattctataataatactggaagaattgtctacagttcgatgcaaaatcttttaatccttctaaacattcaaacttttactttattaaaaacataaatttcaaagaaggatggggaatattttagctatttttgttttttacgctttcgtccaatttgtaaatgaatgaaaaaatctcggctaccgtttcataaagagcttcaggaatttgatcatctaccgtcaaatggcgcattaattcgacaagggtccgatcttcttgaatcgggacccctgcttttttcgcttcttttataatgttgtcagctacatggcccttccctgtggcaatcactctcggcgccttgtctttttgttcgtcataatggagagcaacagcttttctgatcggtgtctgctctttcatattttcacatccacttcctgatcactgatacttgttatatattgatcgattgaagccttttcttcggtgtgaaccctttttttagcgtttacccctgaaaggctgtaccccatttcctttagcccctgtttaagcgcgggcaccatcggatcgatcgcagcctgcagctcgaaatcagtctctattgtaatggtcatgactttttgctgtaccaagcaatcaacgacggtttcttttagtgtatcaagctgcagcaaaaacaaaaggcggcaatgggaaggatcaagctttccatccgcttctttctttcctttaaacagaacagtcatgtcctgaacccctgacttcgaaaacatcggaaatgacattacaatttggctgtatgatggatggtcctgctgcatgaaaagctggccatttaatttatgaaaaagctgatcggcttcttgtttgactggttcggctacctcatgcgatgctcttaaggcagaaagagccagcttgatggattgcatttcgccagatgtgactgcgcttccttgttcaaacgctttaatgaacgcaacctcgtcccttgcgccgattgccgttttcactttggataagaaagaaagaacatctgccttatccgccaaatggggtgctgtctgctgaacagcctttaaaaagacttcggcttcctgatctgtgacttgtgccgcctgtaaaacagctgaagctgcaagtgacttactatcacccgatgaagcagccgctttaatccaatttgctgcttctttcacaatttggagactgtttttttcagcagattccgtcagcttcaccagcagctggcgggcttctttaattggaatgtctgctgctgttttaacaggctcttcttgtatgcttccctgttctgctgtgtgatttgcaatcggcaggctggcttttccgggggagccagctggtgtgctaagctccctgcttccagctgtattcgtcggagaaggtgctttcgtattgtcggttaaagaaataagcttatcaatcagccgttctgcatggacatcgatttcactatttaaaagcaccgtgactgcttcctttagctttgacatcatttggctctgctgagggttttggtcgattgcctgtagcagctgggatacgtgctgatgcaacggaacaggcgatttcacagcgtgaacaccattcaaaatctcggagtgaatgggaagatcacgctttaaagcgaagagaaccgtttcaactgctttttttgtgtcttgcgaaggcagcgtgtccatccagcggacagctgttttgatatcattttctgttacgggtgttttgcttttcagcatcgctcctgtcatcatgagagctgcgtttgacgtcttcactgaaatagcatttaaaagtttgccagctgcatcctgaatggttttaggattttgatcaaagctttgaacgacctgaagacggcctgtttgctctgccgtttttttttcgtaggaaaaccaatagtatgcctgaggacgaagctgagtttcaagttttccctgaacagtttgattgccgacttggatcagggcatgctgatctcctagtaaacgaagcacttttcctaagaggagacgcttctccccgtttagcgcttcgtttacttttgatgtttcctgcgggacggctgtacgcccgaaaaggtgctgcagcgccttttgcacatcatttcgtatgttcattttaaaaaggtgcctccttgtccatggtgatttatctgaaagattgaacaggagcgaaagttttgcggtgcaattcagttgggccgtatgcagcgagagcttccaaatgttcttttgtcccatagcctttatttttttcaaagccgtacatgggatacgtttcggcataagcgctcatcattcggtccctcgtcacttttgcgatacacgcacctgccgcaatagacacgcttttggcatcgccttttataattgacgcctgagccgtgtcgagcggaagtgtcattgcgtcaacaagcaaataatcaggtgtatccgacaaatcctgtatcgctttcaccattgccatttttgaagcttcatatatattgatctcatcaatcacagtagcttctacaattcctatcccgaccgccagtgcttccttcataataagctcgtaatattcctcgcgttttttctctgaaagctttttggagtctgtcagcccaagtatttcacattcctctggaaggatgactgcgctggcgacaactggtcctgccaatggcccccggccgacctcgtcaacacctgcaatcaagcgaaatcctttgtttcttgccagcctttcataggaagtcatattcacccattgttctttcagcgctttttctttcgcttgctttttaagccattgctctacaagcgtttgaacgctttttctcgggtcgttttcgcattgggcaataaatgggtcttgtgcatccttcacttcctgcaaacggtctttaatgtcctttacggttaatgtattcactttctcttctcccttactgtatgtatcggttcagccaagaaaaaataaagacccgcatttctgcgcgcctttacatcgtcggctgttcaaatgacagcctgccgaacttttcagtgcgaatatcgcgaatgatgacttcagtcgtcttatcgtagttgatgagcccaccgctcatgagacagccccgcttttcacctattgcatcaaacagctcggcaatgtcctctgggatctcatcaaggccataacgctctttaagccgttctgggtaatgttcttcgagaaaacgaagaccaaacacggccacgtcctgcaaattgataatcgagtctttaatagccccggtgactgccagtctcaaaccgacaagctcatcctcaaatttaggccacaaaattcccggtgtatctaatagctctaattctttcccaactttgacccactgttgagaagtcgtaataccaggtctgtctcccgtttttgctatgtttttctttgcaagccggttgatgagcgttgattttccgacgtttggaatgccgataatcaaagcgcgaatcgctctcggcttcacacctttcgcacgcatccggtcaaatttttcttggaggatctcttttgatgcaggcacaatttgatttaacccttgtccatttacagaattaatagacagagagcggatcccctggttctcaaagtgctctttccactgctgtgtaactgccgcatctgctttgtcagccttgtttaacagcataattcgcggcttgttttttagaatatcttcaatcattgggtttcttgatgacattggaattctggcatctaccaattcatatacgatatcgattaattttaatttttcggttacttcccttcttgcttttgccatatggcccgggaaccattgaattgtcatgtgacacgaacaccgcctttatcttcagtatgcatgattcattgttgtcctttatgtattttacgatgcctgtccggcattttcaaattctgtataaaaaaagagcttgttacaggtaacaagctcttttcgttcgttatcattatcgtctgatctctttaatacgagccgcttttccgcgaagttcacgcaggtagtaaagtttagcacggcgtactttaccgtaacgtacaacttcgattttcgcgatttttggtgtgtgtactgggaaagtacgttcaacgccaacaccgtaagaaatcttacgaactgtgaacgtttcgctgattccaccaccacgacgcttaatcacaacaccttcaaagatctggatacgctcacggttaccctcaacaactttaacgtgtacacgtaaagtgtcaccaggacggaacgcaggaagatcagtacgaagctgttcttttgtgatatcttcaattagtttttgcatcgttttcaactccttccaacagatgctcttggccacaaaaaccggcacagcggaacatcgttttcaagcttgcagcggataagcccgcttaagccacaagtagtatcttatcacaatttcatagcctatgcaataaaatctattctttttcccattcagaaatccactttctttgctgctctgtaagcgggtagtctttcaacagatccggacgtcttaggtaggtccttctgatcgattctttattccgccattcttcaatttttgcatggtttcctgacaagagtgtttcaggcacttttaaacctttgtaatctgccggtcttgtataatgcgggtgctctaaaagtccggtgctgaaggaatcctcaatatgggaagcctctttacccagtacacccggaagcagtctgaccacactgtctgcgatcatcattgcagggagctcaccgcccgtcagaacaaagtcgccaattgatatttcatccgttaccaagtgctcgcgaatgcgttcatcatagccttcatagtggccgcaaatgaacagcaaatgctcttccttagctaattgttcggcttttttttgggtaaaacgctcaccttgcgggcatacgaggataatacgcggagcagcggctgcctttgatgtcaggtcctcgaccgcgtcaaaaacaggctggggcttgagaaccatgcctgccccgccgccataaggataatcatcaacagtattgtgcttgttatcagagtactctcggaaatttacgacttgaaactgcaccgcatctttttcctgggctttttgaagaatcgatgagccgagcacgccttcaaacatttcgggaaacagcgtcaaaaaatcgattttcattcgtctattaacccttccatgagttcaatctcaattttcttttccctgacatcgatatgtttaaccactgattcaatgtaaggaatgagtgcgtcttttttccttttcgtccgatgacccaaacgtcattggctccaggcgtcaaaatttctttgacctttccgatgagttcgccttcttcagtaaatacttcacacccaataatttcgtggaaataaaattcaccctcattcagctctcctaattcttcttcaggaactttaatgattgcgtttttcagctcttctacttcatttaggttttgtctttctttaaactgcaggagatgaaattgcttatgcagtctatgtgtgtttaccgttacctccactggttcgttacggccgtccataaacaaatacagcgtgtttcccggcttgtatcgttcttcggcaaaatctgtttttgaaatcacccgcacttcgcctttgattccgtgggtatttacgattttgcctacattaaaccatcgctttgtcatatgatcacctctggcgaatttcaattacttttccgtcttttatgacgatggtgttcgctgctgttttctcatgccagtcatccccggcttcaatcgtcagcagcgcatcgacttccttttctttcaactcactgccaagcggcaatgtatgtacttgagcaatttgaaaatcaatgatttttatatcatcttttcgcttttctattgcctttttaaattgttcaatcatattagggttttgctgttctttctcatgttttctaagctgaaaatagagctggctgcattctcgttcaagcatttgtttcttctcagcaaaagaagctaaaagcttttctttactgcgctcggttaagacttgcataacggctacacggtgaataatttgcatcgcaccaagctccccgcttttaaaacttttactcgtccaggcttttctattttgcctaagcttctatcagtttaccctttttttgcgtgtaaaaaaaggggaggtgccggccctctcccttttagtcaaatatttcaaattgaactttcttagaagactgtacgccagctgcaaatacagctgttcgaatcgcttttgcagtccggccttgctttccgataactttaccggtatctgacttatggacagataagcgcagcgcaatcttttgatcggtttcttctcttatgacgcgaatgtcatctggatgatcaacaagcggcgtcacaatgtggacaatcaaatcttccaagtgttgatcagtcattacttgccttgtttagcgttgtggaatttttccatgattccttggctagagaacaagttgcgaactgtatcagatggtttcgctccagtttgaagccatttaagagcaagctcttcgtcaatttttacttccgctggttttgcaaccgggttgtaagttccgactgtttcgatgaaacggccgtcacgtggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtagcttaaacccttttttcttgccttttgacatgtttgtcatctgcttcatcatttttttcatttcatcaaactgcttaagcagacggttgacttcctgtacggatgtcccgcttccttttgcaatccgcttccgccggctggcattgataatatccggctgttctttttcaagaacagtcattgatttgatgattgcttccacatgattcagctgtttttcatcaacttggatgtttttcaggcccttcattttacctgcacccggcatcatttgcagaagctcatcaagcggccccatgtttctgacttgcccgagctgctccagaaaatcgtccaatgtgaagctcatcgttctcattttttgttccagctctttggctttgtcttcatcaacgctggcctgtgctttttcaatcaatgtcagcacgtcgcccatgccgagaatccttgatgccatgcgttcaggatggaacggctctaacgcatcaagcttttcgcccaaacctgcaaacttaattggcgtgtttgtgacagcgcgaatagaaagcgcagccccgccgcgtgtgtctccatccagcttagtcaacacaacaccggttaaaccgagctgttcattaaagcttttggcaacattcacagcgtcctgaccggtcattgaatcgacaaccaggaaaatttcttccggattcgcgatttctttgacgttggtcagttcatccatcagttcatggtcgatatgcaagcgccctgccgtatccaaaatgacgtagtcataatgttcttccttggctttctcaatagcctgtttagctatttctacaggactgacctgatcgccaagagagaaaacaggcatatcaagctgtttgccgagtgtttccagctgcttaattgcggctgggcggtaaatatcggcagcaaccagcatcggtttgcgattatgctttttgcgcagcagattcgcaagcttaccgcttgttgtcgttttaccggcaccttggagaccgaccatcataataacagtcggcggcctttttgcgacggcgattttgctctcttcgccgcccatcagctcagtcagttcctcttgaacaactttaatgacctgctggccgggcgtcagacttttcatgacgtcttggcctacagcgcgttcacttacttttttgacaaaatccttgactactttaaagttaacgtcagcctcaagcagcgcaagacggacctcacgcatcatctcttttacatcttgttcgctgactttcccttttccgcggattttagaaatcgtctgctgcagtcggtcggctaatccttcaaatgccatagtttgccgcctcctaatctaatttctcaagcgcttcaatcagagctgtaatttcttcctcttcttttgaaccggaagcaagctccttcagcttattaaacatctctttacgctcctgaaactttttcaaaaggagcagcttttcttcatattgttcaagcattgcttctgttcgtttgatgttatcataaacagcttgtcttgaaacctcatattcttcggctatttcgcctagggagaaatcgtccaaataataaagcgacatatagctcttctgttttgacgtcaacaacgactgataaaaatcaaacagataattcattctcgttgtcttttcgagtgacatttgagctctcccctttgttaagtcaaatccctttacgataacttagtttacacggttttaatgacactgtcaagtttttatcttgtcaaagcggcgattaacttttccaaaatacgctaaatatcatccaatttattccgatattgtatatgaaccctattttaaggaggatttttatgaaaaaaatcggtttattgtttatgttatgtctggcagccctgtttacaataggtttcccggcacagcaagcagacgctgctgaggcaccttataaggcctcaatcacaaatatcagcacagatggaggggtatacggtaaaatcaattacggacaaggtcaatattggcgagtcaagtacaatattacagtaagcggcaaattactcgaccaaaacggacagccagtgccaaacgcgcccgtaagatttgaagcggacacgaaggtcggaaacacaacacaaactgcttcaggaacgactgatgcaaacggaacatttgaggttccaatgtatttggggccagctgctggttactatacgtattacacatctgtttccgttcattactatgacatcatcccattcagagttttttctggtgagtcaagactggtatccactgataacagcctttatcatttcgcctatcaagtaagaagataaaaaagaaaaaggccccaagatgttggggcctttttcttaatcgtcggctttttccactaaatctgaaaagagtccgtacacataggattctggatcaaattcctgaaggtcatcaactttttctcctaaaccgactagtttaaccgggatgtgaagctcgttgcgaatcgcaaggacgataccgccttttgccgtaccgtcaagcttcgttaaagcaatgccggtaacatttgttgctttagagaattcttttgcctgagccattgcattttggccggtcgtggcatcaagggcaagcagcacctcatgcggagcttcaggaacttctctttcgataacacgttttactttttcaagctctttcatgagatttactttgttttggagacgccctgccgtatcacaaattaatacatcggcatttcttgctttcgcagcatgaacagcatcgtagatgacagccgccggatcgcttcctgccgtctgcttaatgacaggcactcctgtacgctctccccatacttccagctgttcaatggctcccgctctaaaagtgtctccggcggcaagtacaacagattttccttcttgtttcattttatgagcaagctttccgatcgttgttgttttcccgacgccgtttacacctaccagaaggattacgtttaaacgcccatcctggatgttcagttctgaaatttgctcatctccgctgttataaatctcgaccagtttctcagaaatcactgactggacttcctttggatcttgaatatttctgcgtttgacttcttttttcagctcatctattaattccataacggttgtaaaaccgacatccgcgctgataagaacctcttcaagctcttcgaagaaatcctcatccactttacggtaacgggatacaagatcattcactttgttttgaaaggagtttcttgttttttcaaggccatccttaaacttttcagatacggaatctgtctgttttgtgattttctcttttaattttttaaaaaagctcatcttttaacctctttcctcgttactgaacgaattcttttgtttcttccagcttaactgaaattaccttggaaacaccggattcctgcatggttacgccataaagcacatccgcttcctccatcgttccttttctgtgggtaatcacaataaactgagtatcgctgctgtatttttttaaatactgcgcaaatcggaacacattcgcttcgtcgagcgcagcctctacttcgtcaaggacgcaaaacggcactggacgaacctttaggattgagaataagagcgctatagcagtaagcgcacgctctccgcctgacaggaggtttaagttttgcagctttttccccggcggctgagcgataatctcgactcctgaatgaagcagatcgttaggatcggtgagcctcagttcagctcgccctcctccgaataaggagcggaaaacttgatcaaagtgtgagcggatttggacgaatgtgtcgttaaagcgcttcgtcatttcttcatccatttcttcaatcacttggaacaaggtatttttcgcttctgttaaatcttctttttgttccgacagaaacttgtaccgttcgttgaccctctcaaactcatctatgcttccgaggttcacggtacccagctcttcaattgcgagtttaatcagcttcacgcgctttctggcttcctctggatcagtttcaagctgatatttctcttttgccccctcaaaggacaagctgtattcctcccgtaagtattggagtaaattatcaagctcgacttccattcgtccaagtttgacttcttcgtcttttaagagcgttgttttttgtttatacaggcgtttcatttctttcagctcacgctcatacgtatcaagcccatgctgaagcttgatgcgctgatcgcgccttaatgcaatcagttcgatcgttttcgttttgtcattcaatttatgttttgctgcttcttccagcttttcttcgccgctggtgctagatgacatctctgacgttaagaagcttaagtcttcttttgcttcttttaacgcaagctctgtttcagtgagctctttctttaatctggcaaggttgtcctcttcccccttgcaagcctgctcttttttggccgctgcgatcttcagctcagtcagctcgttggagagagactctttcgttgaggattgcgtttgtttttgttttgtcagtctgtctatgtcctcttcaagctgtttcatcttttcagatacggcagagagctcttcttcaagcttgcgtttgcgcacttttctctcttcatcgctttctgacagagcagatttttcttgatcatagagctctaaatgggtattgatatttttctcggcaacttgaagttcgtacagctggcctttcacatcctgctgctttaaccttaagccttccccggtttctcttaagtcagccagttttttctccatatcctgaatggagtgcttaagggttttgacctcttgttcaagcagtgccgttttctcttccatttcagcgagccgtttcgtcacatcttctagctcccggcttcttccaaggagggagttatttttctttttaaccgcgccgcccgtcattgaaccaccggggttcacaacatctccctcaagggttacgatgcggtaccggtgcccgagaagcttcgcaagctcgtttgcaccctttaagtcctctgtgatcagaacggttccaagaagattctggatgacgcttcgatacgcaggatcaaatgtgacaagttcactggcaaccccgagaaatgatgaatgccgggcggctgtttccgcgtcacggctttgaagctggcggtctctaataacagaaagaggcagaaacgtcgcccggccgaaggaattctgctttaaatattgaatcgctttgcgggcagattgttcatcgtcggtcacgacgtgttgagcagaagcgccgagcgctatttcaatggccgtttcatacttctgttctgtagaaatcagctcaagaaccgctccgcgaattccgccaaggcgctctttcgctttcagcacttctttaacaccttgataaaagccggagaaatctccctgcatcgtctcaagcatgtccttttttgatctcgcttgctgaacgtattggtatgcctgatacagagcggattcatttttttcgtattggcgctttttctgctcatattttgtctgcatatcacgatatgcaccgacttgactgtgaatctcctgctcaattcgggcaaattccgtttcacatgcggctttacgcgcagaaatatcatgccgttcctgcaggtgcttttcattgttgtccgcaagtctctgcaatgtgacagcggattgggacatctggtcatcaagaagctggagttcgttgcgtatcgaagcctggctgtttaacagctcaaaataatcacttttcagctgctcgattttctcttcgacattttcattgtgaagactgagagcctgctgtttttcttttacttgcgcccttaactgcttcacctcagcctgaagcgtttcgaagacagcttcctgcttcgaaagctcttctttcagaaccgtttctttttgctggaactgaacgatggcttcttcaagctgttcttggttttgcacagcgtttttctttcgttctttcaggacttctttacggccttcaagcttttccagctcttcactagttaccagtaaaacttgctggagctcatctactgactcatcaagcgcttgtattttgtcccttgtatcctcaatctttgcttctttcgcagaaatagcagacgattcagcaagctcttcttcttttgccatctgcactttctctttaagagtcgaccatttaccatgcagctcttcgatatcataggcagtcagcgcaatttcaacatgctccagctctttctttttctcaaggtagtctttcgctattgaagcttgaattttaagaggttcaacctgtccttcaagctcatgtaatatatcttctacccgatttagattgtcctgtgtctcaaacagtttattttctgcttttttctttctcgttttatatttaagcaccccggccgcttcttcaaagatactgcggcgatcctccgctttgctgctcaggatctcttccactttcccttggctgataatagaaaatgcttctttaccaagcccagagtccataaataaatcaataatatctttcaagcggcatggctgattgttaatcagaaactcactctcacctgatctgtacacacgtcttgtgacactcacctcgtggaagtcaattggcaagaaatgatcatcattatcaagagtaagcgtaacttcagctagatttaatcgctttcttgaatcactcccagcaaaaatgatgtcttccatttttccgccgcgaagagagcgtgccgattgttcgccgagaacccagcgaatggcatccgtgatgttgctttttccgcttccgttcggcccgacaactgctgtcacgcctttaacgaagtctacggaaatccgttctgcaaatgatttaaatcctataacgtctaaacgtttgaggaacatagcgatcctccttatgtaataagtatttcaattctatcataaacattggtcaaataagacggcatacatactgaaatccccctgagtcataagggggattttattgtttcgtatggtgtttttgcaatttagctaaagcttcctgagcagcgtgctgttcggcttctttctttgaacggccgtttccgactccgagtggttcaccttttagagatacgatggcttcaaattcacggttgtgcgcaggtcctttttcgttggagattttatactccagagagcctttgccgtcccgctgcacgtattcctgcagctggcttttgaaatccatcacatgagaaaaagcaccatcgttaattttagggaacacataaacttttaagaaactttcgaccggctctaatccttggtcaaggtacaaggctccgataaatgcctcaaaaacatccgccaatagagcaggacgctttcttccgcctgtcatttcctcgcctttacccaacaggacaagatcgccgaatgacagctcgtgagccaatgaaacgagagacggttcgcaaacaattgcggctctcaatttcgtcaaatctccttcactcatagccgggtatttggcaaataagaatctggagatcgtcagttccaaaacagcgtcacctaaaaattcaagcctttcattatcttcatacggctttttccgatgctcattcacataagatgaatgtgtaaatgcttgatacaaaagcttttcattttgaaagtgaaccgaaatccgttcttgaaactctttaaattgttctacttttttatagaactttttttatctttataatgtgagtgttttgacatagtaacctccataggcacatcaggttcaccgcgcttctctgactaaaccggatacagcgcgcgtaaaagcggcatgctgtaataactgcacgaataaagggctaaagccccgcgtttcggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtctgcttcatcaacgccaaggcgatctacgatgattttcgttacacgctctaatgtgtctgccatagcaattcacctcccctcaagtattatagtggattcgtttttaaaaaactagagaaactacgatgaaattttcgagaaaaaacttacatcaccattccgccgtcaatatgaagcgtttggcctgtcatataacgagctccctctgaagctaggaacgtgacaacactgctgacatcgctaggttcaccaaagcgcgcgagcggaatttgtttcagcatttcgtcttgaacgtcttttgcaagtttatctgtcatatcagttgagataaatcctggcgctattgcgtttaccgtaatatttcggctggcgagctctttagcagaagatttggttaaaccgatgacgccggcttttgcagccacgtagttggcttgtccagggtttccgctgacgccgacgatagacgatacgttaataatgcggcctgaacgctgtttcatcatttgtcttgtaacagcttttgtgcagttgaaaacacccttcaggttaatgttaatgacgtcatcccattcgtcttctttcattctcatgatgagattgtctcttgtaattcccgcattattaaccagaatgtcaatcgtagaaaaaacagacaatgtttcttttatcatgttttgtacatcttcgggatttgatacatccgcttttacagcaattgcttttctgcccattgatttgatttcatctaccacttcatttgctttcgcttcattgccggagtagttcacgacaacatttgctccgctttttgccagatcaagggcgattgagcggccgattccgcgggatgcgccagtgacaatagccgttttatcattaagcattatcattctcctccttaagcgtttgaattgccagctcgatcgtttccggatctgatacagcaattgtttttaaccgtctattcacttttttcacaaggcctgaaagcacttttccgggaccgatttcaataaaagtcgtaacaccctctgcgatcagcttgttaatgctttcctcaaaacgaaccggagagtaaagctgctcaataagtttttctttgatatctgctttttcagtcatcacgtcagcagaaacatttgagatgaccggaacgtcagcgtcttttatgtcacaggcgtccaatacctctttcagcttttcagcagccggtttcatcagttcagaatggaacggaccgcttacttcaagcggaattgcgcgttttgcgccgttctcttttgccagttcagatgcaagctcaacccctttagctgttccggaaatgacgatttggccaggacagttgagattcgcaagctgtacaaggttgccttcctctgtgactttatcggttacttgctttaatgcttcagcatccatgccgagaatcgcagccattgctccttcgccagccggcaccgcttcattcataaactctccgcgctttctgacagtataaacagcatctttgaaagacagagcgccagccgcaaccagtgcagaatattcaccaaggctgtgtcctgctgtgaaatcaggtgtaatgccagattctttaaatttctcaagaacagcgatgcttgtcgtaagcaaagcaggctgcgcattgtatgtaagtgttaattcttcagcatccccctcaaaaataagcgagctgagttttgtttccaacgtttcatcggcttcatcaaacagacgctttgcagcaggcacctgctcataaagctcttttcccatgccgataaattgtgatccctgacccgggaataaaaatgcaatcttactcatgatgtaaaaacctccagactactcatctgttttttcttctttcacttcttcctgaatgagcgcagccacattttggctgaccatctctcttgcttgccgaatcgcatggaatacagcatttgaatctgaagagccgtgcgccttgatcacaggcgcttttaagccaaaaagacttgctccgccataattcgaatactccattttcattttcatttctttcaattttggtttcagcacagctgctgcaagcttggatgtcaaagtagacgtcattacgtctctcatcattttaaaaattgacaacgcagagccttccagcgttttgagtgtaacattcccggtaaagccgtctgttactacaacatccgccacatcatctaaaaggtctcgcgcttccacgtttccgataaaattgatgtttgctgtttcttttaaaatttgaaacgtctgcttcgtcagttcgtttccttttttatcttctgttccgacatttaaaagtccgactctcggtgaagtgacaccgcgcacttgctgagaataaacagaacccatgatggcatattgaacgaggtgctccggtttggcatcgacattggcgccgacatcaaggagaagaaatccgtctcccgaaacagtcggaagtgtcggagcaagcgccggacggtcaattcctttaattctcccgacaataaagagaccggctgtcattaatgcaccggtatttcccgctgaaatgcaggcgtcagctctgttttccgcaacctcctgcgccataagaaccatagatgagttcttttttcttcgcacggcacggaccggttcatccgtaggctcaatcacttcatctgcgtgcagcaccgtgatgcgatctgatgtagttgttaaatgtgattctatcgttgttttgtcaccgacaagtgtgatatggagatcatcaaatgcctctataccttttataactccgtcaataacagctttgggagcgtggtctcctcccattgcatctacagctattctcatgcatgctccacctttatgaatgttttgaacgatacatgtcaaagcgtccagaaaaaacaatttcttcgccaacgtagctgttcacttcgacaaccgttcttcctttttctttttcgacagccgtcactttcgcttttgctacgacacgttcaccctgctttacctgtcttgtaaagcggatgtctgcacttgcagtcagcgccagctcgtcatcaatgactgcaacggccaaagaattcgcctgtgcaaataaatggtgtcctctcgcaatctgattccggctgaacacgtgctcctgttttatttctaaaatggatatcgcctgatcatccagctcaaggtcaataatttctccgataacttcatcaagtgacagggacttcacttcgtcctcaagtgttttctctgccacgttcttaattctttctctcagttcaggtatggaaagctctaagcggtccaaacgtatcgtctggatgctcaccccgaatttacccgctagttcttcatctgtaataaagggggttgcttgaatcgtctgctgaagtaattcctggcgttctctcttatttcttctcatatctaaacaccatccggacaattaagactaggtactaatagtagtatataatttcatagattggaatgcaacgattgtttctggctgaacaccaaaaacttctgatactcagcttaatttttccccgtccattactccgctcttcagcaattcatctcttaacacagcgtattccggctccttccagaacgcgtcagaagccacaagattcgcagcatcctgccttgccgtttcaagcgctctgtaatcatgaaccatgtccgccactttaaattccggcattccgctttgttttttcccgaagaaatcaccgggacctctcagttccagatccttttcagacagctcgaaaccgtcattggtctccgacatgatcctcatccgttctttccctgtttctgattttggatcagccatcagaatacagaaagattgatgctcaccccgtccaacacggccgcgcagctggtgaagctgtgatagtccgaaacggtcggcgtcataaatcaccataattgttgcattcggaacatttacgccaacctccacaacagtggttgatacgagaatttgacagtgatttgcgctgaattctctcatgacctgatctttttcatcggaatgcagctttccatgcataaggccgacattccattttccccgaaaaatatcagaaagcatattgtacacgtcaatggcgttttgcacatcaagcttatctgattcttcaatcagcggacagatgatataagcctgcctgccttgctttaattctttttcgacaaatgccaaaatacgatcaagcatgtcatgttttacccaataggtttcaattcgctttcgtccagccggcatctcatcaatgacagatacatccatttcaccgaatactgtgatcgctaatgttcttgggattggagtggctgtcataaagagaacatcgggatcctgccctttgttccgaagctttttgcgctgctcaactccaaatctgtgctgttcatcagtaataacgagactcaacgccttaaactccacctcgtcttggattaaagcatgggttcctacaagaatatcaatctcacccgccgcaagacgctcaagcagttcttttcgccgctttcctttaacagagcttgtcaaaagagcaacgctgacgtcccatttttcaaatagcgaaacgagcgaatcagcatgctgctcggccagaatttctgtcggcaccatgagcgctccttggtatccggataggatcgcggcatacagtgcaatggcggcgactgccgtttttcctgatccaacgtccccttgaagaagacggttcattctgtatggagaagacatgtctgctgttatttcgcgaagaacgcgtgactgggcgtttgtgaggggaaacgggaggcttttgataaatctcatgagttcttcgtttgaaaaacgctgccgtatcccttgtgtctgctctctttccgcctttcggaacgcctgcattttcaactgaaacaacaaaaattcttcataaacaaaccgccgtctggcaagctttaatgcttcccttgtttcaggctggtgcattgcttttaacgcttgataatagtcaggcagtttatagctttttcttagcttttccggaagaggatcaggaagtgagtctgcatattgggtcagcgcctgctgaataaagcgcctcatcattttgacggtaacattttctttcacagaatacactggttcaatgcttttgtcttcttgatgcggcccgtttttcaactcctgaacagagatggtttggcggtgcttgtcccatttacctgaaaccgtcaccacagagccgagcgaaagcttcttcttcaaataaggccggttaaaacatacggctgtgattaaatagtggccgaccagaagcctgaatgtcagcctgtttcgtttttttccgtaataggtaagagaaggctctgaatgaaccttcccttcgactgtgactctttcatcatgctttacttcttctaaatccctcagctcgtagtcatcatagcgataagggaaataattcagaagatcagaaatgtcataaataccgagttcattcaatgttttttctgtttccggcccaatacccttaatgttagctatactagtttgctgatgttgtttcacgtgaacctagcgctcctccgaaaatttttttctctaattctcttcctgtcggtgttgccgctaaaccgccctggcctgtttctctaagtgcagttggcatcgtttggcctattttatacatggcatcgataacctcatcacatggaatacggcttgtaatgcccgccaatgccatatcagcagcaatcatcgcatttgacgcgcccatcgcattccgtttcacgcaaggcacctcaacaagccctgcaacagggtcgcacacgaggcctagcatattttttaatgtaatggccatggcttccgcgctttgttcgggtgttcctcctgccatttcaacaatagccgcagccgccatgcctgaagctgatccaacctctgcctgacatcctccggcggcgccggaaatgcttgcgttattggccacgacaaatccgaaagccccggctgtaaacaaaaagcggatcatttgttctcttgttggattcagcttttcttttacagcaaataacgtaccgggcaccacaccggcagaacctgcagtcggtgtcgcacagatggttcccatggctgcatttacttcatttgttgcaacggctttcgatacagcatctaaaatcagcgggccagacaggctttttcctgatcgaatataggcctgcaatttaacggcatctccgcctgttaagcccgtttggctcgtaactccctcgagtcctttctgaaccgccgcttccataacagacaggttatgatccatctgctgaaaaatgtcctcttttgttttttctgttacttccatctcttgagctatcatcacatcagagatcaatatttgtttttctttagtaatctcaattaattcttttacattacgaaacataactggctcctcctgacccttttcgctagtcagcaatctttgtcacttgaataatattcggcagcttcgacagctcgtcgagaatgtggtcgtcaatattttgatcgacctctattgtcatcagcgcaagctggccgatatctttccgggctacttccatatgtcctacgttgattgaaaatttcgccagaacattggcaacaccggcaattgtgccaaacttgtcattatgaacaactaatatggccggatgatttcctgacagccggagctcaaaaccattcaattctgtgatttcaatctttcctccgccaatcgaaatacccgtcagttccagctcacccttttcatcagaaatggtgatttttgctgtgttcgggtggaccgggactgcgtcttctacccgaaactctatatcaattcctttagcttctgcaatttgtatagcggttttaatccgttcatcgaatgtatcaaaatcaagcaatccgccgataatcgcgacatctgtgccgtggcccttatacgtttccgcaaacgagccgtaaaaagatacaatgatgcgctcaggctctctgccaaataaacttctggccactctcccgattctagcagctcccgctgtatgagagctggacggaccgatcataaccgggccgataatatcaaaaacgcttctgtatttcatgctattcctccttatgaaccagagcttattagcgctttgcttctagactaattgatcagatataaaatggcaagcgggcgcgttacagcgctgccgcacttaaaagcagacataagaatagaagggcaaattgcccttctattctgctgaaactatatacgaatacagaggctgtttcccattgtggatctcaacctcaatctcctcgtacttttcactgagaaacgcttcaagctgctcagcttcttcctgagacgcatcctcaccatatagaatggtcacgatttcatcatcttctccgatcatttctgacagcagcattttcgcggctgacagctgattttcagaagtgccgataatcgttccattcagaatgcccataaagtcgccttttttaatgtctttaccgtcaatatgagtatctctgactgagaacgtcacctgtccgctttttacttgctgaatggcgcttagcatattggcctcgttcgcttcagcttcttgatccgggttaaaagccagcagagctgacatcccttgcggaaccgttttagcaggaatgacaaaaacctgttcatccactacgctggccgcttggttagcagccatgataatgttggagttgttaggcaggataaataccgtatctgcatttacagacttcacggcatcaacaatatcctcagtgcttgggttcatggtctggccgccttcaatcacaacagaagcgccaatgcttttaaataggtctgcaattccttctcccatcgctacagtcacaatgccatacggctgttttgccggcggtgtttcgttgtctgcaggtttgctttcttgactgatgatagaggtatgctgttctctcatattttctatttttattttgatcaattcaccgtaatgctgggcgtagtttaacacgtttcccggctcttcagcatgaatatgaaccttcgccagcgattcatccgcaatcacaagcagagaatctccgaactggctgaggtcttgcctgaacgtgccttcgtcgaactctctttttgtctgatcaagcctaaccatcacttcggtacagaatccaaattcaatatcttcggtattcatcatgctttgcgcgctcttgtgatgctctgcgctgaccatgtcgtcaagtgacggaagaactgctttctgaggtacagtttcaccttttaatgaagcaaggaaaccttcatacacacagagcaggcctttgcccccgctatcgacaactcctacttcctttaggacaggtagcaattcaggggtgcggtttaaagacgcctctgcttcttctgtcactgcagtcatcagcgcagtgatatcggtttctttttctgctaagatcattgctttttttgcagcgtcttttgcaactgttaaaatggtgccctctacaggtttcatgacagctttatacgccatgtctacacctgcttgcagcgcagcggcaaactcaagtgcattaatttcttttttcgtttcaatgtttttgctaaatccgcggaacaattgggataggataactcctgaatttccgcgtgctcccatgagcagccctttagataacgcggagcccaccttcccgatatcatccgtatccatttgttcaacttctcttgctccggaagtcatcgacaggttcatatttgttcccgtatcaccgtccggcaccgggaacacgttcagtgcatcaactgcactggcgttttgagacagattctgcgctcccgcaagaatcatctcggcaaaggttctgccgtctaatgttctgatagacaatcctactcctcctaactacgggttcgtcactcgtacgccttggacataaatattgacagaatccactgccagtccgatggtttgatttactgtgtactttacttttgtttggacattatgtgccacttcagaaattttcgtgccgtagctgacaatgatatacatgtcgatatgtatctgttctccttcttggcgaacttggacacccctgctgaaattctctttccgaaggatttcagtcagtccgtctttaatctggtttttagaggccatgccgacaatgccgtaacagtcaaccgccgcgcctcctgcaaccatcgcgatgacttcattagatatatcaatctgtccgtacttcgttcttaattcaatggacacactagttcctccttcgaatgcatagagttacagctattctactatatggtttccattatgaaaagaccaggcaataatcgctggccgtacctctacatatactatagcgctgctgtttccgcaagatgtcaagtgaattttcttgaaagatgatgaaacaatagttgcaaacgttttttagctgtggtaaattatttaaagtatccatatcgaaagcatctaagattatatgaatgttaaaaagtagatgttttgtgcaagtgaggagggaaacaaatggcacgtaaatgcgttatcacaggtaaaaaaacaacagctgggaataaccgttctcacgcaatgaacgcttctaagcgcacttggggcgcgaatcttcaaaaggttcgtatccttgtgaacggaaaacctaaaaaagtatatgtatctgctcgagctttgaaatccggtaaagttgagcgtgtataacaaaatgaacgcctgccccgatatgtggcaggcgtttttatgtggtgaaagagggctttgaacccctgggcattaatcttttctaaatgagcccagcatcgcccggacaattcctcctaaaaacttcggcaatttaatggtgtaaaatttcatttttgtcccctcctataacgtcccgtaaccgccttgttcattgttttcagcaattgaatgaaagcacatgcttaatccgtgcttcttatcattattaatatgccttttgcaaacgaaaaagtacctcgtgaatgaatgagttcgttactaatacatagtgttgaaccgagcgtaatatgacaattatttagaggatatttaaaaccggtcagggtcagctcatgtatgtcttcggaaaacggtatgaaggagatatatcgcttattttcatccttctcaatatcatattcaccaggagggaacatttgaatatgattttgtttgtctatcagcctaatttttatgttcgtttttacacctttatacagaagctgaatgtttcctaaaaaatgatcagctctgccgcctgtaatgccgaaaatctgaataatatccggctgcttttccagcgcccaatcaagggcgaggtctaaatctgtttgatctttttctgcttgatacacatgaagggcgggagcggctttttctattcgccggcgttcttgctccgttatgctgtcaaaatctccgaaggcttcaacaggaatgatcccggcatctaagagagtgacggtgcctttgtcaacaccgatccaaagcgtgtgttcatccgtatagccggttagatcgggaatgagatttttcgggcctcccgcaacgatattaattgttttcatctctgattcctttctctgcatacaggaaaaagagcttaggctattgtatgcccagctcttttctaaagctgcttatttacttcctctgatttcagaaattgcttttttgcggtcagactggccataaacagctgaaccggcaacgagtaaatttgcgcccgcttcaatgacgagcggagcggtttctttgttgacgccgccgtctacttcaattaacagatcttttttcctttttcatccgccattcgcttaacctcttttattttaggaaggactgaatgaataaatttctgcccgccgaagcccgggttcaccgtcattaaaagaacaagatcaagatcgtcgaaaacatgttcgatgacttgtacaggggtatgcgggtttagaactactccggccttcactccttgctctttaatgagctggatggtacggtgcaggtgcggacatgcctcagcatgcacagacaggatatctgcgcctgctttcgcaaaagccgggatataacgatccggctcttctatcattaaatggacatcaagcggcagatccgttaccggccggaccgcttctacaatcagcggaccgattgtgatattcgggacaaaatggccgtccataacatcaatatgaatacaatcggctccgcctttttctacatctttaatctcattgcctaaagcggcaaaatcagcggaaagaatagatggtgcaacctttatcattatgctaatacctcggctttctgtctttaatctccgtcataaattcaacataatggtcatagcgatactgctttaattccccgtcttcaacagcttgtttcaccgcacatttcggctctttcagatgtaaacagcctctaaatttgcatgaagagcttttttctctgatatcagggaaggtatagcccagctcttcttcctcaatgtctgtaaattcaagcgagctgaatcccggtgtatctgcaaccaaacctccggacgtgtgaatcagctccacgtggcgggttgtgtgtttcccgcggcccaaatgctcggaaatctcgtttgttcttaatccgagctccggactgatcgcgttgagaagcgaggatttcccaacaccggactgaccggcaaataccgttgttttatcctgaaaatgcgggatgatgtccgctaaactatcttggtccttagaggaggtaaggtatacgtcataaccaatattccgatagtcttctgcataggcttgtatcgtatcttctgtatcttgatcttcaatcagatccattttagtaatgcatataatcggctgaatatcattggcctcaacgagaaccaggaagcggtcgagcaatgccgtgctgaaagaaggctgaaccgctgagaaaacaaggaccgcttgatcaacgttgcaaattggcggcctgataagctcgttggttctttctttaatttccattagatatccttctttgtcattttcagcttgatacacaacgtaatcaccgacaagaggggtaattttgttttttctgaaaatgcctcttcctctgcattgtattactttatctgaatcctctgattcatccagtacatagtaaaagccgcttagcgccttaataattttgccctcaggcatattttccctccttgttattcatctttcggatactcaatggttttgtagctgacaactttattgtttaccattacttgatagtaccctttttggcctggttcaatctttagttcgatcgttcgttcagtcggctcttttatcttaaattcttcgtaagtgtcagagatgctgtgatccgcatcgtcaaccgcgatttgcacttgaagctcgtccccttcattttctggttcgtaggggatcttgaccttttctttcactgttttcgcaggttttttctctggtccgagagagaatgtcacttcaacttcgtttcccggctttactgccgtacctgctgctggtttttgtttgacaacctgtccttctggaacatcatctgagtatgcttctttttctacaagcttcaatccgttgtcttccagatatccagacgctgcttctttactgtaggttttcaagtctctaagcgtaatgtcttcgggtccgatactgactgtaagtttgacttgatcttcactcgggaccagctcagtccctgctgaaggattttggtcaatgacagtgcccgcatttttctcgtcattcacttcatttactgttacatgattaaacccttggtccttcaacgctttttttgcttggtcgaccgtttggcctgtcacatcaccgatctccgtttttgcttttccggtgctcttataaagggtgaccgtggcgccttctttgactgtggtatccgctttaggatccgtttttaccatcaggccctcttcaattttttcatctgagatttccaacacctcggaatcaacctgtaaaccttctttttccaagagccctgcggctttttcgtattccattccggagacatcaggtattttgacatccttaggcatgaaaagcgacggaaaaacagtgacagcaagaattccagctgtgataaaaacgaggcatatcgtgagcaaaacccacggccacttttttcttttgccgttcttctttgttttgttttcttgtgcggttgtcacttcagcttctttttcgccagcagctttagcaagttcttcatctttaatgataggtatcgcttttgtcatttcttcatcttcttgaatcgtaaatctcttttcattgagtctgtcggcatcaaaagctgtttttatgtctgcttccatgtcttcagccgtttcgtagcgatgaaaaggatctttggcagttgccttgagtatgatgttttcaacgctttgggggaccgatggattccacctttttgccgaaggagtttccgcttgaagatgcttcaaggcgatgctgactgctgactctccatcaaacggaatacggccggttaaaagctcaaatagaacgattccaagcgcataaatatccgatttttttgtggctaagccgccccgggcctgttcaggtgataagtaatggaccgagcccagaactgaattggtatgggtgattgtggtcgaacttagtgccgtcgcaattccaaaatccgttactttgatatttcccatatgatcaatcaaaatgttatgcggcttgatgtctctgtgaacaatctggttttgatgggcatgagcgatggctgagacaatttgctccatgatgttcagcgcttctttagggtgaagcggcccatttgctgttatgtattctttaagcgtcatgccttcaacgtattccatgacaatataataaatatcatcttcctcgcccaaatcataaatgctgacaatattcgggtgatcgaggcttgatgcggattgggcttctctgcggaaacgtctgataaattcattgtcatttgcatagtcaaaccgcaggattttaattgcgacttcacggtctagaatgatatcctcagctaaatacacgttggccattcccccgccgcctatgacgcggagaatttggtaacgcccgctgatccgcttgccgattagcactgatcttcaccctcttcaacttgtaaagcaagctcaagcaaaactgctgtaatgttgtcttctccgccattctgattggctttgtccacaagcaggtttactttttcctgaggagctgaatcgctttgcaggatgtcttttaactcagtgccttccactttatttgtcagtccgtcagaacatagaagcagtttgtctccgggttctatatcaaaggaacgggtgtcaatactgactaactggtctgttccaagcgccttcgtcaacacattttttcgcggatgatgttcagcgtcttctctggaaatctctccagtgcgaaccagttcatttacaagcgaatggtcttctgtcacttgaacgaaatcatcgtcctgaagcaaatagcatctgctgtctccgatatgggcaacagaaaccgttttccccgtaaaaagtgcacatacaatcgtcgtccccatgccttggcattcttcgtgggcttgagcgtgatcgtatattttgctgtttaccgatagaatctgttcaatgagccatttttcacattccgagggcgcagttggaatcgtctctgcttcattccatttctcccccatggctttcacagccatcttgctcgcaacatctccagcaagatggccgcccatgccatcagcgacaaccgctaatataaattcatctttccccttgaatatccccgcatcatcttcattatgctggcggatttttcctgtatctgtttttaaggctgttaacaaccctcatcacctcgtctcgtcttgacgctccttcgcgcgaagctgaccgcaggctgcgtcaatgtcatgtccttgctctcttcggattgtgacatttactccgcgggatttcagcgttttttcaaaagcaaaaatctgatcacgcggtgtgcgcacatagtcccgttcaggcacgtagtttaccggaatcaagttcacgtggcatttgactccttccagcaagtcggcaagctcttcggcgtgttccacctggtcgtttacgcctccgaacagcccgtattcaaagctgatacggcgtcctgttttattaatataatatttaacggcttccattagatcaggcagtttatatgctctgttaatcggcatcaaacggcttctgatttctgtgttcggcgcgtgcagagaaattgcaaagttaatctgcatttgctgatcagcaaattcgtaaattttcgggatgattccactcgtagagaccgtaatatggcgagcaccgatattcaggcccttgtcatggttaatgattttcaagaaagcgagcatttcgttaaagttatcaaaaggttcgccgattcccatgatcacgacagagctgacgcgttcatccgtttcatcaagagctttttgcactttgactacttgagcgacaatttcccctgcttcaaggtttcgttttaagcctccaagcgttgacgcgcagaatgtgcagccaatacggcagccgacttgtgtcgttacacatacagaattgccatactcgtgtctcattaaaacggtttcgatggtataaccgtcatgaagctcaaacaaaaacttcatcgtaccgtcttgagaggtttgtttaacagccgttttcagcgttgttaacacaaagcgagtgtttaatttctcacgcagatcctttgagaggtttgtcatatcttcaaaagaagatacgcgtttttcatatagccattcaaagatctgggctgcacggaacggtttctctccattgtctgtcagccattgtttgatttcatctaattcaaaagaataaatagacggacgctctgtccgcaattcttttcttacttttgttttattaagttctgccattgcttatcccttctttctcatgctgcaaataaagaaaccatctgttccgaaataatgaggaaggatttgaagccttccatcccgaacaaagggtctcaccttttcaggcagccgcttttcaagagacaaatcgggttcaaaatcaggatgttcttgtataaacgcatgtattacttcatcattttctgtccggtccattgtacacgtactgtagacaagagtgccacctttttttactaatggtgcgatttccctcaagatcgacagctggatttcagctagacgggcgctgtcgtcaggttttttcgtgtatttcatgtccggctttcttctgataacaccgaaacctgagcacggggcatcgaccaatattcggtcaaactgttcgttttcaaacgtttcccccgcttttctagcatccattgtttccgcatgaatgattgtcaggccaagccgatctgccgcttctttgatcagcttcactttatgtttgtgaagatcaagcgacgtaacgctccccttgttcttcattaattctgcgatatgagccgactttccgccaggcgccgcacacgcgtcaagcactgtttcatctgacttaggatcaagggcgcgggcgacgagcatggagctctcatcctggatagaaacttcgccgttttggaagaaatgagttccggcaattgttccctttaagagcttcacagcatcttcagcgaggtcgcctttttcaacttcgattccctcagcagccatttggtcaagcagctcagctctgtctgctttcatttgattgacacgcagcgtctgtttcggcggaatgagatggatgcggcaaatcttttccgcagcttcaaatccatacgcatccgcccactctttcacaagccattccggatggcttgtttctgtcgccagccggcggacaggatcttcgatcgcgtcaaaggatggaacaccttcgcgctgaatagaacggagcacgccgttgacaaatgaagcaatgcctttgtgtccgcggattttagcaatctcaaccgcttcatgaatggctgccctgtctggaatcttctccaaatactccatttgatataaggataggcgaagaagctgaatcacccacggctttaccttttgaggcttattgataaacggtttaagcatataatcaagcgcgatcttattttgtaatgtaccatagacaagttcagtcaaaagccctctgttctgatcactcagttcatttgatttaatgaccgatttcagcagcaggttgctgtatgcctggttttgttctaatttgatcagcgcctcaagggcgatgtcacgaacactagtttttttcattgtttactcctaacacatcaccggcttcaacatgagcgcctcgcacaaagtcttcgcctttcattcgttttttgcctgccggctggagttcggttaataacagagccgtctcgttacctgtggcaacgataattccttccttttcaactgcaacgactgtgccgggctcagctgttgttggtgccgctatttttttcgacgcccatattttcaagttttgtccgtttagagtcgtataagcaacaggccatggatttaagccgcggatctggttgtaaagctcttcgcccgttctggaccagtcgagcagctcttgctctcttttaatgttaggcgcgtacgtcgctttctcttcatcctgcttttcaggtgatatgctgccggcaataacgtttggaaccgtttcagacaatagcttcgcgccagcaacgcttaatttatcgtgcagtgttccgacattgtcggtttcttcaatgtccacttccacttttgagatcatatcgcccgcatccaatttttctaccatatacataatggtaatcccggttttcttctttccctgcagaatggaataatggatcggagcaccgccgcgcagttccggcaaaagggatgcgtgaacgttaatgcagccgtattttggactgtcgagaagctctttaggcaaaatttgtccgaatgccgccgttacaatcaggtcaggctttaatgccagcactttttcaatttcttctgtcaatctgactttttccggctgaagaaccgggatgccgtggcgcaatgcctcttcctttaccggaggaggtgtcagtactttttttctgcccttcggacggtccggctgtgtgacgacccccactacttcatatccgtcctctatcagggttcttaaaacaggaactgaaaaatccggcgttcccataaatacgattctcgtcatcaaatcatccttccatatccgctagttcatcttctgtatagtatttacttattttagatgtaaacagcacaccgtctaagtggtccatttcatgctgcacggctcttgctaaaaagcctcgcgcttccagaatgaacggttttccctgacggttaaacgcacgcactttgacataatcggcacgtgtgacatcaccatagacgttaggaaagctcaagcatccttcaattccggtttgctcgccgcttttttctaaaatttcaggattaacgagatcaattctccctctgtcatccccgatttctacgacggccgctctttttaaaatgccgatttgcggcgctgccagtccgacaccatccatttcaagcatggtgtcgtacatatcatcaagcagtttttttagctttttatcaaaaacagtcacggtttccgcaggtgtttccaaaacctccgcaggatgtgtgacgaccttttttactgccaatttgttaccctccaagacgtgagatcttacatcatcatataaggattcatatcaattgaaatcattacatgtttttgttcaatttcgcgtttataatgttccagtatcttcttcaataaagcggataactgggtttcctgtttgtattttatcacgcattgatagcgatatctatctttgatcctggctatcggcgacgcgcttggtccgagaattttcgtgtcagctccgcagtttgctttcaaaaaatgagcgattttttcagctgtaaccgctgctttcgccacttcctcatgagaaacagtcacaagagccaaatagtagtatggcggataggattgctctctcctgtgcgccatttcatgctgatagaacgtttcataatcgtgtgttttcgtcagctggatactgtaatgagacggtgtatacgtttgaatgatgacatggccgggcttttcatgcctgcctgcccggccgctgacttgcgttaacagctgaaatgttttttcagccgatctgaaatcaggaatatgaagtgttgtatcagcacttaacactccgacaagcgtgacattcggaaaatcaagccctttcgcgatcatttgcgttccgagaagaatatccgcttttccttctccgaaagctgacagtaatttttcatgggcgcctttccgtgatgtcgtgtcaacatccatccgaatcactctcgcacttggcagcacttttgtcagctcttcctccactcgctgtgttcccgttccgaaaaagcggatatgctcgcttgcgcattcaggacaagtgtgcggaacaggctcttcatgtccgcaataatggcatttcagcctttggccgtaacgatgatacgtcatggaaatgtcgcagtgcgggcattgcgggacatagccgcaatccctgcacatcacaaaggaagagtagcccctcttatttaaaaacagcaccgcctgctcacccttggcaatcgtttcttcaagcttttccatcaattcaactgaaaacatcgagcgattgccgtttctaagctcctctctcatatcgacaagcgaaacctcgggcatcacccgatggttaacacggtgcttcagtgaaagaagctcgtatacgcccttttgcgctctagcatatgattctaatgtcggcgtagcactccctaatacaaccgggcagctgtgatgctcagcccgcttgattgccacctctttcgcatgatagcgcggcatttcttcctgtttataggaagactcgtgctcttcatcgatgattatcattccgagattttcaaacggagcaaaaatggcggatctggcaccgacgacaagccgtacttccttccggtggattttacgccactcgtcatatttttctcctgtggataaaccgctgtgcatgactgccacctgggagccgaagcggcccttgaagcggttgaccatttgcggcgtcagcgatatttccggtacgaggacgatggcttcttttcctttcgccagtactttttcaattgattgcagataaatttcggtttttccgcttcctgtcacgccgtgaaggaggaacactttatgctcatcgctgtccaatgtctcgcgtatgggctcgaaggcagccctctgttcgtctgtcagcggcaggggctctgtttttttgaacattttgtcctgatagggatctctgtaaacctcttcatagctttccttcaaaagccctttttggataagggttttgatggttgcagagctcgtgtccgtttttttgcacaattccgccgcaggaattttcacaccttccggctcagagatgagaaagtgaagaatcgcctgctgttttgctgcttggcgggacaatccctcagcctgcttagcaagctcttctttactcgcatttgcctgaatatgcctgaccatttttttattggttttttgcgcgactttatacgtcacgtcaatgtcccctttttgaacatgcctttgaatcagtttcagcgtctcatgatcgggtatatctgaatacagcagcgtctttgtttcagaaaacagccgttccacttgcggcggaagatcggctccgtgtgcaatttttaattctttttcatatttcgcctttaaggcggcaggcagcattgcttgaagcgccgttattttaaaagacagcgttttgtctgacagccatgatgacagaatcataagctcctctgtcagaacaggtgtaagatctaataaatcctctacttccttgacagattttcccgataggtcagatgcttctttgactgctgtcacaaacccttgaatcttacgggggccaaacggaacaatgacccgcatccccgttttgatcatgcccttcagatggtctgggattttataatcaaaaggcctgtctatatttttggtgctgacatcaacgatgacttctgcaaaattcatgagcgctctccggtttgttttgagagggctgcgatctcctgaaggatttcaaaagaaacatcgagcttagacataatcgggagttcgcgtttatgcccgtctttgaaaaagattgtcacgatattcgtatcagcaccaaaaccggccccatttgctttcacatcatttgccacaatcaaatcaaggtttttagcggcgagctttttacgtgcatagtgttcaatgtcttgtgtttcggcggcaaatccgaccaaaatctgctctttctttttctcgcccaattctttcaaaatatcgactgttcttttcagttctaaggtcatgccgccgtcttgttttttcattttatggtcaaatactgttttcggcgtaaaatcggctaccgcagctgttttaatgactatatcgcttgcgtcatacacagagagcacagcttcgcgcatatccgcagccgattgaacagggataaactcagcaaggcctttaggctgatcaagtgaaacaggcccagaaattaagattacccgtgcgccgagctgaacagcagcctccgccagtgcgtagcccattttgcccgtcgatttattggtaaaaaaccggacaggatcaatcgcttcccgcgttgggccggctgtaatgaccacatgcttgccttctaaaggagcggatgtttcttcagcaaaatgtttttcggccagctttacgatgttttccggctcttccaatctgccttttcctacgtaaccgcatgctaaatagccctcacttggctcaataaaacaataaccgtcctgataaagaacagaaatgtttcgtttgactgccgggtggtcatacatatgaacgttcattgccggcgcgatccaaacgggagccgttgctgccaacaatgttgtcgtcagcatatcatcagcgatgccgtttgccagttttccaatcacattagccgtagccggcgctacgataatcaagtcggcccagtctgcggcatcaatatgagaaatgacgcttggattttgttctttaaatgtatctgtatagacttcgtggcggctcaatgcctgaaatgtcagcggtgaaacgaatcggcaagcggattcagtcataatcactttgacatttgctcctgcctgaaccagcttgctcgttaacgcacaggctttataaacagcgatgcctccactcacgcaaagtaacacatttcgattgttaagcaatgaattctccccctctgcactttacaaaaccgcacggaaaaaaataacaacctacatgatataggttgctacttgtgctactattcgcggtcttccttttcaaacgaaagcaggcctgcatcaatttcttctaaagctttgcctacatatttgtgtgaaatcgtatgttcaatcatttggtcttttttgatttgcatttcacgggcacgtctcgcagaaacagtcaccagcgtatattttgaatctaatttattcattaaagaatcaattgacggatctaacattgattattcaacctccagcattttcttatatcttggtgcaacgcgttcacgcttcaaatgttcagcaagaacgattgctttgattttatcgcaagccgtttcgacattatcgttttcaacgacatagtcataagcatccatcatttcgatctcagcttttgcggctttcattcgattttcaatcagagcgtctgtttctgttcctcgtgtcacgattctgtttttcagttcagaaaggcttggaggcgcaaggaaaataaacaggccttccgggaaagcatttctcacttgaagagccccttgaacttcaatttctaaaaagacgtcttttccatcttgaagcgtctgttcaacataatcgactggcgtgccgtaataattgccgacatactctgcccattcaagcagcttgttgtccgcaatcatttgctcgaattcgtctcttgttttgaaaaaataatcgactccgttcacttcgccctctcttggacttcttgtggttactgaaatcgaatattcaaattttgtgtcttcctgcgaaaagatcgcttgtcgaaccgttcctttaccaactcctgagggacctgagagaacgattaataaccctctttctttcatgcggcaattacccctgcccttcatccataatttcttctttaacagaaagtctgtgtgcaactgtctcaggctggacggcagataagataatgtgatcactatccatgacgacaactgcacgggttcttcgtccgtatgtagcgtcaattagcattccgcggtctcttgcatcctgaatcatccgtttgattggcgcagactccgggctgacaatcgaaatcatccgattggcggagatgatattgccaaatccgatattaatcagtttaatcgtcatcttctacgttccccctgtaaaatagacgtctctagtttagcctagtaagaccgtctgtaaacaatacgcacagtcactattctatattttgcacttgttcttttattttttcaatagaacttttcatttcaacgacaagctttgtgatctgatgatcatttgcttttgagccgatcgtatttgcttcccgattgagctcctgaacaagaaagtcgagtttgcgcccgacagctccgccactagctaatatatcacgaaactgggcgaagtggctcttcagccttgtaatctcttcagtgatatcagagcggtctgcaaaaatagcgcattctgttacaagccggctctcgtctaatacgtcttcagtccattctttgattctggcatacagccgttcccggtaacgagatacgacatctgcagccagcaattcagtttctctcaccagctcttcaagctgatcaatatgcatcaggcagtctttcgctaagagcagcccctctttttcacgcatttcacagagaccttttaccgcttcttctgcagcatcgatgatcaacgcctccagcttgtcattttgcgtctgttcttcatgaacctggacgacatgatcaagcttaaagaaatccattacatcgggctctgcagacaattgataccgcttcttcatatctctcgcggctgcgacaaactcatcgagcagcggccaatcaatttcaagccttttctcaacaagcatatcgctgtcaacggatacgaaaagctcaattcttccgcgctgaatatgctgcagaatggtctgtttcagcttatcttcaaaatatagcaaaggccttggcaaacgagcgttcacttctttaaatctgtagttcacagatttaagttcaacgcttacagagagatcgtcttgtgttttgcttgcactgccgaagcctgtcatacttcgtatcattttaaaacacccaattcttccctgttctcataataaaagggcaatagacacgctattacccctaagattatatcatatgaatttattttttcttgttaaaagtgaccccgccagcaaaaaagtagggatggcggacataccgatgacgagcatccagtcccccggcgtgatggctacagtatggaaaatcggctgaagcggcggatagtagattactacaagcatcagcaaaatggatgacaataccgcgccgattaaatacaggttttgaaacggatttctagagaaaacagaagtttcgctgcggcagtcaaacacgtgaataagctgagcgagcaccaatgtggcaaacgcgatcgtctgggcataagccaagttttccggattgcggtggtacacaatgataaacgctaaaatagtggcaactccgattaaaaatcctctggaaacgaccttccatcctagcttgcgggcaaataccccttctttcggatgacggggcttgcgcttcatgacgtctccttccggctgatccatgccgagcgccattgccggcaatccgtccgtcaccaagttgacccacaaaatctgaatcggaaccagcggtaaaggaagggcaagcagcatcgcaaacagcatgacaaggatttctccgacgttagacgccaacaggtatctgataaacttcctgatattttcgtagatgttcctgccttcttttatcgctgatttaatcgtcgcaaaattatcatccacgagaacaagagatgatgcttctttggccacatctgtcccggtaatgcccatagagacgccgatatcagcctgtttaatggcaggagcatcattgacgccgtctcccgtcatcgccacaatatgcccgttctcctgataggcttttacgatttttagtttatgttcaggggaaacgcgggcaaatacatacacatcctccaccacatgagaaagctcttcttgagaaagttcattcagcatcttgccgtccatgattttgccgcttttcggaaggaggcgcaagtctttcgctatcgctttagcggtttctacatgatcacctgtaatcatgacggtcttaattcccgcttcacggcattctttaatcgcctgtctgacttccggccgcgggggatcaatgatacctgaaaggccaagcatggtcagatctttttccgcctgctccattgacggtgtttcgcctgcttttatcggcctgtaggcgaccgctatcgttctgagcgcctgtgatgccaaatgtcttaataccgcctctgtttctgcttttctttcatttgaaaaaagagccgctgagccatcataataaatacgggaagatcgctgcatgagtacatccggcgcaccttttgtaatgatatagcgctttctgtcttgattctctacgatgacagtcatcattttccgtgcggaatcaaacggaaattcttcaatcactctgtaattagattcaacaaactcctttgaaaaaccgccttttcttgccgcggtgagcagcgctccctctgtcggatctccgtcaagcacatattcgccgtctcttttctcaatattggagttgttacaaagcgctccgaacagaagcatctgctgaagcggcttatgttcattgacactgatctctttttcgtttagtgtgaagcttcctttcggttcatagccggcccctgccactctccatgttttccctccggaccagacatgcgtcactgtcattttgttttgggtcattgtccctgttttatctgagcaaatgatagacgcacacccaagcgtttcaacagcaggaagctttctaacaatggatttttgtttaatcatcctctgtacaccaagcgaaagcgccactgtcacaatcgccggcagcccctccggaatagcggctaccgctaacgagacacctgctaaaaacatactgtacagatcatgaccctgaataacaccgacagcaacgacaagtacggtcagaagcaatgcaacaacaatcaaaatcttcccgagctgctccagtcttctttgcagcggggttgacaatgtccctgccgattcaagcatgtcggcaattttccccatagccgtattcattcctgtcccgacgacaaccccgacaccgctgccgcgggtcacaatcgtacccataaatgccatattggtaatatcgccgagtgaaacatccggttttttcaatttatcagcatgcttcacaaccgggattgattccccggttagcgctgattcttctatttcaaggcttctcgcttcaacaattcgaacgtctgcgccaattctgtccccgctcgtaaatttcacaatatcacccggcaccagttccttagaaggaatctttgtccagcttccttccctgagtgccatgacgtgcggtgttgaaagctcttttaaagcctgaagagattgctcagcacgcctttcttgaaagaaaccgagtatgccattcacaaacacaatcgcaataatcgcaaccgcatctacatattcaccaagaaatcctgagattaacgttgccgccagaagcacaagcaccataaaatctttgaactgcgcgaaaaacaagagaagcgctgaagtttttttcccttcttgcagctcgtttggtccatgcttgtcaaggcgtttttttacctctttttctgttaatccttgtttcatggacgtattggttgcctctagtaaatctgtttgtcccatttcatgaaacttcattccgctcgtccactcccctgctctcttatagagatatcactctataagcatgcttattctgactcgtcccatttcatgctataattatcgaatgcaggaagaatgagagggtgtattgcatatgtcgtttgatggcatgtttacatacggaatgacacacgaacttaacgagaaaataatgggcggacgaattacaaaaatccatcagccatataagcacgatgtgattttccacatccgtgccaagggaaaaaccaaaaactattattatcggcacatccgagctattcacgggtgcatatcacggcacaagcttatgaaaatccaagcgaaccgccaatgttttgcatgttgctgagaaagcatatcgaaggcggattcattgagaaaattgaacaagcgggcttagaccgcattatgatttttcatatcaaaagccgaaacgaaattggcgatgaaaccgtacgaaagctttatgtagaaattatgggccgccacagcaatatcattttgactgacgcagcagaaaatgtgattatcgacggacttaagcatttatcaccgtcaatgaacagctaccgtacagtactgcccggccaagattataagcttccgcctgctcaggacaaaatatcgcctcttgaggcgtcagaagatgatattttgcgtcacctcagctttcaagaaggaaggcttgataaacaaattgtcgaccacttttcaggcgtgtctccgcttttcgccaaagaagcggttcacagagcaggccttgccaacaaagtcacactgccaaaagcgttgctggcactgtttgccgaagtgaaagagcaccgtttcattcccaacattacgactgtaaacggaaaggaatatttttatctgctggagctgactcatctaaagggcgaagcgcgccgttttgattcattaagcgaactgctcgaccgtttttatttcggaaaagctgaacgagaccgggttaagcaacaggctcaggatcttgagcgttttgttgtgaacgaacggaagaagaatgccaacaaaatcaaaaaattagagaaaaccctggagtattcggaaaacgcgaaggaatttcagctttacggagagcttttaaccgctaatttatatatgctgaaaaaaggtgataaacaggctgaggtcatcaattattatgatgaagaaagcccgacaatcacgattcctttaaacccgaacaaaacgccttctgaaaacgcacaggcctatttcacgaagtatcagaaagcgaaaaattcggtcgcagttgtcgaggagcaaatcaggctggcacaggaagagatcgaatattttgatcagctgattcagcagctttcgtccgcttctccccgggatatcagcgaaatcagggaagagcttgttgagggcaaatatttacgccctaagcagcaaaaaggccagaaaaagcaaaaaccgcacaatccggtgttagaaacatatgaatccacctcagggctgacaattttagtgggtaagaacaatcgtcaaaatgaatatttaacgacaagagtggcggccagagacgatatctggcttcacacgaaggacattcccggctcccacgttgtgatcagaagcagcgaacctgatgagcaaacaatcatggaagccgcgacaattgcagcttatttttcaaaagctaaagattcaagttcagtgcctgtagattatacaaaaatcaggcatgtcaaaaaaccaaacggcgcgaaacccggtttcgtcacttatgacagccagcataccgtctttgtcacgcctgatgctgatactgtcatcaagctcaaaaaaagctgagccgcataaagaaaagccagagcatttgtatgctctggcttatttctttcttctcatctgataaagcctgttcacttcagcaacaaaatcgccgtcaatcagcttatccacgttttcagcaagctctttcgtgtgctttggactggctccgcttgtagaaacagacacagtgacatgccctctttttacgattttcggcatatatacattgccaagctcagcgtcactgacacaattgacaagctgaaaaggcgaagcggattgggcaatttctttgttcactgccgcattatccgtcgcagcaataatgaagaaagcattgagataatcttctttttcaattgtccgtttttcccatttgatacgccgctcttctgccatttgcttgatttccggttccacatccggactgacaagcgttatatcagctccctcagaaatcaccgttttcagccttctgagagcgatgcttccgccccccgcaatcacaaccttcttcttttccaggctaatgtgcagcggaagcatatgaacctccatcaaaatcaaattgtccctcagaatttgccgcagtttctctcacacggttcaaaaatgcgtttttcacatgaggatgaaaaccgatataggaagagaggtagacgttcggattatgggcttttaatttctgaacctctcgttcgatttcattcatcagcatacccgtaaaaagcaaatatggaacgataaaggttgttatgccgtcatctttttcaagttctgaaaaaacctctttgtaattagggccgcatgctgtcaaaaagcacggaatgacttccttcactggaaccatttcctgaagaagattagcaattccggttacgtctcttttgacgtctggatctgaacttccccttccgatgagcaccactctggcattttcatacggaacacctatgtctttcattcggtgatatacagccttgactacttcttcgtcaatcccgatcggctttccgtatgaaatacggactgatggatatcgagatgcaacacggacaatttcttccggaatatcatgttttgcatgcgcagctgttaaaagaagcagaggcaccactgcgatatgagtggcaccttgcttcacacatgcttcaaatcctgtctcaattgtcggctcctgaagctctaaaaagctgatttcttgtactggcacagagatgtgggccttgcatccttccaaaaaggctgcggcttcttgctgcgcttttttgacccggctgccgtggccgacatataaaattgcttgtttcatttttacaacgcctcgcttaaatcttgtttttttagttcagattcaaaccattccagcttatagtgataatttacaacatttccaatgacaattaaactcggatttgtaatgttttcttttatcaccgtttctgaaagggtgtcaactgtacaaaaaacagatttttgcttgtccgttgtcccccaatgaataaaggctgctggcgtagaaccgtcccggccattttcaaggagttttctttcaatctgctgcacgtttttgatacccatatagatgacaagtgtatcaattcctgtagccagcgctttccacttttcctcaaaatcttcttcttttttatagtgacccgttacaaaagcgacgttagagcccgcatcccgatgggtaacaggaatcccggcataagcggctgccgcgattccagacgtaatgccgggaatgatttcaaacggaattccattttcagagaggcattccgcttcttcccctcctctcccgaacacaaaagggtctccgcctttcagtctgacaaccattttccctttttgcgcatacttcacaagaaatcgattgatggtttcctgcttcatcgtatgaaaatccggaagcttcccgcagtagatcaggtctgcttgctctttggcatattgtaaaatctctttatttactaatctgtcatataagatgacatcagctttttcaatggctttcagcgctttaattgtcagcagatcagggtcaccgggacccgctcctacaatatatactttccccatcgtatttcccccgatctattcgagttcttccagaagattcgctgtgatgatgttctcgcttgcattccggcatctgagaagaacgcagcagatcatattcagctcaatttttgtttaacaaactcgatcagctgatttttacacgcttcacggtcatgctgtcctgaatcaagaacgagctctggagcttccggttcttcataaggagaatcaattcctgtaaagaacggaatctcgccgtttcttgcttttttgtaaagccctttcggatctctttgttcacaaatatcaaggtcgcatttaatgtagacttcattaaattcgcccgcttccacaagctcgcgaacctgttgtctgtcctcgcggaaaggagagataaaagcagtaatcacaatggttccctgctgaacaaaaagcttcgccacctctccgatccggcggatgttttcttttcggtcttcatcagaaaaaccaagatccctatttaggccgtgacggatattatccccgtccagcacaatgacttggtagccttgctcaaacaattctctcgcagcggcgttggcaatggttgatttgcctgagccgcttaaccctgtcagccagagaatggagcttttatgcttgtttttttgctgatactcttcttttgtgatagaggcttcatgccatacaatatcgcgatttgtcactgccagtcctccttaagatacgcctacttcttcttttttcttcatccctttgattaacacttctactacttcttttcgactgaattcagcaggcggcagcacaccgtctctcagcatacctcttaccttagtgcctgataaaatgacgtgatgctctctgccatgagggcaagtttttgctgttcccatatttccgcattttttacagaagaagctgtgctcaaatttcagcggtgtaattccgagttcttcaggtttaaatgtgtcaaacagttcctgtgcttcgtatgttccgtaatagtcgcctacacctgcatgatcacggccgacgatgaaatgtgtgcagccgtagttctttctgacaagcgcgtggaaaattgcttctctcgggcctgcataacgcatcgccgctaaaaagacaccaaggaaaacacgatctttcgggtaataatgatcaagaagcacttggtagctttccatccgtacatcagctggaatgtcatcagattttgtttcacctactaacggattcaagaacaagccgtctactgtttcaagagccgttttttgaatgtattcatgcgctctgtgaacagggtttcttgtttggaaaccgacaatggtttcccagcctttttccgcaaactggcgtctcgtttctgacggttcaaatgtaaattcagggaactgttttgaagcttttttaatcaacgtaatcggtccgccgacatatgtattgccgcggctgaacagctttttaacaccaggatgctcctgttcatctgttttgtacacattgacagcttctttttgtttgtcaggcacgtacaggtcttcgatttggataacgccgtaagtttctccttcatacgttaactttaccgtttcaccaagtgacagttccgctgctttttgcgcatcgaccggaagcgtgattggaagagaccagacaacgccggaagaaagacgcatgttttcgaccactgatacgtaatctttttcattaaagaaaccttcaatcgggctgtatgcaccgataccgatcaattccaaatccgcgaaagaaattaaatcaagttcaatttctttttgaatgccgctcacatcatatgattcatctactctgtttactaatgttcctccgtgtggtgctaagctcataatatccatctcctcctagttaacttataaaattactcagattaatgatcagattcccccgccttgttcgtggactgagcgtctctctttacgaatggcctttgtcaggctgatggcaccgcccgccgctaaaagcacacttaccatgataaagatcgaataataatctgcttttaaaaacaaggatacaagcagataagaaatcgataaagataaaaacggcgatacgatccataccttcagcatcgtttgaacaacttgtttatggaacacgttcggaccgtttttcgccatgcctattccgataatagacgatgacgtgacttgcgccaagggcaccggcatcccaaatacagaactgatgatcaccagtcccgctcctgtaccggataagagaatgccttcccctttggagaacctcgtaattttcttcccgtttgtttctagcactcgccggcctaataacagtgcgccaagagcaacaaaagctcctccatacaaggttccttttccgacatcaagcacaccggcagctactaacgggccaacagcattcgccacgttattcatgccggcagagaatgcttcgaaaaatccggcaactaacaaaacaatgccgaggattttttgctttttagaagattttacttcaatcttaaaataacgaaacagcttagatacgaaataggtgaagccgaaagcgaacagcgggacaaaaacccaaaatgacacaatgatcagaagattgttcacaaacaatactttataagccactcccacgccgacaaccgcgccgactgttacttcacttgtcgacaaaggaatgccgagcagattagcagtaaagagcgacagggcagcagctccaataatgatgcaaacaatcgtcagtgtaatcgtctgctcaggaataatgccggagctgattgtttttacaacctcgcctccgccaatgaccgccccggcaaagacaccgactgcgcataggatcaaagcgtaagttttctttttgatggctccggagccgtaagcaacccccatcgaagctgcagcgccgcttgcaccaatattcatcgcgaaaaacaagctaaataaaatagcggctaattccattttgcagctccttattcatgcagtccgcattctgttttcgccataccattccatctgcctgagcgcaaatcttctgctgtaaaagcgggagaagtgcaaggcgcacagccaatacttggatagccttggtcatgaagcggattgtagtccagttcattccgggatgtatatctccaaatgtctttccaagtccaatggataagcgggcaaacttttactgacttgaatttttcatctttgtttaagaaattcgtattggcacggcttggcccttgatcacggcgcaggccggaaagccaggctggatgtcctgaaagcgcctctcttaaaggaacgacctttctaagatagcagcactgattcggctctctttcccatagtttgtcaccatgttcttcggcttgttcctcaagggtgagatctggttttttcaggatgatattaagacccggataacgctctttcactcgttcaattgtttcataggtttctttaaaatgaagtcctgtatcaagaaacacaatctctgcgtcttttttcactttataaattaagtcaatcagaacgattccctcaattccgaaactgcaggcataaacaagctgatcgccgtaatggccgtatgcccattttaaaactgacagcgctcctttataaggatcgtcttccggaaatgtaatcgttggttcttcccaattatcatacgttaacatttcttctttcctcctttcggagacaaacaaacagtagctttctgccggttgtcttttcccatgtaatgtgattcgcggctgctgatatacagatagcctttttacctcttaaaataaaaaactttcaatccggcggaaagaaagacaggaacagcatgcagcccttatctttcaaaatggaattcattttgctggaagtagcaccttacaaactatgcaggttgccgggcttcataggtccagtccctcagccgctcttgataagtttttagatttgtagtaaattttagcacaattctaacataagtcaacccgactttttttataggattaataaaaaaacaggcctcacagcctgttttcaagtacagcaaggctttgaagcctctttacatcatttgaatttattttttattttttaaaccaatcttttgactcgggatttcgtttccatgtttgcagcttttttagatcatctgaatgaatatttccgttttcaagcgcgacctctgtgagcgtatcataatcggttaatgagtagtatggcagttctgcctttgcgaaggcttcctccgctttaggaagtccgtacgtaaagattgagacgacaccaagcacttcacagccggccgcttgtaaagctgcacaagcttcaagcacgctgcctcctgtggaaattaagtcttcaatgacgactgttttttgcccttcttgcacagctccctcaatctgattgccttttccgtgcgccttcggcttgctcctcacataacacatcggaagattcaaatggtccgccgcaagagcagcatgaggaataccggcagttgctgttcccgcaatcatttcagcttcaggaaaatgctctttaacaagcttgctgatacctgaagcaacatcgtttctgacctctgggaaagatagcgtaaggcggttgtcacagtagatcggtgataaaatgccgcttgcccatgtgaacggctcgttcgggcgtaaaaatacagcttggatgtctaatagatgttttgcgatgatttgtttcaagatttgattccctcccattcaagtctgacagccttataggcttttaccgggtcttccgcttttgtaatcgagcgtcctactacaatcgctgatgaacctttctctcttgcaatggcaggcgtcgctacgcgaacttggtcattcgcagcgtcctctgacattctgatccccggagtgacagtcagaaatgaaggcgacaccgcttggtaaatggcttttgcttcatgaacagagcagaccactccatccagtccgctttcttccgcctgtttgctgtagtgcacaaccgtatcaatcagagacttttcgatcagcagttcatctttcatgatttgttcagatgtgcttgtcagctgggttaccgcgataagtgacggacgtttttttccagccggcgtaccttcttctaagccttcgagagctgcctgcatcatttttttgcccccggcagcatgaacattgacgaggtctactccaagactggcaaggcgcttcatcgctttgtttacagtagtcgggatgtcatgaagctttagatctaaaaatagctcgcagtttctttcttttagttgtttcacgatagatggcccttcttgataaaaaagctccatcccaacctttacaaataacggttcttgctgaaaaggcgctaagaacgcaagtgtttcttcagctgacgcaaaatcaagcgcgatgatgggcaggttgtttttcatgattccagctccttccgatgcattcttcaattgattgatagccgtattggagcaaaacagatgggagctgttcaataatctctggacatgcaaaaggattcacaaagtttgctgttccgacagcgactgcgcttgctcccgcgagaagaaattccagggcatcttcagccgtttgcacgcctcccattccgataatcgggatgttgaccatctggctgacttcatacaccatgcgaatggcaaccggcttcacagcagggcccgaaagtccccctgttttattcgctaatatcggtttgccggtttttaaatcgagtctcatgccgattagtgtgttgatcatcgtaagaccgtccgctcccgcttcctcgatcgctaatgcaatttctgtgatattagccacgttcggggatagcttcacataaacgggtacatccgaaacctctttcaccgcttttgtcaaatcggcagccatttcaggattcgtgccaaaagcgattccgcctgttttcacattcgggcaggaaatattcaattcaagagcatgaacattaggcgctttgctgatatgttctgcgacttcaacataatcatcgacttgagaacctgcgacattggcaatgatcggtgtatcaaactgctcaagccacggcagctcatgatgcaacacactatccagccccggattttggagaccgatcgcattgagcattccagcaccagtctcagctacccgcggcgtcggattcccaaagcgcggctcctttgtcgtagccttaatcatgatagctccaagacaagacaaatcataaaaacgtgaaaattcttttccaaaaccgaagcagcctgatgcaggaatgattgggtttttcaaatcaagtcccggcaatttcacctctagcattacagcgccacctcctgagctttaaatacaggcccgtcgagacatacttttacataggatgtctcactttcgtttgtatggcacacacacgcgaagcatgcgccgattccgcagcccattcgttcctccatggacagatatacttctttatgggcatattcctgttttaacgccttgagcatcggtgtcggcccgcagctgaggaggatatcaaactctagctttttccgtttaatcacatctgtgacaaatccggtttccccgtagcttccgtcagctgttgccacatacgtgtctccgtactgccggcattcttcctcgtaaaaaacatcctttgccgattggaatcctaaaacgtggatgacatttacccctttttcaatcaagcgtttcgacagctcttggagaggcggcacacctactccgcctcctaccagcaaagccgtctttccgggttgaacttcattaacaggaaagccatttcccaaaggcccgaggacatccacaagttctccctgctgcttcagtgacaagagtcttgtcccttccccatctacccgataaatgatggtgacttcatttttttcaaagttgacgtctgcgatgctgatcggccttctcaaaagaggcgtaaccgcttcgctcactttaagatgaaggaactgtccaggggttgtaaacccttggacaagctcccctttcagaaccatttgaaacacccggtctgcaatttgctggttagaacatactgtcaaatacgcttttttcatatagtgactgccgcctcctgatttgtgttgactgccggcatttgatcagcacggaatgtcatgctttccagcactcgcaatatcgcctctgccgtatctaaagatgttaggcaggcaacaccattttctactgattcacgtctgattctaaaaccgtctcttgccggctgctttccttttgtcagcgtattgatgacaaactgcgcttctccgtttctgatgacatcaagcaagttcgggccatcctgaccgatttttccgacgaccttcgctggaatggaagcttctttcaggtagcctgccgttccttccgtcgctaaaatgttgtagccgatcgcgtggaaccgcttagcaatggcaagcccttcttctttgtccttatcagctactgttaaaagcacggaaccgtagttcgggatttgaatacctgaagcgatcaaggctttgtagagcgccttttcaagtgtcgaatctttccccatgacttcacctgttgatttcatttcaggccctaacgtaatatccactcttctcagcttggcaaaggagaagaccggcgcttttacaaatacaccttgctgttcaggctgaaggccctctgtatagccaaacgcagccagcttttgaccaagaatgatttttgttgcgagattcgccattgggatacccgtaattttgcttaaaaacggtacggttctgcttgatctcggattcacttctagcacgtacacctcgccttgcgacaagacgaattgaatattgagcaaaccgacaatattcagccctttagccaatgcgatcgtgtattgttcaatttttttcttaatgtcctctgtgagagactgaggcggataaacagcgattgagtctccggagtgaacgcccgcacgttcaatgtgctccataattcccggaatgacgactgtttcaccgtcggatactgcatcgacttcaatttcttttccggtcaagtatctatcaattaatacagggtgctgtggattgattttgactgcatttttcatgtaatgaagcagttcctcttcatggtaaacaatctccatcgcccggccgccaagtacataggaagggcgtaccagtaccggataaccgatatcacttgcgatgcttaccgcctgattaactgatgtcgctgttttgccaagcggctgaggaacaccaagttctccaagcgcttgttcaaatttatcccggtcttcggcacggtctaaatcttctaatgaagttccaaggattttcactccgcgtgcagaaagctcgtcagcaaggttaatcgcagtttgtccgccaaattgtacgacaacgcccattggctgttcgaggtcaatgatgtgcatgacatcttcaatcgtaagcggttcaaaatacagcttgtctgagatgctgaagtctgttgaaacggtttccgggttgttgttgacaataatggcttcatagcctgcttgtttaattgcccatacagagtgaaccgtcgcatagtcgaactcgacaccctgaccgattcgaatcggacccgaaccaagcaccatcacacttttcttatctgtaacgacagattcattttcttcttcatatgtgctatagaagtatggcgtttctgactcaaattccgccgcgcatgtatctaccattttgaataccggcgcaatccccgcttgttttctcaagctgtaaagctcagattctttcattttccattcacggctgatgtactgatcagagaagccgagttcttttgcccgtctcagcacatctgtatcgcccgcattggccttcaattctttttcaaactgtacgattccgaacagcttatgcaagaagaagacatcgatagcggaaaattcatggaggtcttctaccgtgtagcctcttctgtacgcttcagctaagtagaataagcgttcatcaccggcctttttaattcgcttttcaagaagctcatctgaaatgtcagcggcgtccttcaattcaagatgatacacatccgcttccagtgatcgcactgccttcagcaatgactcttcaagcgtgcggccgattgccatgacctcacctgtcgctttcatttgcgtgccaagctttctgtttgctgattcaaacttatcaaacggccagcgcggaattttggatacgacatagtcaagagcaggttcaaatgctgcatatgtttttcctgtcaccgggttcatcatttcatctaatgaaagtccgactgcaattttagcagcgagctttgcaatcgggtaccccgttgcttttgatgcaagggcagatgaacggctgacacgcggatttacttcaataatgtaatattggaagctgtctggatctaaggcgagctggacattacatccgccttcgatcccaagcgcgcgaatcagttttaacgatacattccgcaagagctgatattcgcgatcgctgagcgtttggctcggcgcgacaacaatactgtctccagtatggattccaactggatcaatgttttccatgttacaaacgacaatggcgtgatcctggctgtctctcatgacttcatactcgatttctttatagccggcgatgcttttttcaagcagacattggtgtaccgggcttaatttcaagccgttctcaacgatttcttttagctctgtttcattcgagcagatgcctccgcctgttccgcctaatgtatatgccgggcggacaatgacagggaatccaatttgactgacgaatttttctgcttcttcaagggagtggataatctcactttcaggcaccggttcattcagttcattcattaatgttctgaacaagtcacggtcttcagcttgctgaatcgcagacagtttcgtgccaagcacttcgacgccgcattctgccaaaacgcctctttcagaaagctcaaccgcaagattcaaaccggtttggcctccgagtgtaggaagaatggcatccgggcgctcttttctgatgattcgtgtcaggaattcaggtgtgagcggttcgatgtaaacccggtcagccatttctgtatctgtcatgatcgttgcagggtttgagttgacaaggatgacttcatagccttcttctttcaaagcaagacaggcttgtgttcccgcatagtcaaattctgctgcttggccgatgatgatcggtccagatccgattactaaaattttgttaatgtctacgcgttttggcataccgcttccccttctttctctgttgtttcgatcatttcgatgaatctgtcaaatagatggttggcatcctcaggaccaggtgaggcttcgggatgatattgaaccgtaaatgccggcaatgttttatgcttcagcccttcaatcgtatcgtcgttaattgcgatatgcgtcacttccagttctgttttactgatagacgaaactgtatatccatggttttgagatgttaaggcaacttttcctgtagccagctcttttaccgggtggtttgagcccctgtggccgaatttcattttttcagtattcgccccgcacgccagcgcgaataattggtggccgagacatattccgaataatggcacttttccaagaacacctttaatcatttcaatcgcttcaggcacatccttcgggtctccaggtccgttagaaagcatgataccgtccggtttcagctgaagcacctcttccgctgtaatgttgtaaggcacaacgatgacgtcacatttccgtttgttcagctctcttagaatcccgtgtttcatgccgaagtcaaccaagacaatgcgtttgcctcttcccgggctcggatatgctgtttttgctgatacttgggatacttgatttcttggcaattccgtttcgttcagtcttttcagcactgcttcgatatcttcatcagatgaagcgaatgttccttttagcgcgcctgccgtgcggatcattcttgtcagcttccttgtatcaattccctggagtccgggaatgtttttcatttttaaatactcgtctaaggtgtatgctgaacgccagttggaaggcagctcacataattctttgatgatcagccctttgacaaaaggggtaatggattcaaaatcatcacggttaatgccgtaatttccgataagcgggtatgttaatgttacgatctgtccgcagtaagaaggatcagataaaatttcctgatagcctgtcatcccagtattaaaaacgacttctcccatgttgtgttctaagcttccgaaagcttctccctcgaataccgctccgttttccagtactaatcgtctcttcatttgacaagtctcccctcttcataagcaagcttccctgccgcaattgtagcgaccggccagccggtgcaactgatgccgttgaatggtgtattttttccttttgataaaaatgtctctttgtctataactgcttctttttctaaatcgattaacgtaatgtccgcagcttgccccgtttgtaatgttccatatgggagaccgaacgcttcgcatggcttgattgtcatgtagtcaatcagctgcttcagtgaccagctgccatttttgacaaagtgtgtgtaaagaagcgggaatgctgtttctaagccgacaattccgaatggcgccagcttcatttctgtgttcttctcttcttccgtatgcggtgcatggtctgttgcgataaaatcaattgttccgtctaaaagaccttcaattaaagcagctctgtcttctgggctgcggagcggaggattcattttatagtttgtgtccagccccgggatgtcctcatcacaaagcagcaaatgatgcggcgatacttctgctgtcactctgattcccgcttttttcgcatcgcgtacaactctgacagattcttttgtgctgatatggcatacatgataatggcagtttgccgcctcagccagcagcacatcgcgagcaatatgaaccgattcacacacagaaggaatgccgtttagcccgttcgctttggagaatgtcccctcatgtacgctccctccgtaaattaaggagttgtcctcgcaatgtgcaacaatcgctttgtcaattgcggctgcccgtttcatcgcttcatacatcattcctgctgtctgtataccaacgccgtcatctgtaaaagcaaatgccccggcttcttttaacgcttcaaagtttgtcatttcatcgccgatttgtctgatcgtaatggatgcatatggaagaactcttacgcatgatgtttctttaattctgttttgcacccattccatctgctcctttgtatcaggaaccggccgcgtattcggcattgctgctactgtagtatagccgccgcgcgccgctgcttttgccccggtttcaatagtttcttttttctctccgcccggctctctgaaatgcacgtggagatcaacaaacccaggtgaaacgagcaaaccttttgcatcaattaccgtttcattatccgttgcatcaagcttgccgattgcggtgatggtttctccagtcactcggatatccgcttgtgttttttcaccattttcgtttagtatccagccgtttttaatgagatatgacatacgctgcttctcctcttttcacattggtttgtaaggcacgctgtatcactgccattctgataaatacgccatttttcatttgcttgaagattcttgatttttcgctttctactaagctgtcatcaatctccactcctctgtttaccggagcaggatgcatgatgatcgcatgccgcttcatacgctcagcccgttctacggtcaagccgtatttgtttaaatagccttcctgactgacagcggactgatgtcgttcattttgaatgcgcagcagcatgacaacatcggaagactcaactgcttcatccattgagacatacgtgccgaatgtattttcttcatcctgccattccgaagggccggaaaataggacccgggcacccaatcttgtcaacacttccgcattcgaccttgccactctgctatgcttgatgtcgccgtgaatggagacggtaagccctttaaacgtattgaactcttcataaatcgtcattaaatcaagcagtgattgtgttggatgctggccgcacccgtctcccgcattcagaatcggaatgttcacctggctgacaagctcttcataatactcatcctcactgtgcctgatgacgcagacgtccacaccgattgattcaagcgtccggatcgtgtcatataaggtttcgcctttttgcacgcttgtgcttgttccatcaaggttaagcacattcatgcccagctttttttctgcgacctcaaagctgaaccgcgttctcgtgctcggttcgaaaaacaggtttgctgcaaactttcctgtaagctgattgtctgtttttccgcttttgagctcttgtgctgtttgaagcaaatctttgatttcctcagtgctaagttcactcatcgtcgttaaatgcttcatgttctttcccctctcttttcaacttaaggctgaaaaaaaaccccggtctaagatagactcggggtatggttaaatagagggcagcattgaagcttccttctcttcataacccttccaagcctctctggactttcattaaaaggttttaaatatgatgttgttcagatgtgtctgcctgctcttccttcgcctgcggaagaatcaggtttaagatgacaccgacaattgcggcaagcgccattcctgacacttggaatccgccctgagacacttggataaaagcgcctcctacaccgatgacaaggataactgatgtaataatgaggtttctgttgttttcataatcaattttgttgtcaatcagcattctcaggccgcttgaagcaatgattccgaacagcaggaaggagacgcctcccatgaccgctgacggcactgaactgatcagcgctgaaattttgccgataaagccgaagcaaagggcaatcactgccgcgcccccgatgacaaagacgctgaatactcttgtgatggccagcacgccaatgttttctccgtaagtcgttgtcggagggccgccgatcagggaagcgaggattgtcgccacactgtcacccataatagagcgatgaagacctggctttttaatgaagtcttgtccgacaaccttgctcagcaccatttggtggccgatatgctctgacattgtgacaaatgcgacaggaaccattgcggctgcgatgccgagcgtaactgacggtgaataatctttgaacggaatgataaattcaggcactgcaaaccatttcgcgtcaagcaccggctggaagttgacaatcccttgagtaagggcaaacaggtatccgccgatgattccgatcagaaccggaatcaggcttaaaaaccctcgtaagaaaatcgcacaaataatcgtaattgccagcgtaactcctgcgacactaaagtgctttaagctgtagaccaactcactcgcgttcggatcagcatacatcgccatgtttactgcagtgcttgccagtcccagcccgatgacgataataacaggccctacgactacaggcgggagaatcttcatcagccatcctgttccaagctgcctaatcaataaggcaatcagcccgtacaccagccctgcaagaaacgctccaaccattgccgctcccggcccgccggtcgcttttaccagaatgatcggagaaataaaggcgaaggatgaaccgagatacgccggaatttgtcctttggtaataagaaggtacgccagtgttccgatgccgcttgtcaccaacgccacagcaggactcattccgacgagcttcggaaccaaaatggttgagccaaacatggcaaacaaatgctgaaggctgaatgaaacccaagagaaaggtgtcgggacatccctgacccctaaatttacttttttcttactcatgatgatttccccctgattgttgactttcattttaggatgactcaatgactgtataaaaaaacctctttgcttttttacgcaaagaggcatacaaagacctgccgaatactttttgggcctttgttgtgcacctctttgcaacctctctggattgcccttaaaaaggtgatctattattcgttttcataaatggcgacgagatcgttttggtctacctcatcaagctgtaccataaccttttcagactttgatgtcgggatgtttttcccgatataatccgctcggatcggcagctcccggtgtcctctgtccacaagcactgcaagctgaatggaggaaggtctgcctacatcaacaagcgcatccattcctgctctgactgttcttccggtatacagaacatcatcaacgagaatgactttttgatctgtaatatctaccggaatatctgcaccttttacaagcggttcatcgttgcttgtttttttagaaagatcatctctgtaaagagtaatatcaatttcaccgactgtaacaggatttccctcaatctgttcaatgcgttccgcaaggcgttttgccaggtaaatccctcttgtcttaatgccgacaagaatgcagttattcattcctttattgcgttcgatcatttcgtgagcaatcctggtcagcgcccgtctaattgcctgttcgtcgagaatgacagctttttgattcaatgtgtgacacctcacagttcatatagaagaaaaaacccctcctgccagagcatagaggggttttaggacaaggtgcgcgcctatacacgcatcccgtctatccgttatccttctcagcctctctggactgttttaaagaatctattcagcttcgtttattatttcagaaaagaaaccctctgtcaaccgttttttctgaggttttcgattaattctgccatatcctcgggaagcggcgcttcaaattcgacatattctcctgttcgtggatggtcaaaacctaaaactcccgcgtgaagcgcttggccattaaagtcgattgtttttcttgggccgtatttcggatcgcctgctaatgggaatccgatatatttcatatgaacacgaatttgatgggttctccctgtttcaagctggcactccactaacgtaaaatcctgaaaacgctcaagcacatgaaaatgagtgacagcgtttttgccatcacgtgtcacagtcatgctttgacggtcttttttatcccgtccgatcggcgcgtcaattgtgccgtcatcatgagaaataagcccgtggacaaccgccgtatatttccgcgtgaccgttttgttgaccaattggtttacgagtgactcgtgcgccatatcatttttcgccaccattaataaaccggacgtgtccttatcgattctgtgaacaatacccgggcgcatcacaccatttattccggaaaggtctgtgcaatgagccataagaccgtttacaagtgtgcccgtaagatgcccgggtgctgggtgaacaaccattccgcgaggtttgttgacgaccagcacatcctggtcctcataataaatatccagatccataggctctgccaggacgtcgagcgcttccggttcaggtacagtgacggtcacctgatcacccggctgaattttataattcgctttcaccgcgcttccgttcacgacaacctgtccgtcttttacccattgctgaacctgggttcttgaccaatcattctcagtcgatgccaaaaatttatcaatccgctcacttttttgttcttctgaagcggttatatcaatttgattcatgctattgctcctttttctttttcccgctgtccaacagcatttgtataaataaaagcattacgccgacacatagtgaagagtccgcgatgttaaatatcgggtaattgtaattgacaataataacatggataaaatccacaacttcctgtctgacagcccgatcgataaagttgccgatggcaccgccaagcataagtccgagggcaacgccaagaagcctttgtccctttgtataacgctgtatgtaataaacaataccaataataacagcggttgttatgaggtagaaaaaccacatttgacccgctaatatcccccatgcagcacccgtattgcgatgggaggtgatatagaatacctgatcaatgatcggaatgctttggccaagttccatgttcttaacaactagccattttgtcaattgatcggctgcaataataagtagtgcaatcatataatacagcacaaacgttcctccagtttacggttactttaatccattatgcattttatcaataaaaagcactggagtaaagaaatatcaggcatattaaccggacagacactgttattcatacagtgcctgaccatattcgatatccgttgatttccatatcggaagcgtttttttctcaaattggacagaataaagaaaatcgtttgctgttcgggccgtcggcagcactgccagctttgcaagaggaatgggggccccagtttcttcacagtatccgaatgtgccgttttcgattttggacaatgcaaggagaacgtcttgaagttcttctttaatatgatagatcagagttgctttttgtttttgattgattgctgcttgcgggcttgtagaaacctgaaagcaagaatactcaaataatctcgactgtaattcttctttcatcagaagaagttccgtataaattgcggtcagttgatcattcattcttcacaactcctgctcttaacgtagtatctttattgttgcctgtgaatgatgatctaaagcccataagatttttcctttcgttctaaaggatgtcactcttggcacaaaaaaagcccggcttttacgccgggctcttttgcattatttttgatagtatttttcaacgatttcagcgttgcgtaatgaaagtgtaggatatttcggatttgcccctacatcttttgaaatcacacgagatctctcacacatttcgccttccgctttctcgacagcgattttacccgtcgcaaagctttgcgcatcgttcggcgcttcattttcttcgctgattgtcagttcagacacaataaacagctgagaaaggttttcttttatggaagccaagagctccttgttttctttgtttggatacaatttcaggtttgcttccaaagatttaccgataattttttcatttcgcgcagtttctaatgcttttaacacgtcatcacgaagagccataaagcggtcaaatttttcttcagtcgcttcactgtttggaaccgtgattgtttccggcatatcggtcaactgaacgctctgctcttcaacaaatgttaaatgagaccacaattcgtctgccgtatgtggaaggataggcgctgaaagcttcactaatgcaagaagcgtttcgtagaatactgtctgcatgctgcgtctatccggatgatccgcatgctcgatgtagacaatatcttttgcaaaatcaaggtagaatgagctcaattcgattgtgcagaaattatgaatgctgtgatacacaaccgcaaattcgtactcatcatacgcttttttcactttatcaatcagcttgttcagcttaatcagcatatactgatccacttcgcgaagatcttcgacagccaccgcatttgtttttggatcaaaatcgaaaaggttgccgtgaaggaaacggaacgtgttgcggattttacgatatacttccgcaacctgcttcagaatggcgtcagacacgcgaacgtccgcctgataatccactgaagatacccataatcttaagatgtcggcaccaagctgtttcatgactttagccggaacaacaacgttaccgattgatttactcatcttacgtccttctccatccagtgcgaacccatggctgagcacacctttatacggcgctttccctgttacggctactgctgtagaaagagaagagttaaaccagccgcgatattggtcagatccctctaggtatagatcagccgggcgaacgaggtcatcacgttcttcaagcactgcttgatgtgaagagcctgaatcaaaccaaacatccatgatatcctgttcttttgtaaatgtgccgttcgggctgccaggatgcgtaaagccttccggaagaagatcctttgcttctttttcaaaccaaatgtttgatccatgctgtctgaacaattcagaaacatgttcaatggtttcatctgtaataaccggttctccgttttcagcgtaaaataccggaatcggcacaccccacgcacgctgtctggaaatacaccagtctccgcggtcccgaaccatgttgtgcaaacgctgctcgccccattcaggaacccatttggtttctttaatggcatccagcaggtctgatctgaaatctttaatagacgcaaaccattgcgctgttgctctgaaaatggttggttttttgttctccaatcatgcggataagaatgagtaatgaattcaagcttcacaagtgcgcctttttcatcaagctgctgtgtgatcgctttgtttgcatcatcatagaacatgccttcaaagccaggagcttcgcttgtcattacacctttttcatcgaccgggcaaagcacatctaaaccgtatttttggccgatgataaagtcatcttccccatgtccaggcgctgtatgaacacagcctgttccggcatcagttgttacgtgttcaccaagcataacgagagagtctctgccatatagcgggtgttcagcgataatgttctcaaggtctttccctttgaccgttcttgtcacttcatactgatcaaatccgcatgccgatgcaacattttcgactaaggcacttgctacaacaaagcggtcttcacctactgcaatcacgctgtactcaagatcagggtgcactgagattccgaggttcgccggaattgtccacggcgttgttgtccaaatgatgatgcgctcgccgttttcaagaacgccttttccgtcttttacaccaaaagcgacgtaaatagatgctgaacgtttatcttgatattcgatctcggcttcagccagagcagactcacttgaaggtgaccagttaaccggtttaaggcctttgtaaatgtagcctcgttttgccatttcaccaaatacgcggatttgctgcgcttcgtattccggttttaatgtcacatatgggttttcccagtcaccgcggacaccaagacgtttgaattgctcacgctgtccctcgatttgcttccaagcgtactcttcgcatagtttgcggaattccgctactgacatttctttgcggttgacctttttgttttttgtcagagctgtttcaattggcaatccgtgtgtatcccagcccggcacatacggtgcgttgtagccgctcattgatttatagcggacaatgaagtctttcaaaatcttgttaagtgcatggcccatatggatgtcgccgtttgcatacggaggtccgtcatgtaaaacaaatttcgggcggtctttcgtccgttcctgaacaagacggtagatatcttcttcctcccattttttttgaatgtcaggctcacggtttggcaaatttccacgcatcgggaaatctgttttcggcattaagagcgtgtctttaaaatccattttcattcctccactgcattttttcagaaaataaaaaaagccctctcatcccataagggacgagaaagcttatctcgcggtaccacccttttagaaaaagcaagcatacactttttcctcttgagcatcgtaacgtgatgaacgtcctaacctactgtgagttcagcaaggaaactaaagggctgatctacatgattccggccatcccggactctcaccatctccgggtcgctatgaaggcctgaaggaaacatgactgtccctttcaaccgttttttcatctgaatttatgaacgtattatattcgacaagctaagaaaatgtcaagataatcagagaatttattccttttcctcaaatacagcgtcgacttcatactcaaggagatgatcccaatcgtcatttttcagaagatcaagctgagcttcaatcagcatttggaaacgtgttctgaacactttagactgttttttcagctcttcaatttccattgcaatttttcttgattttgataacgattcgttgataatgcgatcagcgtttttctccgcttcccgaacgatcagctttgcttctttttgagaattgcgttttacgtcttcagccgcttcttgagcaactaaaattgatttattcaatgtctcctcaatattggcaaagtgtccgattctttcatcaagctcattgactttcgcttcaagctcagttttcttgcggagaacaatttcgtaatcttttctgacttgggctaggaattcatttacttcatcttcatcatatccgcgaaaactttttgtaaacgtcttgttgtgaatatcatttggcgttaatggcatgatgccacctccatttttacatttcagtacggttatctagttcacattataaaacaaatttcgcacagatggagaaaaaaactgaaaaaccgactatttttgtcgttcaaacgtaactctccatttgtcttttttggtttttccttcgatttttgttaagctgcaccggccaaaacctctgatagacagcatgtccccttccgcgactatgtatgaaggatcttcaaccaccttccagttcactttcacaaggccgtttttcacaagcgtctgtgatttctggcgggattgcctgctcatagaggcgcagacggcgtcaagccttaaagaagaaaccgtgtcatctcttatttcgacatcaactgctggaatgttaaggtctgacaagtcgattttctctaggctgaccgccgctttgcctgcttgggtcagctgtgcagccacaaaatcagcggtatcggctgagacaatcaattgcactgctgtctcagaaaacacgatgtcaccgaatttttgccgctttaatcctatgcccattaatgcaccaagcagagaacgatgatctactgagacaaacttgtcagcataacggacgttaaacgcctgcagttcaaaatctgattcttccggagtaatgtactctggaaacagaatcgcccgtttccgctccgctctgtcatagccgccggaaaaggcaagcccgacatctgcctgtcccgtaacagcagagaggatgacctgctctcggggatctaaaaagtcggtcagcttcatccggtactgctcctggacaattcttttccattcgagcgcttgatcaataaaggcccgctcgtcttttctgaagtgctgatatatatcgctcatcgtctttcccttctatgtaaagaggcttggctgctgccaagcccctatcaaactgtcacattaaaacgcaatcatgcgataaagtccccacaagccggttgtcgcaaaccgaagcacaagtattgctacgattggtgaaatatccagcattgcaatcggagggatgatttttctgaatggttcgagatatggttcacaaatcgaagccaaaaaacgcccgactgctgtttccctcgtactcggcacccatgacataaaaatatatatgatcagggcaaatgagtatattgtgattaataagcttaaaaccgaaaaaacttgataaaggatcatctcgctttaccacctctgatgttcgtcttcagatatgagctcagaaattgtgcctgatacatctacgttgtcaggcgtgcagaggaaaatatctgagccgattctttgaatatcgccgccaatggcataaacggttccgcttaaaaagtcaacaatccgcttcgcctggtcatgctgtatccgctgaagattgacgacaactgcccgccggttcttcaaatggtcggctatttcctgcgcctccgcataaacgcgcggctcactcaacaccactttagaggatttctgaacactttgcaagctcactacattctgtttgcccgcaggtttattcccgttgtaagccggcttttctttttgctcatgctcctcatgagattcccgctctgtctcaatatattcatattcgtattcttcatcttccattgagaaaaagtttttcagtttatttttcatactcattgctgtacaccccctgtttcatttccgactaacgatgagccgattctaatataagtagctccttcttcaattgcaatttcaaaatcatttgacatgcccatcgacagttcagtacacggagcgttcggctggttcagcttctgaacctggtcacggagttctctcagcgacctgaaacagcttctgatctgatcttgatcatcagtcagcggagccattgtcatcagcccggcaacaaggatatgttcgaaaccggaaagctcctgtatgaatggaatgacttcttcttttttcatgccatgtttagaaggctcaagagaggtattgacctgcacaaagcatcgtacagtaccttcagcccgtttttcaatttctttcgctaatgagagccggtctagggaatggatataggaaaccgaattgacgacagattttgcttttcttgattgcagactgccgataaaatgccattccggattccctttcatcaattcctgtttgcggagcagttccgcatcccgattctctccgaggcaggtgatgccagcatctactgcctcctgtgctctttcaggtgatacatattttgtgactgcaataaccgtaacttcatcggagctgcggcccgatctgttacatgcttcgtttattcgttcgtttatatgtcgtaaattatcaacaacacgcaagatcttttatgcctccttcattccgataaaggacatcatccgtccagttttcccctgatcgcggcgatgagaatagaaaagagacggctcgctttccgtgcataaaccgctgacagaaatttgttcacttgccaaaccgctgtccatcagtataagacggttcagctctttcagatcaagctgatattgtgcctttgccgtctgattggcggcaaggtctgctgaaaccggcaatgcgcggacagcatccatgacgcggtcgtctaccgtatagcatgctccgctgatagacgggccaataacagcgtaaatatctgagggatttgaaccttccttctcagtccattgcttcaccatttctctgccaatctgtttgacggtgcctttccacccggcatgggcgactccgacaagcgacttaaccggatcataaaagaaaagaggcacacaatcagcaaagcataatgctaaaaatacatttttttcatttgtatagatcccgtccgttgcttttagagccgtgtgatactcacgggcgccttttcccctatccctctgcgtcactttctgaacgcgattatcatgtgtctgatcagcgaatacccaagactgcaaatcagtattaaacatatcggcaatatattcacgatttttaactacatctgcatctttgtcatgaacgtgcaatcctgtatttaacgattcaaaaggcttttggctgacaccgccgttttttgtcgtaaatccggcaatgacctctttgttgttttgattcgtttgagcccagtcttgtatcatgagtgtcgagggtgtggtaagactgaatgggtgatatgtattcatgatgatccaacctttcgacaaacatttaaaaaagcggaatttcccacttattttaccacatcttactgcattcgttgagcgccgatttgcatatttctaaatgaaatgtgccggaagaatcgagacttccggcatttgccaatctgcggcagacaagcaggtttatgcatgtggttcacttaatcggactaagattacatcttccccgatttttactatatttcgccatggaatgaccaattcctcttcttttccaaaaaatccgagaactttcccatttcctccgagtatgatcgcctgaatttttccagtggtcacattgatatcaatatcaccaatactccccagcttttttccgtttgagacattgacgacatcctttacctgaaattctgaaatgctgatcattccatcacgtcctttttccgtccttttgttcaagtatatgaacgggcaggctgaaccttgtcagcaagaagaaattttcatgtcattgttcttttttccggctgcaccagctgatgataaaatcgagtataatttttgtatactctactagctgctcaatcgataccttctcgttcacagagtgtgcattgtgcagatctccaggaccgtatattacgcatggaataccggcatcatacagccatccgccatctgtaactgattgagaaacgtcaataattggacactcccgtttcactttctgatgagaggcagttagcgctaagacgcctgggtggccagggtcaacttccaatgccggaaaaatttctcccctgtcttctatcatagatgagcctccccacttgaatacagggcggttttccctaagccaaatatcactgtcactcagccgattgacgtaatcttctatttccgctgccacttggtcatgggtttcattcggataaaaatggactgtgatccacagccggcattcgtccgctataaaagccgcatgtctgccgccttctataactgccgggttaatcgtatttgtgcctggtttaaaaccgggataacttttcataatagaccagtggcgctcaagttcaccgagccccgcaatgatttttgccattttttcaattgcgcttgctccgaatgttcctccgcctgcatgaatcatattccgtctcgttccatcatgaaatgtttgactgcttttgatttcgatccagcctgtaatgacaccgccttggccttgaatatgcatatcgctcgtatccgcgacaattgcaaaatcagcgtggtagcccctcttgcagcattcaagtgtgccggcctctccaacttcctccccaataaccgattgcagaatcagatcacctggaagttcaatgcttgcttcacgaattaatttgacagcaaacagcacacaagccattccgcccttcatatcggaagcgcctcgcccgattaagagaccgtttttttcaatgggatgaaacggatcgtgcttccattcttcatcctcttttacctctgccacatctacatggccattgataatcaggctataataatctgctgaatctgttccttttagcttccctacaacattgggatctccagggtacacatcccatttgtcgatcgagaatcccaattcatttaaatatcccgcaatccaagactgaatgccctctgtatttcttgcaggcggagcaggtgtttgataagaaatcagcgttttcgcaagctgaataagctcctccttatgttcttccacttttttttgcaaagagtatatttgttgatccaatgtaaatccgctcctattctttaaaatcaaaaaagccgtttcaaatgtgatgaaacggcttaataaaaacaaacggagtccgatgtactccgcttttcaccgcttccctccgctggcatgatccagatcaggtcaaaagggttgagacaaagtctctctcagcttcgcaaagcacccctaggatgaatctatatatatttgtcaggcattcgttatcggctcagctcttgttaaaaacggccgatcctgattccataatacatggattggcgtatcaaaaaaagcggaaagtatttgatcagtaagcatttcctttatttctccggatccaaaaacctctccctgttttaataaaagggctttatcaaagacaggcaaaatttcttcagcatgatgagtcacataaaggatagatggtgcattttctttgtttgcaatgtatgtaatcgtatctaacagcttttcccgggcaataaaatccagtcctgtgactggttcatccagtatcagcagctccggatcggccattagtgctctagcaatcaatgctctttgcttttccccttgagaaagggtttcatagcggcgatcggcatattcaattgctcccaagtcctctaacaaacctatcgctttttccctggtttccttacttggcgtttcatataacccaatcgaagcgtaagctccgctcaaagcaatttcaaaagctgaatctgccggatacaatttttgctgaagagctgctgagacgaggccaattttacgtctgagcttttccccaagctctgttttgccaaattcatggccgagcacctgcatctcgcctgatgttggaaaataatatgagcaaagcatatttaacagcgctgtcttcccggcgccatttaggccgtaaagcacccaattttccttttcttccaccttccaatgaatatctttcagtatccatttcccattccgttttagtgagacattgtcaagctgcaaaatcatcgtggtcctcctctttattgccttttataattgttttaattttcataaaactttgtacgaactaggataccttactttttccaaaacgtaaaccatccataatcaatagaaaagcctttaaaacaacatcgttttaaaggcttttcattattgatgaatatttttattcatttgtttgatagccgctttttcaagtctggacacctgcgcttgagaaattccgatttcctcggcgacttccatttgggttttcccttggaagaatcgctttctcaaaatcattttttccctatcgttcagccttctcatgccctcttttaaagccagctcttcaatccattgtgaatctgtattacgctcatcactgatttggtccatcacatagatcgggtctccgccgtcgttatagatcggttcaaatagagaaaccggatcctgaatggcatcaagcgcaaatacaatttcctcatgcggtacttcaagaacttttgcgatgtcttctgcagtcggctccttgcttgtctcactgattaaccgctctcttacctgaagcgccttgtaagcgatgtcccggagtgatcttgagacacggatcgggttattatcacgtaaatacctgcggatctctccgataatcataggtacagcgtatgttgaaaacttaacattgtggcttaggtcaaaattatcaatggatttcattagtccgatgcagccgacttgaaataagtcatcaacatactcccctctgttattaaatcgttgaatgacacttaagacaagacgcaagttcccgtttacaagcttttctcttgctgaatcatcgccttcatcctgcagctgcctaaacagctttctcatctcttcattcttgagtactggtaatttggaggtatccaccccgcagatttcgactttatttctcgacacttttttccctccctacaggagctgctgtacaacgttaagtatctccttgggtgggaaaaatatgcactgcactcagaccgaaaaactgtcgaaatcaggaaatccctgtaaaatcaaggggttctaaccataaaattttttacaccattttgttgaactcttttctcaacctttttataattcttttctcaagccgcgaaatataagactgagaaatccccatcatatccgctacatccttttgggttttttcttcttcaccgacaagcccaaaccgcagctccatgatttgcttttctctctcattaagctgttcaagcgcttttttcaaaagctttttatcgacgttagcttcaatgtctttagtgatgatgtcatcgtcagtgccgagcacatcagaaagcaaaagctcattgccgtcccaatcaatattaagcggttcatcaaaggaaacctctgaacggattttgttatttcttcttaaatacatcaggatttcattttctatacaccgggaggcataggtagcaagcttgattttcttttctggattaaatgtattaacagctttgattagaccgatggtaccgatgctgattaaatcctctatattaattcccgtattttcaaatttacgggcgatatatacgaccagacgcaaattgcgttcaattagaatggcgcgcgccgcctgatcgccgtttgggagcttcattaacaaaacctgctcctcatctttagataatggaggcggcagggcttcactcccgcctatgtaatagacttcatcacttttcagcccaagtttcatcagcagcttataccagaggtgcgtcaaccgtaatttcagttttttcatcttcctctcccttctaaatgtcacgccgtttgagtatgataagtaacggacatttgcgaacattatgaaacgtgtttgacagccttgcccgaaagcattttcggatgaataatcgcgtcaaactctccatctgccgacagctttgttgtgctgataccgattaaacatttatctgcagaaatcatttcttcttttgtcataatcgttacgtgatccggtttaacgcataataaaaattgattttgctgaccaactcccctgtatggaatcaacctcattttatctaaaaagcgaaaggaatcatcgagctgttcgatggcttccaatgggtctgtgtttcgaatgatcatcgtttcggctgttccgaaaatcggctccagtttatcaatgtaaatgatcattaccggtgtttttgtaagaggatcgtacagctggttaccggaatcaatcaggcctctgacatgaagtgtttggctgcccaaatctgcctgcacgctgactcgttcctcatattgaatgttttttgtttcaatatcttcaattcttcttttagaaaaaaaccataatgctggaaagccaccaacaataaacaaccagctgatcgggtctccaaaccctgtttgattggtaatcatgacaccgttttgaacaatagaatttgactgcagcaaagaatgggctccgataattcctccccccattaaaaaagtggcaaaataaaaggaaaacaaattttgaaagaaaaaccgaaatcttttaaagccaaatgtcaccaccacaatcacaactgaaaaagctagcttcccagccggatgttcaacaatcggcgaaaaaggagtaaacatcaaaaggacaatactggaaccgatgaacgctccgcctaccagtcttcttttttttacatgccgttttaaaataaatgccgtgagcaaaagcaaaagtgcatcaaaacaaaagtttaacagccaaatgacatctaaatagattttcacatctgactcctttctttcttgcctcacgctgttccccttcttgcttcataagtataaagcaagctctgtgggaaagtctgtcaattaatgttgagaggaaaatacaatttttcagggaaatctgcttaatttgtcgaggaagtataatgagaggatataaaaaaagctgccaatgacggcagctttttttccacttaattttctgtgttcatattaagttttccattcgcagtttttcttgtttcatttccataatcatctcggacgatcacttctacttttgctccttttgctttaatagaagaagtggcagtccaatagccttcatatctccccggagagatttctcttaacgggagttcggtggcattttgcacactcgctcttgcattggtcagcggcatacgaatggtaaacgttgcatctaaatcctcagcgcttgagaaagcgattttcacagattcaccggcttttaagtttttatcctctcccggaattaagccggaaatgacaggcttgtcaaagttcacatcaatgactgtctttttcgtcgttttgttgcctgccaagtctgtagcaattaccttgatttcatttcttccattttccaaaagaatacgggctgagtatgaaccatcagctactgttgcttttttgccattcaccttgacgtctttcagattgtcatcggatacagcccctttgacagtcagcgtttctttatttgttttcccgccatcctttggattgtccagtgttaattcaggcttttcttgatcaagcgtgaccgtgattgggctggaggcatctgttgttccgttgtcagttgatgcagttgccgtcagctcattttcacccttgttgagtatgatgcctgcatggaacgtgccatccgcagcagctttcgtttctcctgcttctttctctccattataaatgtgtaccgttgtgccaggagaagcgtttccttttacagtgacgctatccttatttgtgtatgatttgtctgtcggtgaagtaatctcaggtacagcagcttcataatcaactaatgcgcgaatcatatagttgccatccgctttgtcacctggctgccactttccatctatatactgccagttgcggccggaattctggccggtttcatccattgccaatccaggtgaatacggatcaggtttcgactggatatatacgagataaaaatctttatcgaccataatcccttttgaactgagatctaccttagtccactcgccattgcgaagagcttccgcgttaaatggccctgcaattttcttgcccggtgctccgtcttttcctgtggcatcgtatacctcaaccttaaactctgtgccgcccggatcagggaactctgtatcccagaatctgaacagccctcctgtaagcatgcctttgtccttgccgtcagcgagcgtcatttttaccgcccatccgttaccggcagcaaaataggaattggcattctccgctgttccgtcatcatatgcaatttcacccggataaccgacgaaaggcttcaatgcagtttcttttgtaacatcaccttttaactcaacggaaaattcatcactgtaataacccggtgcagcgactttaatcgtataagcgccttcataggcctccagcatatattcacctttgtcgtttgtcatagccggttccaccgcagcatcctctacaacataaacggaagcgcctgttaccggctctcctgtcgttttattgatgaccgtgccttttaatgtgcccttcttcatctcttctaacgtaaaattagcttgtgtcgtctgatccgtctttaaagatactttttgtgttttcgactgataaccatatgcttctgccataagcgtatagtctcccgctttgtgcttcagcgtgtactgccctgtggattgatctgaatatgttgattttcctgtttccactacactgacttgtgccttgagcggcaaaacttgaggctgtatagccttgttctgatgttttaccgctgtgtttgcagatggcttagcctttttcggatttactggctttttcttttgctttccagacggcttttcgacgcccagcttattctttttgactgtttttccggctgatttgtcagaaagcactacatcatcaatataccagccctcttttgcaatgctttcatcagattgaaggttaaacatcacttgaatgttttggcctttataagccgataaatcaatttcttcgtccgtccagcttgatgtctttccgttatagacaccagcctgctcccaattcttttcaccttccggaagaacaaaaacgtagccgtaatcaaaatcatcctctaaattgtgccagcttttaaattgaaggaacagacttcctgaatcaggtgctttaataggaggcataacaaggttcatgtttgctgagttggcataatttcctgtcaaattcgttccatatactttttctccggatgctgctgtatttgggccagttgacggaactccccattcccagttattatttgttccgctcgcaacccagccgccgggtgcagtttcaaagtcctgcttatatcccgccgtgatgcttggtttcactgttacatcgtatacgtcagacgaaacgacatgaccgccaaaatcgtgaatcatccacttatagcttagtttagttccttttatatctgggatctctgcctgatacgttccttttagatgatcaccgctgattcgtttagccgttatttctgtccattcaccttgatcaagcttgtaggacagctttacagatgtcacactcacattgtcttcagctgtcaaagtcagtggtaggctgccaccttcataagcttcagttactttctcatgctgatagacaggaggctcttggtcatccccctctacagaaacttgtccttccgctttccctaatccatctgtaacagcggatacagcatcaaaagcattcaccagaccatggccatatccgttattcggtgaatcaggaaatgttgaatccgtgagcggttcagccgtgctggttaatatatcctccatctcatcaacagaaagtgaggcattcgcctgtttcagcagtgcagcaacagcggatacatgcggccctgccattgatgtgccgtcccaaccatcctcatatgtctgaccgggaacggatgaacgaatattaacgcccggtgcagatatttccggctttatttcatcatatggagatggcccttgaagagaaaagtcagcgagctttttattgatatcagtcgctccagttgcaaacgattctggatagtttgccggatttgcgatagaaccaggcccgccgggaataaagagatccgtattccccgctgaaaactcagggaaaatatcggccgcacgccaggcattgaccatgtctctgtaccattcatcaagtccagagccccctccccatgagttattgacaacatcaggagccatttccgggtggggatttccttccgcgtcctttggtgctaaaacccattcaccagcttccaaaatgtcagcatcagtgccgccatcttcagagaacgctttaacagcaatccattttgcgccaggtgctacaccgatttgatttgttccatcaggttcagagcccaccatcgtgcctgtcacgtgggttccatgagccaaatcatcataagggcttgcctcgcctgctacggcatcataccagttcatttcattttcaggctcattaggattttccggattatatccgcgatatttctcttttaatgccggatgattccattccaccccggtatcaatggacgcaacaaccgtgccagttccatcatatccaagtgcccaagcttttggggcatcgatttggtctacattccattccacaccgtcagttgctttaatagctttctgtgcttttttcatattaaatggggaggatgacttaaaaagctgccgtttctcattaggaagcaccttttccacttcgggaaactgcaccactttttccataacctcttttgaggcatgaacagcaatcccgttcaccacataataagaatgaatttggtctgcatttcctttatctttctgggtgttcaagtattttaggacatcttgctgggattcatcggctgtgacttttaaagatgacacaacagcagaacgcttttgatattccgtcttagcggcagacagcttcttcgatttcgcttttttaacagccgcttttgccgctttttctgggttagccagatctttaaatttaatcagaaaagtcgttttttctttctttttaaagcttttctttaatgaactcgaaatcttgttttgaatggattccgcagattgaagctcctttttaacagaaggtgaggtgactttactgcttgccccggctgctcccggaaacagcagtgaactgatgacaactgtacttaaaacagagctgatgagtctgtttttcgttttttcctcattttcatccccctttttcaacatgctttttaaaaaaagtgtcgtccctccttttaataatgaatggtttgtcagaacatcgctgtatattaactgtagacaatctgaattacagatattgtcgtttcatgtcattcaatttccatatatatgaaaatgataaaaatgtcacaaaaataaatgggtctaattatctgttttgttactaagcgaaggaagcaatagggaaaaagactttataagaaggaaagtgtgaagagaaaaacaaaaaaggacaaaatcgaaaacgattttgtcctttacattagccgcgtttattacggtttcttaagaatgtcgggatgtcaagcgtatcatcagccggctgtgaagtatgacggcttactgtgttctgctgctgaggttcctcacgttttggctcacgcttcggaacactttgattgtgtgttttgatgctttgatttaagcttggacgctgaggcttcgtcacgtccttctcttgttcgataaagccggttgcaatcactgtcaccacaatctcatcttttagattttcattaataacagaaccgaaaatcatgtttacgtcttgatcagacgccgaagcgacaatgtctgctgcttcctgaacctcatataggctgaggtttgttcctccagtgatgttcatgaggacgccttgcgcaccgtcaatggccgcttcaagaagcgggctggaaattgctttttttgctgcctctgccgcgcgattttccccagtagcaataccgatacccatcaaagcagatcctttgtttgacatgattgttttcacatcagcaaagtcaaggttgataagaccaggtgtagcaatcaagtcagaaataccttgaaccccttggcgaagtacgttatccgcttcgcggaatgcttcaagcatcggtgtgtttttatcaacaatttcaaggatacggtcgttcgggatcacgatcagtgtatccaccgcttctttcattgccgagattccgcctgcagcctgaagctgtcttttgcgtccttcgaaggtaaacggtcttgtcacaacgccgactgttaatgcgcctaagtctttcgcgatttgtgcgataaccggtgcggcacctgttcctgttccgccgcccataccagctgtcacgaataccatgtcagcacctttaagtgcttcttcaatctgctctttgctttcttcagcggcttttttcccgacttccggattcgcacctgctcccaatcctctagtcagctttgcgccgatttgcattttcacttctgcttttgacaggttaagagcttgagcgtccgtgtttaccgcgatatactctactccttgcacttcattttcaatcattcggttaacggcgttgttaccgccgcctcctactccgattactttaattgatgctaagccgtctatgtttgtttcgaactccaacatgctaaatcctcctaatctgccgaatgactatctatctattcccaaaacatgcttaatagttttttcattttgctctgtttattatgttcggcttgtgttttttgtttccttttggccgctgctgcacctcattttggtgatgatgctgctcttgttcctcagatgatgagactgcgatttcctgtatcgcttcttcaggcatcttaaagcctatttttctgccttggattcttgcattccggcaggcgaattggatcaggcccactcccgtcatatattgaggatctcttacaccgatataattcgggcttgccactctgacattgttttgcagcacatcctgtgccaaagacatgacacccggcatagctgcttgtcctcctgtcagcacgaagcctcccggcagatcggtaattcccatactgcgaagctcttctgaaacaatttcaagaatttcctctactctcgcttcaatgatattcgctgcttcttgctgtgtaaatgtttgtttttgattggtgcctataacggttacctcaaatatttcatcttccgaggcttcgtcatagtaggcatgtccaaattgctttttcacgcgttctgcttcttctgttgacgttctcaatccgatggagatatctttggtgatattttcgcctccgagaggaatgacacgggtagaagtgagatgtccgttctggaatacggcaatggttgttgaccctccccctatatcaatgagagccacaccaaggtttttctcgtcctttgataatgcagcagaaccggctgccagcggctgaaggcaaatatcagttatttcaataccagctctttcaacgcagcggagtaagttatgtaagattgtttttgaaccggtgatcaaggtgccctctacttctaaacgcacacccagcatttttttcgggtcggtgatttcatctcttccatctacgataaactgtttaggaatgacgtcaacaatcagctgttcatgcggtacggaaacaacctgtgccgcctccatgacacggcgtacatcttcaacctgaatttctttattttcactggaaactgctacaacaccgtttgtatcttgaatattgatataatttccattaacgccgacaatagcttttctaagcggaaaacctaccattctttcagcttggtcaaacgcttttcttatagaatgaacggtctcatctatatcaacgattgagccttttttcaacccttcagacggtacatttcccacaccgataatattaagggaatcatctgtcatttctccgacgatcacttttgtattggacgtaccgatgtcaagactgacgtaaagttcattgttgttcattctatggcacctcctcacatttcgatcatttctattctattatttgcggaacaacaatacaatgaatgtggctttacaagtgtgtaacaaaaaataacaacagaatatttttatgtgcttttcacattttatgtttattgaaaatattcgttatatcctatgtatatcctcttttatatcacatttttttatttttttagaaagagtccactttgttagtagatttcttctgataacggctatattctgaaataatctgactccaaatgcgaatatacctgctaaatacaagtctacaccaagatggactcccagaaaagctaaacttattgccaatataatattaaaaaagaaaccggaaacaaataccatttcatcatatgtaccttgtaaatgcgccctgattccgccgattaatgtatcaagtgcggcaagcaccgcaagcgataaatagtttgagtattcactcggtatcgttaagtttgtcattagtccaatcgctattccgagcaccagtcccaacacgggcagccacatgacaattctcctccttttcagtctttaagcagtttcagctgttgtacgtccagtggtctgtcatatgcttttaatgttagtttgctttcagatttaccggcttttaatgctaaattttcagatgcaaaaagatcctcaaggcctgaccccttcactctgctgtgtaacatgtccggatctttggcaagcacttttactgttaaaggataatcgtcaagggcgtatccgtctatttttgtagtgccgtttatatctctgatgactgtatgattcacaactcttcgctcattaatcgagatatgctctgcaccgtaggagttgagttcatttatcagctttttcagcaaatccggaggcggattttcgatcggctctcctgttaagctttcagaaaaaagcggggaaatcgtaatgacaattccgctacctgttatatcggtcatgccggctgtttttttaaggattgcaaggtattatttagcgcggtttcttttgtcatttctttcgtttgcgaatagctattcagcaatttgtcatatttgtttatttcagccagcagcttttcctgcttcttctgctctgatgtcagctcttccctaatatcccacatatctcttgtatcccggactttggggtgctttaacgaattaaactgaacagatatcatcaggccgaagatgaccataagaacactgatgcttatgaaggaacgctttattttcaatctatttcacccgctttttcagtcattccttcgttttcagaatcggtttcatttgtacgtttttctctttttctgccgacacagaaatatgatccattgacagctgatcaattaggcctccagcgatatttaacgagggcagcaggacatctggatctccaatagcggataccgtaaacggagcgggatgctgcaccccgtctaccgttaccacaggaccattgcatttgatatacgaatcatgcgtcaaacgctgtccattaacggcgacagctgccgctcctgagatatacagttcgtttactacttggaagatatggctttcgtgaacgatgtaactattcacattctccccttccggtatgtatgacgcatcttccaatgtcacctcaacgccttctccctgcacaccgacttccccaatatacatcctgtatttttctgtatcttcgaggacattatagtattccgacttctctttcttcagcttattttccgcctggcggactttgttttgcttttgatataattctttttcaaacttcttattttctttctcttgtttcagcagttcatctctcagcgcatattcttttttccactcttccgtctcagccgcgcttttgttgttttcttttgtcatttgaaaagaaaatgaaatcaaaaaacctgcgataagcataatcaaggaaagaaggactgctgatttgcccctcaattttcatcttcctttttagcagctttatcgtttttcccaaactcttcaaaataggtggcaacttctaaatgaatgattccttttttattgctgcttagctgtgagatgatagaaggatacgtcttcattcggtctgcaaacgttttaatagatgccgtaacaacataaccgtcgttcatgtacaacttaatacggttttcatccatttttacaggcgtataataaatttctgaaatcgactgttttaacgaatttgacaacgcatcgagctgcttggccatttgagaccgcttcttcgcgtttgtccaattcactaaaatcggtccggcatcatccggcgttacttcgtttggcagaactgagccgttttcaagcacttcatagtacacatcgtctttttctaaataagcaatcgctttatattcttcgattgcaatgttgattttattaggaagcgatttgctgatctccgcttttttcactaatttattttgctgaatcttcttttctgttttttgcttgtccaaactccaaaactcagtatctccgctgttaatatcggaaaggtcgataatttccttttttgatacattttcattccctgtaacagagattgttgatactttactgattggtgtttgcaggtacacaatgatcagcaccataataaaaaagagcataataaatgaaatgagacggcggtttgccttttgtttcctctgctctttaattttagggatccgctcttcaatgttaacgattttttctcggtcttgacccgggttcattgcctgttcacctcattcaaatgaaacagctgttaaaagtctgtctattccaaaacaaacggcatactatgatgccgtttgtcgtttgcttacagtatatcatatgaacagcttcagtcagaacttgaatcagcgatttccgccgatgatttcaacctctgtgtgcatatcaatctcgtatttttcacggattgtctttttcacatggtcaatgagatcaagcacatcttttgctgatgctccccccgcattgacgatgaagtttccgtgcatctccgatatctttgcaccgccgatttgatatcctttcaagcctgctttttctacaaggttcccggcatgattcggaagcggatttctgaatatgcttcccgcacaagggcttgaatacggctgtgtattttttctatagtctttattgctttgcatttgctgaacgattgattccttatccttctgctcaagctgcaaaacagcttcaaggcaaacgcccgggcgtttcttttgcagtacagatgtcctgtagctgaaatccatctgctcatttgtcagccactcaatcgttccgtcttcaaataaaatatgcgctttgacgaggatctcgctcatatcagaaccgtgagcgccggcattcatataaaccgctccgccgactgatcctggaatgccggcagcaaattccaaaccggacaggccttttttgctcaatgatgtagcaaggcggaccaccgaataaccgcctccgactgttacttgttccccttcaagctccaaatggtcaagacccgcccccagcttgatcactacgcctctaattccttcatctaaaacaagaagatttgatccgcggccgatgactgtccacttcacatcatattttttaatcacgtccatgatgtctttaacagcatccacactgcttggaatgaccaatacatccgcaggtccgccgattttcatcgttgtatgattcgcgagcggttcatttgcaagaaccttgccgacttctcgttcttttaattcctgtatcactttctccatcgtaaacctccgcattccatttgcttttctactatttttttaattcctcgagtacgctgtataaacgggcagccgcgtcaggaacaccgagtgactttgttcgttcgctcatttcctttaacgtttgctcattcagtacaatccggtctagcgcttcaatcagcttctccccgctgagctctgtttctttcagtacaatcgccgcatcatgctggccaagagacctcgcattgacctcctggtgattcgctgtcacatatggacttgggatcagaacacttgggattccgagagcagtaatttcggcaatcgttgtcgcaccggctctggccacaatgacatcaatggcctttaaatactcaggcatttgatgaagaaacggctttgtgaccatattatcagcggcacccttgcttttcagctcattcattactttttcatagtgaacttcaccggtgatatacagcacttgatagtctcttgttttcagcacatcctgcatgtcaatgacagcgcggttaatcggtgcagcgcctcggcttccgccgaaaattaagaccgtttttttgtcttcagaaagcccaaattcagccaatgatcgtcccgtctttattgagacgacttcagaggctctcgggtttcccgtaaatacaactttctcgctaggaaaatgtgatttcgcttcttcaaaacaaatcgctactttattaacatattttgaaagaaacttattcgtgatgcccggcaggctgttttgttcgtggacaatagtcggaattcccattttcgcagcggcatagacaaccggcccacatacataaccgcccgttccaattacggcatcgggcttaaattccgctaaatacgatttactctttttgacgcccttcagaaaacgcatcacagtcttgacattttcaaatgacaattttcttttaaatcctgtaatttcaattgaacgaaacggtatattctcccgctcaacaatttttttctccagcccgttttctgttccgatatataaaaattccacattaggatgacgtctttgcacttctttaataaaagcaagagcaggataaatatgtccccctgtaccgcctccgcttattgcaattcgcatttcttttttcccccagtctaagtttctctataacataacgataaccctgttttgttggacagggttatcgcatcaattgtttccaagcttcatgttagacaggaggcttggaaatacattcgttaatacctcgagtagcggcttacattcagcagcacaccaactgccatcagcattagagtcaatgaagagcctccgtagctcagaaacgggagcgtgatgcctgttacaggaatcaggcccgtgactacgccgatatttatcatgacttgaatggcaatcattgaaataatgccgactgcgacaaagcttccgtacagatcaggcgcaccaagcgcaattctgattcctctccacagcaggacgctgaagaggagcaaaataagtgttcccccgataaagcccagctcctctgacaagatggcgaaaataaagtctgtttgcggctcaggcagataaaagaacttctgtctgctttgtccgagccccattccgaacaacccgccgggccccactgcataaagcgattgaatgatctgaaatccgcttccgagcgggtcttcccatggatttaagtatgaggtaatccgctttatccgatatggagccgatagtacgagcccgacaaatccgctgaggccgatcagcccgagaaagacgaaatgggcgatccgtgcgccggctacaaaaatcatgacaatacaagttccgaccataactgtccccgttccgaggtcaggctggcacatgataatcaaaaatgctgaaaacacgatgccaagtgcagggacgaacccccgtctgaacgatgtgatgtttttttgtttttcagagagaaatttagcaaggaatgcaatcatcgcaagcttcataaactctgaaggctgtatgctgaatgctccgactccgatccagcttcttgaaccgttccgcaccattccgacgcccggtatcaaaacaagcaccagaaggaaaaagcagataaccatcagcaatttggaccatgtcctccaagtccaataatcaacattcatgataaaaaacatagcaatgacgccgattcccgcaaacaaaagctgccgtttcgcgaaaaagaatgagtcgtcaaatttataatccgcccataccgcactcgcactgtacaccataattaatccgattgttaataataataacgtaatgatgaccaataacaaatcaggcgatgtttttttagtagtcaaagcaatcgacaccccaagcttaaagtcattagggctgccgatttacttcaagacaagcccttacttaagcatatgcacggcatctataaacatgtcaccgcgttcttcaaatgttttgaattgatcccagctcgcacacgcgggtgacagcaggatgacatctccttcatttgagagcgcaaacgccgcagatactgcttgttcaacattatcgacacgtttgacatgttgtattcccagttcattgccgagtttctcgagttttggcgccgtctggccaaatgtaagcactgctttgacatgcttcatataaggtttcaagtcatcaaaaccatttccgcgatccagtccgcccgcaagcagaatgaccggcttatcaaaagctgaaagcgccttgcttgtcgccagaatgtttgttgctttactgtcgttataaaatttgcggccattcacagttgtgacatattggaggcggtgcttcacaccagtaaagcttgtcagcacctttttaaccgcctcattggatgctcctgccgttttcacaactgcaatagctgctaaaatgttctccaggttatgagcaccgggcagtacaacctcttccagaggaagaatggcttcgccgttaaacataatcatactgtcttttacatatgcgccctgttcaagcgttttgctgactgaaaatgggacgatttcggcttttccggcttcagcaagacgcacgacggtttcatcatcctggttgacaatagctttatctgaagcagtctgatgaaggtacactttctgtttcgctttttcatagttttcgcgcgtatggtgataatccagatgggcgtcaaatacatttaaaatcaggctgatttccggtctgaaagcgtgtgttcccatcagctgaaacgaagacagttcggtaacgatccattcatctccatcagcatgataggcaacctcacttgcgactgtgccgatgtttccggcaatcagtgctttttgcgagtcagccttgagcatttcgtaaattagcgttgtcgtggtcgttttaccgttcgatccggtaatcccgataaacttggcgctggtcaggtagtaagcgagctcaatttccgtccaaaccggaatacctcgtttctctgcttcctgaaccatgatattttcataaggaattcccgggtttttgatcagaatcgtgatttgatgctgatcgaacagagaaactggatgctctccgcaaacaacttcgattcctttttcagaaagcttttgtgccggttcattttcttcaaaaggcttttgatcattgactgcaacataaatgcctttttcatgaagaatggaggccgccgcatatccgcttttcgcaagcccaaggattaaaaaatgctgtttctgtaaaaattgatcattttccacttataaccacacctcgatgtaaattcctaaaacggcaagcaaaagtcccgcagcccaaaacgtcacgactactctccattcagaccagccgacaagctcataatggtgatgaagcggactcattttaaagattcgtttacctgtcgttttaaagctgatgacctgcaaaataacggataatgtctcgataacgaatacaccgccgatgataaccagcaggatctctaatttcgttaaaatggcaatggtaacgatggctcctcccaatgcaagcgatcccgtatctcccataaaaactttggccggatgagcattaaatacaaggaagcccagaactgcaccgacaacggcaactgagaaaatcgctacgtcatattgagactgattccatgccagaatggcaaaggcgccaaaggcaatcgccgcagtaccggataataacccgtcaaggccgtcagtcaggttaactgcgtttgatccgccgactagcataaagagcacaaggataaagtaagcccagccaagatcaaatgataagtcagttccaggaatgcgaatatccgtcgcaaaattgtagtaatgatacacggcgtaaaatacaaccgcaataataatttgtccgatcagcttttgctttgatgtcaatccaagattgcgcttcatgacaaccttgatgtaatcatctaaaaagccaagcaaaccgtagcctagcgtaacaaacagaagcagcaccatttcggggcttatttctgaaaacttctgtgtcataacaattgttgtcactatgatagaaagtatgatcatgaccccgcccattgtcggtgtccctgattttttctgatgtgatttcggtccttcttctctaatactctggccgaattttaatcttcttaaaaacggaataagaatcggagagagcagaacactaattaaaaaccccattaaaattgtaaacagaatgacttgctcaagcattgtccttttctcctcctgtttctttcaaacgacatacgtagttatcatattcatgatttttttccatatgaaaaatcttttcaagctccattattcagtaacatctctttcctatgaattcgtcttattcttattgagttcaacaatggctctcgccgctacttcagcatcatcaaaatcgaaagtttcatttccgatctgctgataggtttcatgtccttttccggcaatgaggacaacgtcgccttttttggcattggcaattgcgaaaaagatcgcctgctcgcggtttgcaatactgtgatagtatgcgttctctactccggcttccatatctcttaaaatcgcgcgaggatcttcgcttctcgggttatctgacgtgaaaatcggctcgtcagccagctccacagcaattttagccattttcgggcgcttcgtcttatctctgtctcctccgcagccgacaacgacaaatagctttccttccgtcatgtctctgcatgtctccagcacattttcaaggctgtccggtgtgtgcgcgtagtctacaatgacaggaaactcctgctgctgattgaccaattcaaaacggcctcttacaccatgcaattcttcaacagcctcagtgatgatttcaaacggtatgcctgctgcaatacatgtcgcaacagcggccagcacgttatacacattaaattgtccgacgagagacatcgtgatgtgcttcgtgcctttgtttgtcacgagatcaaagcttgtgccctgtgcagtgatactgatgttcttcgccatcacatcagcatcgtttttaattccgtatgtagagatatgcgcagctgttaccttttcaaaataagcgctcgcctcatcgtcagcattcaggacggcacgctttggatgttcatggttgaaagccccgccaagttgggaaaagagcaagctttttgcatgccggtactcatccatcgttttatgatagtccagatggtcctgtgttaaattcgtaaacacggcaatatcataatcacagccatggacgcgtcctaaagacaaagcgtgggaagaaacctccatgattgcagtgtcaacgtgcttgtcattcattttcttaaacgttttctgcagcgtgacgctttccggagtcgtgtttttaacaggaagtgtttcgtctccgattttcatgtacattgtaccgatcaagcctgtgcgttttcccgcttttttcagaatctcatcgaccatgtgggtcgttgatgttttgccgtttgtccctgttatcccaatcagctgaagcttcttcgtcggctgtccgtaaaacgcatcagacaaaacgctgagcgcgcgaagtgactgccggacaataataacaggaacattcacatcgacctctctttctgccacaatagccgctgcaccgttttctactgctttttgcgcaaaatcgtggccatccaccgtatacccttttacacatacaaaaagactccctttctttacttccctggagtccatctcaattgaagttatttcagggtcttgtgagtcgtttacagaaggttcggttgttaagtatgtaagcagctttgtaagtttcatcgtatcaaacctctcaacattctaattcgttctttttatcattgaagtcacatcaaatgatgtggtaatgattttaagcatacagttcatattttagcgtaaataaaaggatacatccagctaatcttgaaagatatcagcattttttctgcaataaaagaataggcagcccgaatcaatcggctgcctccttttcatcttcttcagtcaaatacacgcgtatctttgagccttcttttactttcgttccggcagctggcgattgtttaacgattttgctccctttcccggaagcatccacattgagattcaccaatagtgactcaagatctgagacagacatccctacaacattcggaacttctattgtttttgtgtcgttccattggtattttttctcgatttgatttttccggggcttcacaccaagttccggcagactgtctctcataatatttccgacaataggcgctgccaccgttccgccaaactgaatcgtgcctttcgggttatccaccgcaacgtagacgactagactcggatcatctgctggcgcgaaaccgataaatgatacaatatggttgttttcaagatattttccatctttaaccttttgtgcagttcccgtttttcctccgacacgatatccttctacaaatgcattgcggccggttccttctgcgacgacgctttctagagcatagcggatttgtttggatgtttcctcagaaatgacttgtttctttgcgattggtgattgttttttgaccgttttcttcgtaacaggatcgatccattcctttgcaatataaggtgtatagagcgttcctccgtttacagcggcggatactgctgcaacctgctgaatcggcgtgacggatactccctgtccgaaagccgtagttgcttgctccaccgggcccactctctcaagcgggaataagatgcctgttccctcgccttggagatcaatccccgttttttgtccaaaaccaaagtctttgatatatttgaaaagcttttcctttcctaagcgctcgcctaattcaacaaaccccgggttgcaggagttctgcacaacttccagatacgtctgcagcccgtgcccgcctcttttccagcaccgcagtctcgctccgtccacttcagcatgccctttatcataaaattgatcccgtttcaaatttactttttgctcttcaagggctgctgcaagtgtaataattttaaaggtagatcccggttcatacgtgctccatactggcagatttcgattgtagacggacggatcaacagattggtaatcagcagggtcgaagtcaggcctgctagacatccccaaaatttctccgtttttcggattcatggctacggcaatcatgccgtccggatgatatttggcctcagcgttatcaagctctctttccattatcgtctgaacctttgaatcaactgtcagcttcatatcaagcccatccttaggcggcgtatagtcatccgcttcatcaggcatcttcttccccttggcatctgtataaaacttaacagaacctttttccccttttaaatcatcgtcgtaataggcttcaagtccaaggagcccttggttgtcaattcctgcaaatccaagcacatgagataaaaagctgccgaacgggtaatgacggatactgtcctccgcaacatacacaccttttaaatcaagcgctttgatttctttcgccttctcatttgaaatttttctcccttcaggagtgatcttttcgattgacgctttttttgtcacatgtttatatactttttcttctgacatattgagcaccgccgcaagctgcttgctcgttttcatcggattctgaacttggcgcggcacgacgaatacggtcggcgcacttttatttgttgcgagcttcacaccattccgatccagaatctcgcctctctccggctcaaacggcaagttccggctccaggaatctttcgctagcgaagtcagtttttcgcccatcacaaactgaacataccccagccttgtatcaatgatcagaaacacgatcacgccaaaaagcaaaacaaataataaacgttttctaaccgttacattcgagacgcgcaagagaccgttcactccttatttaggcttgtttcattttatgcctgaatttggacaggtagaacgatgctcctctgaaggcataaaaaaagaaagcctgcataacgacggctttctttttaatcaggatttttaaacttaaccttgattacggttttgtctttgatttctttgtctttcttaacactttggctgacagcgtagccttgtccgcttacttcaatatgaattcccgcgagctcgccgtactgcagaacctctcttctcgaccagcctgtcatatcaggcattttgattttgccgcccgttttcaggaagaccttttgattggtgagaacttcctcatccgctttcggatactgttcttttacagcgacatcactgccgatgacaattggtgtgagattctcctcttttgctttcttttgagcagcagctaccgtttgatctgttaaatcaggcattgtctgcgcttttgtttcttccttatctgagtcagatttttcagttggttcgatgtttaggtagtgcaggctatttttcattgttggattgaagatttctgatactggatctgaactgctttgtcctgcttttagttgcggctgctgtacagcaacataaattaaaagctcaggatcatcttttggcgccatacccataaacgaaaagatatagttatctgtgccgtctaaatatccgcctttaccggctatttgcgcagtacctgttttcccggcaacatcaaaaccttcgattttataagcttgccctgttccgatcttcgatgtaacgacttctcctaatatatcccgcacctttttcgcagtacttgcagaaattggagttccggctgattccggcttattttgataaatagttttatctttatcagggtcaacgatatggtcaatgacataaggtttcatcattttaccgtcatttgcaattgccgttgcggcctgaatctgctgaattggtgtgaccgcagacgcttggccatatgcagttgacgccttatcaaattcatatttaaagttgattttgctggagacttctcctggcaaatcaatacctgttttctggtaaaaattgaatttgtgcaaatattgattgaggcggtcatatcccagcttttctttcgccagtttcgcaaaagcgacattcgacgaccttaggacgccgtcatgatatgttgtcggaccccagcctacaccgttattgtgatccttaacaggtgctccgccaacttcaaatgtccctgatttatatttttcgttcgcattaaacacgttttcctgcatcgcagcagcgagtgtaaagatcttcatcgtggacccgggttcatacgcatatgaaatcaaatcattatagtagtttgtcacatcgcgcttgttcggatcaaagcttgggcgctgtcccatggcaaggactttgcccgttttcggatcaacgactgcggccatgatttttttcggattatacttttgcgccacttttgtcatgctgtcttccaaaaaggtttgaattttctggtcaatggttaaatatacattgtcaccattttttggcgctgtaattttatttttgctgttcgggagctcccagccggatttgtcgctttcatatgtcacatatccgtcccgctccttcaaatacttatccagcactttttctaatcccatcgcgccggaaatttcatttgtttcttcatcaacctcggcatagccgattagattagatgcaaatactccgtttggatagtagcgttttgtatcccgtaaaaatgaaatgcccgggagtttcattttttcgattttttgcttttgtgaatacgtaatatcccggccagctgagccaaactcgacttgttttgcatctttatttaagatatcaaggatgtcggccttgtccaagtttatcactttagacaatgcttccgccgttttttctttgtttacaacatgctgaggatgcttgacatcagtggtcatttttttatcgagaatcgcaatcagtttatacgtcgctgtgtcctctgcaatgacttttccttttcggtctaaaatcgagccgcggctcgcttcgatggtccgtttcttttcatgctgctctgtcgcttttgtcgcaagcacttcgccgttcgcttttccggttatttgaatatatgccattctccccaggatgacaaagaaaaagagagcgaaacaaatacttagaatcgctgctcctctattcataaatttattcttttttggcatttgaatcattcctgtatgtttttcacttttttatcttttaaattcaagccgttctttttcgcaatgtccataatgcgctgcggtttgcttaaatcagcaacgcttttttcgaggtcaccaatttgcttattttcggatgaaatttgctcctcaagcttttgcacctcaatattggtttgatatgccgcatacgccttcgatacgatcaaaagcgatacgctgagcaccgccgcagcaaagaggacaagaagcactttttctccgagagtaatggaagcccttttcttgacaatcacttttttctcaggactgatcgcatgccgctgctgtttctctggttggtaagctaaattgctcataggctgatgacctccttttaattttgcgttcgcgtttcgttattttcttttttcagcaatccgaagcttggcagaacgagcccggttgttctcttcaagctcttcttgagatgccgtaatcggttttcgtgtgatgagcttcagctccggttcaaactcttccggtataacaggaagtcccggaggaagttccggaagcgacgacttttctttaaaagtggttttgcaaattctgtcttctagcgagtggaaggtaatgaccgataccctgccccctggcttcagaacctcaattgcctgctccaaagcttcttcaaacaccctaagttcatcgtttacggcaattctgattgcctgaaacacgcgtttagcgggatgtcccccgctccttctcgctggagcgggaatcgcgtcttttattagatcgaccagttggcccgtagtttgaataggagacttcattcttgcctcctcaatttttctggcgatctgtttactgaacttctcttctccgtatttaaagaaaatacggacgagatcctcatagcgccactcattaacgacttctttcgccgaaagcgtagccgactggtccatcctcatgtccaacggtgcgtcatgatggtaactgaatccgcgctccggtgtatccagctgcggagaggacacccctaaatcaaataaaatgccgtctacttctgtaacgccttgttcattcaaatattcttttaaatacctgaaattgcttttaatcagaatgagctgtcctttataatcggacaacacttctttagcatgctgtaatgccgtatcatcttggtcaaaagcgattaaacgccccttctcggataactgctgcaataagtatgtactatgcccagctccgccgagtgtgcagtctacatatgtaccgtctggtttaatattaagtccgtctacggtttcacgaagaagtactgtcttgtgttgaaacatattgtgttggtcccaccttttatcaggatgaattgaaattgtttttagagtgttatacacgaagaatcattatatatcaaacccaatcatgttttcagcaatttcagcaaatgaatcttcttgctcttctgtgtattgttcccaaattactttactccacaattcaattcgattagaaaccccgataacaacacattctttttccagtttggcgtaattcaatagagatgatgcgatatttaccctgccttgcttatccagttcgcattcagtcgcccctgaaaagaagaaacgggtaaacgcgcgggcatctttctttgtgagaggaagagcttttagtttttcttcaatttgtttccattcgtgcatagggtagccgaagagacattggtcaagtcctctagtcagcacaaattgctcacctaggccttctctgaatttagcgggtacgatcatgcggcctttcgcatcgatggtatgctgatattcacccataaacatgatctcttgccccactttctctccttaactcaccactattcaccacttcgctccacaacttcattttacactgtttacccataaaaaaaaccctgaactagtcagggttctttaaaactttatttcaaagtttgacaacttgatgttgattttgaaaagaaaatggcagattcttgaatgtcgtgaagaattttggaccgtacctgttcaaataatacatgatattccaaatccgttcttgcggcgcaagaagcggcttaatgctattttgaattctttcataatccttcaagacgtagccttctttttcttcaattcgcttcatcaccgtgcgctctaagaattgaagctgatcctgaataaaagcggcatttttcagaagtaaaggttccaagctttgatcaacctttaacgcctcctgccggaccgttttgtgaatcgcttcaatttggcttttcgcctgatccatcaccgccgtaaactcttccggaatctggcgctcgaagtatgtctctctttgattctccgttccgcgctcaatcgcgtcttgtaatgagatattccgttcagccagttttttctcaatatgccgctcaagtatcgtaatgttcagccttggcatgacaggaggcattttgaagcccatcaccgcaaatgcctgtttgagctcgccccaataattgatttccccaggccctgcaataaatgctaaagtcggaatgagaaattcctgcattaacggtctcgttacaacattgttgctgaaacgctctggatgttcttccatatgtgtatgaagttcatccctcgtccatcctagatcaagctctttgatgacaaatcggccgttatctttttcaattaaaaaacgctcatcttcgtattcataaaacagattcgcctgctcttttccggactcgataatcggtttgtagcctgcttgacgcatgaaggcctgctgatctgatacagcccgggcgagttcatcattttctcgaagaatcttttggaacatggccgtttccagctttttaatccccggatccccagaatttaataaaactaagccctcttcttggaacaaatccgcgatcagcagttcaaagaagtcagtaaacgtaacagattcccttaaacatcgtttcacattgtcgagaagtgtattcgtatggtctgtttcttcaaaagcggcaaaaacatcatctatccacgcggcacacttttcctgatcaagcgatgtactcgctgctgatgatttcttccaataagactgaggcagcttttttttcacaggcccattctcttcagatgtgtgaacaaaattaatctcatccaaatcgtggtcttctccagccacccagaagattggtatgacaggcacttgcagttccttttcttgttgctttgctaaaacaatgattgaaatgattttatgtatggtgtaaagcggtcctgttaaaagtcctgcctgctgtccgccgactacagcggcacttgacgggtccttcagcttctcaatagcagactgcatcgcacttgaaccgaatttattatggtaagaggttaagtacgccgccaattcctctcttgcgaaaaaccgggaagataagtcttccagtctttcgcgccacatgtccttatgatgaatactgtaatcaaaaaaagaagacatttcttctttgccatctatatagtgctgtacaaacacattctgatttttgatggaaagttcagttagctgcatcttctagaacttcctttctccaataaatagttagtgatccgaaatgagtatagcatgttaccgaaaaagctcaaaagactttgtttgtatttcgctccaatgctttgatgctgccatataaaaactctaggtggacggcatcaagaccttgaagacttgcttccttcaataagtatccgataatggcgtcagcttccgtctgccggcctccaatgacgtcaaccagcattgatgaacgattctctttcgtttgcccacaaacggcctgaacccgctcccaagccttttcttcattttcaagttttaaaatgcggcatgcctcctgaaataccagcttcataaaagccagataagctggcgttgtcagcagttctccatttttcacttgcaataacgcagttaaaggattaatacacgcatttacaatcagcttgcccgtcagcagacggtaccaatccgtctcataataaatcggaaaatccgaatggttatgctgaaacaagatgttcagccggtctggttcagcatcgtcgaacgcgctccattttatcgcacctaggcctgtatgatcaacagctgtatccgattttcttacagctccgtgctcaacgattccaacataaatggaatggccaacgtgccagtcttttaggtcgtggatatgccccatgccgttttgcaaaaataatatattcgtcttcccgattcgttcaagcgacgaaaaaacagattgaagctgatgctgcttcactgtcacgacaagcaggtcaaagtccgaattgatactcgtgtccgcactgcaatcagccctgaattcctccccgcctttataaagccggattccttcagactgaatggccgcagcctgttcttgccgcctcgtcacaacagtcacgtcgtgataaagtgacaaataataggcgcataaaagaccaacggagcctccgccgataattccaattttcatgatgtcacacccaatttagcatttacgtattatcatagcagaagtaagaagaaattacttctcaaagatcccatgtgcttaaaattaaagtttaaatatttggattttttaaataaagcgtttacaatatatgtagaaacaacaaagggggagatttgtttgacaaaggtagaacgtctgcttatcaactataaaacgctggaagaattcaagaaattcaaagaatacggcattcaggagctttcaatgcttgaagaacttcaggataatattattgaaaatgacagcacctcgcctttttacgggatttattttggcgataaacttgtagcacgaatgagtctgtatcaagttaacggcaaatcgaatccctattttgacaaccgccaggattatttggagctgtggaagcttgaggttcttccgggctaccagaacaggggatacgggagagccttggttgaatttgcaaaatcattcaaaatgccgatccggacaaatccgagaatgaaatcagcggaattttggaacaaaatgaactttaaaactgttaagtatgatatggcgcgggacaaaggggaaaacccgctcatctggcatcctgatatggatcgcgaaatgacaccgggagagtctgcatagaaatcaaaacaaccggcctattcttactatagggccggttcatttcaggcgtttctttacgtttcttgagccgcttttttcattcttccgtcttccttcgaaacaaccatttttctggcccgatccatgatatcgatcagtgccttgtaatcctcttctgtcatctctagctgattccgcaatgtctgattttcactccgcaaatcctcaagctctttttgcagcgattggatttgctccttcaatttttccctttcaagctgaaattcttgtgcagacggtgtttctttgaattgttcgagaaattgaatgacatcctgaatggacaaatctcgttttccttctgacgatgccgaggcagtctgcttcatggaattcggcatattgaccgaatgaacgccgatttgctttctcagttctttcctttgcttttttgcaagctctatacctgactggtattgttttctcacatacgagttccacctgaaaccacaggctgccgcggttctggtcagcgcccttccaacctcctcaaaggctgaaagctgtgttcctccctctcgaatatgacgaagcaccacttctgccagcagcaaatcctcatcctgagtccaagcatcttgtcttgtaatggtcaaattcaatctccctccatgtcagcttatttatctcatacatatgccggtaatagattagatagactatttgcactcacaaattttccgcaagctgacaggaagagaaaaagaaaaagcgcagggctttcaccctgcgcttttctcattagttactttttacatttatgtctttgccgttgtatgatccgcatgctttgcatacacggtgagacaacttcatctctccgcatgacggacattctgtcataccaggtacattaagtttgaaatgtgtacggcgcaatcttttcttcattttagaagttcttctaaaaggtacagccattattcccacctccttaaagagttaagattcatcatcttgttttaagagcttttcaagggctgcaagtctcggatcaacttgattcttcttgtcttcttccgaaatgacttgccaatcctttccttcttgaggagcagctcctttttcttgttcagattcacaaaagatttgcatagggatttctaaaagaatttcttctttcacgatcggagttatgtcgatagtatcgtcctcaacaatgtgaacgtcatcatcttctatatcatccgtgtgatgaaatataaacagttcttttgttgaaatttcaaatggatacggaacatcaacgagtgttcttgagcatggcaaaagcatttcgcctgaaattgtaaaatcaaacgaaacctgtttggatttgatatccgctctgcccttcacccgaacgggagaaatgcggcgaatgtcagaattcagctttgtcagctcatttaactcaactgtttcatcaaactcaaaactttgttttggcatttgatgcagctgataaatcgtccatttcatttgtatcacctcaggaaagcaacaaacatgattatagcttttaagattgtttttgtcaatattttttctttacagcataatgctgccattgaagtatcgttgacagcggaatatgctatgcatacacttaaaacaaaaataaggcgtaagagttttcatttgcaaatgtaccatacgtttttaaacatagcaagaaaggcggaaaaaatatgaaagctgtcggattggtggttgaatataatccctttcataacggtcacctttatcatgcccaaacagcaaagctgcaaaccggatgtgacacggctgtcgcggtcatgagcggacattttttacagcgcggggaacccgctgttgtatcaaaatgggcccgaacaaaaatggcgctgcaaagcggagttgatcttgtcattgagctgccttatctttatgccgtgcaaaaagcagacatttttgcacgcggcagtgtttccatcctgaacgaacttgaatgtgaggcgctgtttttcgggagtgaaaatggggatatcaagccttttttagaaacagcacagcttattgatgagcataaacatatattgaatgaccgaattaaagaagaacttaaaaagggggccagttacccagcagcggcggctatcgccttcagctccattttgcatactgaaagtgcacttgacttgtcaaaaccaaataacattttgggataccagtatgtgacctcgattctaaccgggggatatcctatgaaaccttatactacggcacgaatctcttcggactatcatgatgccgatctccctgaaggcgaaaaccatatagcaagtgccacaagcattagaaaagcgatgattggccagaatctcgaagcctgccttcgttttctccctgctgcatctgcacgtgaattagcagcttaccgcaaatctttcggattgtggcatacacctgaaagctacttttcttacttaaaatacagcctttcaactgtaacggcacgggaattacagcaagtatacgaggtggaggaaggtttagagcacagaattattcgttcgatcagaaaatccagctcctatcaggaatttatggaactgctgaaaacaaaacgctatacgtggacaaggctccagcggatgaatacacacattttaaccagaacaaaaaaacaggatatgcaaaagctgcttgacaacgataaggcgccgtatatcaggcttctcggcatgacgaaaaaaggacaggcttatttatccgaaaagaaaaaagcactgtctgttccgcttgtcagcaaactgtcctctttctcccatccagctctcgatctggacgtaaaagcaagcaggatttacagcctgccgatagaagagccgctgagaactgagtttgacctacaggaatacggacatgcaccgattcgatatgacgaagatgaacaacactttttaaatgtatagaaaaagcacctgagaatcaggtgcttttcgctttcagcttattcaaataatcaatcgcatcctgcatggtatcaacaggcacaatcttcatatttgaatcaatatcttttgctgtttttactgcgttcttataatcggaattgctggcgccgttttgatttggcgcgaagaaaatgtcttttccggctttgtctgcggcgacgactttttgatcaatgccgccgatcgggcctacttttccgtcaacatcaatcgtacctgttcccgcaatatcgtagccttttgtttcgtctggttttgtcagctgattatagatttcaagggacatcattaaccctgctgacgggccgccaatattttcgatttcaaaatcaatatcaggctctaccttcacgtttctgtctgtataaagcgaaactccgattcctgcccgatccggctcatcaggaaattgttttaacgtaagggtgacacgcttttctttttcttctctttcgatctttaacgtgactttatctcccgcttttttgctgctgatataatcaatcagcttttcagcagactgatagtttttgccgtctgcgctgatgattttatcaccgacttctattttcccttttgccggcatgttttctacaactgagcttgcgtatatgccgttaaaggaatagctgactttttttcctgccttttgataggcggctataaccgcattttcttgcgagcttttcatcatttggagctgtcttttcatatactccttatctgattcgccttcctccttaatgctctcatcaggaacaatttcataataagggtgcatctttgcccacacatatgtaaatggattagccggtcccactttaacagtcattaaggacagacttcctttttccgggtagcctccctccacttttatcaatgaagcaagctctgtcgcttctcccggttttgtaatatagtatggaagttttataaatgataaaacggcgatcagtatgaggatgacgagcatccagctaaaatgttttttacgtagcaaattatgagccctcccaattctctatttcttttcttatcttgctgatcattcggtttgtcgcctcttcgcctgccgatatcatttcttcaatattggcaaacgagcttgagctgtatgtttcaagggaagggcgaatcatgatatctgcggcaattgtttgatgccgcactaattcattttgcagtatatccatactttgcataatcacatcaaaaatatgcactgctgtttcagtttttcgaaccctggaaacatccgaagcgatgataatatcagctcccatgtctttcacaacagaaaccggaattcgatcgacgaccgcgccgtctacaagaaggcgtccgtccagccgctgcggaataaagatacccgggatgctgatgctggccctcactgcatctgacactgatccttttcggaacacaatcttttctcccgtctgtagatcacacgcaacaatgcccagcgggatttggagctcttcaatcggttttccgaatgtataagcatgcacaagctgtctgacgcggtcaccttttaaaaaaccgagtttcggcaccgtataatcagcataaagccttcgtttaaaggctttggctacttttttcatcgttgccacgtcatgtccggcggcgtaaaaactgcccaccaaagcgcccatgctgcttcctgcaatcatatccacttcaatttggtgcttatgtaaactggaaagcacaccgagatgagcaagccctctggcccctcccgatcctaacgctaacccgattttaggtttggccaaagcgttaacctcctgcctgaattccctgtataccgaattctatggtctaaactgaacccctatgctcgtatattagtacaaagaatcaagaggacaggtactgcttggccgttttacatcatacattattttatcatgatatacatgtcattgggcatttttagcatcggggaggtaagaatgaacttgtcgaagattaatacacttttgattgcctcgttttttctttttttaacagcgactgtcatctcacatccacaggcctcattcgaagcctctaaaaccgggctgtctatgtggtgggaggttgtgtttccgtcattgctgccattttttattctgtccgaactcttaatcggctttggcattgtgcggtttgtcggtgttttgcttgagccttttatgcggccgatctttcgcgtgccgggtgtcggcggcttcgttcttgctatgggaatggcatcaggaaacccagcgggcgcaaaactcactgcccgtctgcggcaggaaaatcagatttcaagagtagaggcagaacggctcgcgtcgtttaccaattcttcaaacccgctctttattttcggcgctgttgccgtcggtttctttcaaaacgcatcactaggcattttattagcttctgcacactatttggggaatcttgccgtcggtttaacaatgcgctcctatggccgcaaggaagagcagcatctcagaagaaagaaaacgatacctttcccttcagtcaaagatgctttacacgctcttcataccgccagacttgcagaaaaacggcccttaggtaaaattttaggcgacgccgtgacgtcttctgttcaaacgcttcttatggtaggcggctttattattttattttctgtcttcaatcggctgttgtcagtggtccagctgactgatgttttgtctgttttcacaaaaggagcactgactttgtttcagcttccgactcaattggacattccgcttttatcagggatgtttgaaattacattaggcagcaagcttgtcagcgagacagatgtttctcttctgcaaaaagccattatcgtcagctttattcttgggtttagcggcttttccgtacaagctcaggtggcaggtattttatcggaaaccgacattagatttaaaccattctttatcgcacgtttgctgcagggcgtttatgccgctgtcttcgtcatgcttttatggaaacctctttacacagcatggcatgatccgtatcagtatgtatttaaatctcttaacagcagtgacatgtcaactgcctttataaacggctggaatctgcttgtgcagatcggacctgctgtcacactatgcgcgctgtttacgtacattatcattttttcttacagactgacaaacggaacaaaaaaggatgagtcaaaaccctcatccttgtctgaatttttgctgaagcgccaactctacttccggcggtacaaactctgataccgagccgttgtatcttgccacttcttttacgatgcttgaacttagaaacgaatattgattgtttgtcatcataaaaaacgtctcaatagattcatcaagcacccggtttactgatgtcccctgcatctcgtattcaaaatcagatacagctctcaagcctcttaaaatcgctttcgcattttttctttttgcataatcaattaacaggccttgcgatgtttcaactgttatgttcggaatgtcttttgtgacttctctcagaagctcacaccgttcttccacactgaacaaaggcttttttgaagaattattcagcacacatacatacacttgttcaaaaatatgcgccccgcgtttgatgatgtccagatgcccgtaggtcacaggatcaaaactgccgggacagacagctatactcgccacctcactaccccctctttttataaatcgctacacctgttaacccataggtttcttttcttgtcatcacaagatctcctacggtttcgggaagctcgacctctctgtcatgctcagcgacgataaagccgtcttcttccagcatttgatattcgtcaatcaaagttaaaagtgctttcagcttttgttccttatacggcggatcgagaaaaattccgcgaaagccggtttctcttttagcagcagcgtgcaaagcacgttccgcatcattgcggtatacctgtgcatgttttgtaagctccagcgttttcaaattagattttaccgtttgaatcgctttaaaatcacggtcaacgaatatacaatgctcaaacccgcgtgaaagcgcttcgattccaagacctccgctccctgcgaataagtcaagtcccctgcccccgtcaaaataagggccgatcatattgaaaatggattccttcactttgtcggttgtcggtcttgttgatgttccggctacagcctttagtgaacggcctttttttgatccagaaattactctcatgttccacaccactttttctaaaagctattttgtttctttattcggccggacgccgctatgtacatagaaaaaaatcaatcctatctgaaaaaaatcaatcctatcttaacataaagcattcttccaaacaatgaacgctaatcttgataaacaggtgtataggcagcatgatccttgtccatactataagcaacagcatctagaggatgttgttgccaaccgcggagaagacttacgtttccccataagttcttcctccggtttctcctctccctttgccttctccttaacatattaaggaatagaaggaccccgcagatgcctgcggggatttttttatagctatatgccgattttataatcgtattcttttgccttatcaagctttgactcgaattccaattttaaaaacggtttataagaaggctccacttttttcacaaatgagtaagacgcaatcttgtccattgttttttcaatttggtccatatcacagtacagtacgacatattttaatcgttttgatacatagtgcacattcccgaacttcctcagcattttgctctgctttagggagtgcagatacacaaccatgccctggcgcctattctccaatacaatcacctgcctgttttctcttatatgtaaaagacgagacggccagtctcgtcaggacactttacatccgcagcttccgcctgaaccgcagccgcctccgcatgaagacaaaccgtcaaaataagggttcccagtcggaactttcacatgctccgaaacagctgtcccaatctcaacgctgacctcatcaagaatggactggagctcattttcagctctcttgaagtcagccaccttatcgttcaggtccagctcacgtttgatctccctcattttccgggatatttctctatagtcaggatgatatttgccaaaacgctgtacatcctcatactgctcttttattttgataaaagaacgaataatccgacctgcctcttcatcttcctggagacgcttgtaacaattgcggtagttctcagccgtctccgactgcagaatcatctcggcaagctgctgagcttcactttgaagccgcacggattccatcgtcgcatacataacatgcacctccagttgttagtttaccatgaaaccagccaattggaaaatgcttaaccgcagccgccaacaaaaccttatgaccgcatgaaaaaagacccttcttcggggccttttaatcttttgtccgcatcgcttgaaacatttgcatcatcatttgcgccatttgaatcccgttcgtaaactgattcacccgatgcggaatggttttttcataaaaattcatcatttcaagctgaaaggaggacagatcatccggttttcttgaaagcctgcggtaccatatcggctgttctctgatgaatcgtttccgttcttcgtttgctaaaatatattcctgaacctctttgcgcatatgagctccccttttttaatcctttcgaaaagaaaaaggatgctgtccagagcctggctgagaatgcttctgtccgcttccggaaaatgtattaagaaggctttgcaacgatgagatcgactggctcattttattgatttgttcgttcatttgattgacatccatctttttcaccgctgtcaccattttcgagacaaaatcatttttttgcggtgtttcaggcacagcttcagaagcttcttccggttcccgatatggatcccaaatcgggtcgctctccccgaagaggacccaattttcatatacgtcctgccagcttctttgttctttgcgcacttcttttatcagcttgggatgctttttgacgaattgtttaaagtcattgattgaatgattggcatgttgattcgccacaatcctcaccccctccgaaaatcgttacctactacaatgtatcgttttgtcgggcattgtgttcgcctatattcattcccaaatgaatttttagcgatatccctatacactggtgaaaaagcctgactgaagggatgggaaacggccttatctgtaagctatcagcacattcattcagaccagcttgtatggaaatagaaaaagccgggaaccattcgtccgcggctttcattaccatcgcttaataaagttttgggtgtaatatttccggtctactccgacaccaagatgcgtataatctgaattcagaagcgcttttcgatggccttcgctattcagccagccttctacagcagccggaccgtccacataattgtatgcgatattttctcccgcttgctgaaaatcaacatgcccttcttctaagcggtctttcagcgagccgtattttttagagacatgggagaaataattattttccttcatatcctcactatgcccaaatgccacttccgccgttggctgatcccactcaagcttcgcaagtccatgtttaacgcgtatgacattcgtcaaatcaaggatttgcttttcgctcgttgtttggatctttttccatttctcatctgaaacggctttcggtttaattaattccccgcggtacactacctcataaggtctttgctttacaaaggtctgcgcatcaaacgccctgatgctggatagcttcccctcaaatttgtccatatacagctggacatacatctttcctacctttacagtcggtcttgtattgatatcttcttcagaaaattcaaaccgataggaatttcctttatactctacattcacaaatggtgccacctgggtggtcttgaatacttcgccagttgattctccaattttgaaaggcttggcgttaatatcattacccgacgcgaataatgtgaccactttattgtttaataccccgatttggatatattgatccttaccttgattgtatacccaccaatcgtaatcataagccgaagggtcaatacgttcaggttccccaagctttttcgttacttcatcggcgtgcttgcccatgaaggacaataaccctgaagtcggcatatgtattcgtttgccgctttgcgcttcctcattcgacacctgaggctcgctgtcatttgatttcttttcaggaacagatccatattgaataaacagaacataggttccgcagataatcaaaaggataaccattgctctcaatatatttttcaatctatcacccccgtggcgattcacaatctcttgtttacatcccattacaatacagcctatttaacatgtcaaagatttatgtgttaatgaaaaaagccttcttctctattatccccttcggaaatatccgataaggcgctgccggcacgttcattcgtttgctcagataaagaaagatcaccaagcgtgacaattccagtcagttttttatttttgtaactggtatccttctgagctgatgcgatgccatcaaatgaagaacctcatcgactgaagcatcttcctccacactgacaggtttttcagtcatcgcgtcagtgattttttgcgagttcggttttttgatggcgattcctcttaatacgagatcgcggtcggttacgatgccgaccaatgtttccccgtcctcatcaactaccggtatcgctcctacatttgcgtccttcatctttactgcagcttcatatacattatctaataccgtgcaatattgcaagtcggctgtcatcagatcttttatttttgtcatccgtttaacctcctttagtctagtgctattgtcgtcaaaatttaatttttgcatactttcaaaagaagaagattcattgaaagtttaacgctttcatactatgattgtcaggaaaggtaatttttataaggaggggtcagtgttgaagtttactgaaagcggacttgaaggggttaaggctgagctcagctggctagacgacttaatggaaagcaaaggtcttatcagagcgggtcaatgggattacgagagagtcacctatgacaagaagttttcgacgattgagggtacgttttacctgcggatacaaggtattgcggcagaaggcgatgtcggaagcgggcgcgccgtgattcaattaatgtcccctctcctaggaaagcattactaccctcatggagtagaatatggagaaacggaagagtttcccgtacaggttgtgacaaaaagcaaggcactgattcaggacatagccaacatgttaaaaacagttcaaatgtaacgaaaaggtacagcatatttcgctgtaccttttatgatatcgtctgctgaatatacggcggctcctcctgcccgtccttttccctttctttcttcacccattggaaaaaataacggccaaaaaagtaccgtacacaatttcctgaatgattttcatcatgactgctccgagctgctgatcctctaacaaaggcagtgtattcaacatctctggccctgttaatgggacctgccccatcatatccgctggcacgcaaagcctcattgcctcagcccataaagccggatctgtataggtggcgtataacggtgcaccgctgaacatgatcaaggcgcaagcaggtgtgagcagcataccgtccgccataatataacccagcttcatcaagccgctgagctgccgtagacgctcaaccttatgaacaagcggccaccacatgaagaacgcaagcacaaagataagccaagtgattaatgtatggtaaaacggatctgttttgacagtatcaaatataagcggtacatgatataaagaaaaaatgccgttaaacaaaagcaaagcaattaaaggcgtcgtaaaaaaggaaaaaaccggtttgattgaaggcctgaaaatgattttttcccagagccatgcaggaatccccgcgattaacagcggcgggacaaccaaatacaggacggccatctgcaccatatgcgcactgaacataatatgtccgagcagatcaaccgggcttccctcggctgcatataaaaacagcatcgccgacagaaagcacaccatctctttaccagttattcgattcggctttgaagacattcgcctgtaaaaatagagataaagcgccgtaatgcctaacaggatacaaaaaagataagggctccacatcgcgcgaaacccaaatatctccaactgattcatttcttcacctccggcggctgttcaaattaccaccatataattgtcacaaacgcaagcacagtgataaacgcgacaaacacccctgaatacaaaaacagtgccggcgcctcatgccctttctgattcatatgcatgaaataatacagctgaaaaatgacttgaattgcagctagcaaaataatgaaaggaatcgtaaaccagctgccgacaccgtccgtggccacagtcagaaatgcaacaatcgtaagaccgatcattaaaccaaaagacaggacttgatatttcatctcccgggcatgcttttttttcttaaattcaaggtcgctattgatatgccctctgctttttttatcgaccatgtttatcccaccatccccattaaatatacaacggtaaagatgaagacccacacgacatcaataaagtgccaataaaggctggcaacgtaaaacttaggcgccgtatacagattcagccctctcttggcattgcggatcataagcgtgctgatccacataagcccaaatgccacgtgggcgccgtgtgtaccgacaagcgtgtaaaacgcagaaccaagggcagagcttgtgatggtaaagccaaattcatgggtgtaatgcttgaactcatagatttccagtcctaaaaagcccgcccccaataaaatcgtaattcccagccaaagctgcatcttgccgaaggaaaagttcttcatgtggtacatcgcgtacacactcgttaaactgctcgttaatagaagcattgtggcaatgaatacaagtgtcacatcgaacatttccgtcgtaggcggatcaccggcatttgaattccgaagcgcaagaaacgtggcgaagagagacgcaaacagaacagtctctccgccaagaaaaagccaaaagcctaaaaatttatttttcccttccagggttactttttcaggagaagctggaaaggtttctgcggtgaatttttcttgaacttgcattatgccttcacccctttatcatcgttcggcagttcctctttatgaatatgatagccgtgatcatcaattactgaacgaagcagcatcgtaataaatgtgatgccgagcccgataaagatcaccggcaggccccaagcgtaatcacttctgtacagcagcccgaacgctgcgacaaaaaggccgaaggaaatgatgagcggcaggattgagccgtttggcatatgaatatcatcaaccggttccgccggcgtcattgatttgtgccctgcctgcttctcgatccaaagcggatcaagtcctctgacaaaaggaagctgtttaaagttatactccggcggcggtgaagaaacggtccattccagcgtacgtccgtcatgccatggatcagcacctacatattcaccttttaccgatgtccatatgacattgaccagcagaagaataacagctgccgccataaaaaacgccccgattgtactgatcaagttgccggtttccagaccctgtcctggcaaaaacgtataaacccggcgcggcatccccattaagccgacaaaatgctgaatgaaaaacgtgaggtgaaagccgataaaaaacaatacaaatgaaattttccccatcgtttcatgcagaattttaccgaacattttcggccaccagaaatgaacaccggctaaaaggccgaatacaacgccgccaataatgacgtagtggaagtgcgcaaccacaaaatacgtatcatgaaactgataatcagccgcagcagctgccagcatgactcccgtcacaccgccgagcacaaaggatggaataaatgagacagcatacagcatagcggttgtatacttcacatttcctccccaaatcgtcaacagccagttaaaaatcttaatcccggtcggaatcgcgatagccattgttgcaaccgcaaaaatcgcatttgcaatcgggccgagaccagtcgtgaacatgtggtgcacccaaaccataaagcccagaaagccaatgagcacgattgcaaaaaccattgaagaatagccaaacaaacgctttctggcgaacacagggatgacctcagaaaaaataccgaatgcaggcaaaattaggatataaacctccgggtggccgaagatccaaaataaatgttcccaaatgaccgtatttccgccaagctccggattaaagaaattggttccgaacagccgatccagcatcatgagagccaatccaaccgtaagcggcggaaacgcgaacaaaatcaatgccgaggccacaaatgtcgtccatgtaaacaaaggcagcctcatatacgtcatgcccggagccctcatgttgataatcgtggccaaaaagttaatcccggctatcagcgtcccgagccccgatatttggagtccgaggacgaaaaagtctatgccgtgccctttagaatgaagcgaaagtgaggcatatgatgtccagcccgcatctggcgctccgcccaaaaaccagcttagatttaagaaaatgcccccgaaaaagaagagccaaaaaccaagcgcgtttaaaaatggaaacgaaacgtcccgagccccgatctgcaaaggcacaaccgcattcatcaaggcaaataagagcggcatcgcagccagaaagatcatcgtcgttccgtgcatagtcattacttcattgtacgcttgagcactgagaaacgcattttccggctttgcaagctgaattctgataaacatcgcttcaattcccccgacaagaaagaagaatccccctgccactaaataaagaattgcgatttttttatggtccaccgtcgtcaaataatcccaaagcatagatccgcgcgtccgcttttctgtaagcgcattcaacatatgtgacctcccccaatatctccctttcttccctacttgctttccgcttttaagccttttaagtattcataaagcgcatttgtttcgctgtctgagagctttggatatgtgcctgtcattttgttccccggctttatgctgtcagggtccttcagccaagccttcacattttctttgttggcctctttcacccctgccacttttgtcctttcaccgaaggtcgccaagttaggtgccgttctagcggcttctgcacgcttatcattcggctctaccgcatggcagctcaggcagtttttctctttaaacagttcttcaccctgcttagccaaatcgctctctgctgtagacttatagttcttcatttcttttgtccagccctgaaattcttttgcagacatcgtcttcaccttaaaatccatcagcgcatgtgaagggccgcaaagctctgcacacttcccaaaaaacatatctcctgcctctttgcttcgttttgaatcaaatgtcaggaagaacttattttcattatccgtattcgtatcaagttttcctccaactgaaggaatccagaaggaatgttttacatcagaggcttttaaattaaaatatacacgctgatctgtcggtacaatcagctcctggcttgtgataatgccgtaatcagggtactcaaactcccaccagtataaatttgccctaacattgactacaagagcatcctcagctttgcggccttttttatccattggtgatgtgtccgctagctccagcgtatataatacaacaggaatcacaagaataatgagcagcaaaatcgggatcacggtccatgtgatttctaaaaatttattcccctctacctgtttcggtatcgtgttctcaccgacccgtgatcttctgaatctcacaatcacataaaagaagataacagatactactgcaacaacaaccaccataatcaatgtgctgagcactgtcaggtcatactgtttatcagccacctcgccagcaggcttgagcgtggataaaaaaggttttccacatccgcttaatagaagcggcactaaggctaataataaaataagacgccaatgctttaccatttcacccaaccccttttctggtcaatacaaaggcggaaagcggatcgaaatctatcgccatccaacctatcaccaataaagcacttacatttcctcttctcttaaattatgagtttttttactcaaaatgccatctatgtataaaagtaaagccgcctgattaaacaagaggtcaaggcggcatttactagttgtcatcgtttattttgaagcgataaaacaagcatcatatctattttttagaaaagcgtcaagacaaccatggcaacgaaatagattgtcatgtagttaagcgagtaaacgaacatctgcgttgcccacttcatgatattcttggagcggaatcccattaagccaagaatcagccagccgatatttaacagcaagccgagaatgacaatcggaagacccaggctaccaaggaaaaacggaagcggcatcaggcacgcaacccacacaataatttgtctttttgtcacttcaaatccgtatacgacaggaagcatcggaatatttgcagctctgtaatcctcagttttcttaatagccaatgctaagaagtgaggaatctgccaaataaataaaatcatgaataacacccatgctacgacaccgatattcccttccactgccgtccatccaataagcggcggcactgcaccggaaacgcttcctactactgtgttaatcgtatagcggcgtttcgtccacattgtgtacaatacaacatacgtaaagactccgataaaaccgataacagcagccatgacagttgtcatcagcagcatgatcaatcctaaagcaaccagcaaaattccagaccataacgcctgactcggctgaattttacccgtaaccgtcggtcttactttcgtacgctccataagatggtcaatgtcccggtcataccagttattgatcgcgcaggagcccgcaataatcagtgaagacccgattaacgtaagaagaacggtgtttatattgcctaaaaaacttaaaccggatatatgcagtgcaagccacattccagtgaaagtcgtgatgaggttagaattgacgatccctattttaataagggacagaaaatctttccatgccgttgtttcttcaatttgtccgtctatagctgtatcatttaagattctggagttagccataacgtaaacctcccttacaaacctaacgcaggagaataaaataacctgcaactctatcatacaagataacatcttgtaaaaaaacatcctattaaatattaaacgacaaacaggaatttatttgtgaactttttatgaattttaccaaagatgaaggcaatctccaaatcggcattgcgtttaccttatttctatcagacccggcatgaataatcaagtgtacattttccagaagccgtcattctattatatttttgtgaacaaaaggctctgggaattgccacaaaacacatattcgcttacacttggaacgtatataaaattgcagcagtatgttaagaaggtgaatattgtatgaataaagcattaaaagctctcggtgttctgacgacatttgtcatgctaattgttttaatcgggggtgccctcgttacaaaaacaggttccggccaaggatgcggcagacagtggccgctgtgtcacggccgttttttccctgaactgaatccggcttcaattattgaatggagccaccgattcgcaagcggaatctctattatccttgtgctaagccttgcgttttggtcatggagaaaaatcacgccgatttttcgtgaaacaacgtttctcgcgatcatgtcaattatctttttatttcttcaggcattgcttggcgcattggctgtcgtattcggttcgaacgcgctgattatggcgcttcacttcggcatctcattaatttcttttgcttcagtgcttattttaacattgctcatatttgaagctgataaatcagtcagaacactggttaagccgcttcaaatcggcaaaaagatgcaatttcacatgataggaattttaatatattcctatatcgttgtgtatacaggcgcatatgtaagacacactgaatcaagtctggcatgtcctaatgtgccgctgtgcagcccgctgaacaatggacttccgacccaattccatgaatgggtgcaaatgggccacagagcagcagccttacttttatttgtatggattattgttgccgctgttcatgctattacttcctataaagatcaaaaacagatcttttggggatggatctcatgtcttattttcattacattacaggcactgtccggtattatgatcgtatactctgaactggctctgggctttgcacttgcccactcgttctttattgcctgtctgtttggcgttctatgctacttcttattattgattgctcgtttccgttatgaatccaggcaatcataaggactcaagaccaaagccttaggcggctttggtcttttttatgtcttgttttttggcgctttatgcgtttcaatcgccagccttcgccgaacttgatgatcagtgagcggctcacttcggtctgtcccctttctcatcgtgattatagaaatttcatatggatctatagctcgcgaacataagtattaaagccttttaaatcagatagtgcttaaagaaatatgcacggcatactacaaagcatctaaaatattggctgtataagcctctttttattttgggcttgtgacagtactctataatctctgaagtccccttatatctcttctaaccatctgtttcactccacattttctatataaaaaacaagagtgtatatcattgatatacactctttgttttttatgctttttcaatttcaaggagcagatctcccgtttggatcggctcaccatttttcacatgaacctgcttgattgttcctgagaaaggcgcctgaaccgttgtttccattttcatcgcttcattaatcatcaaatgatcacctttattgacttttgtgcctgcttcagccaataccttaataactgttccaggcatggaagctgcgatgtggcttggatttgtccggtctgctttcagcctttcctgaacggaagacttaatgctttcatctttaatgactacttcacgcggctgcccgttgagttcgaaataaacgacgcgggtggcatcaggctgaggctcaccgattgaaatcagcttaacgatcagcgttttgccgcgctcaatttcaacttctatctcttcacctaatgtcataccgtagaagaatgtcggtgtatctaataccgagatgtctccatagctttctgtcgttttcacataatcagtgaagactttaggataaagggcatatgccacagcatcctgatctgaaatttccaagttatgctgctctttaaattcctgtttgatcgcttcaaatgacaccggctcaagcagttcgcccggtctgactgtaatcggctcctgcccttttaagatcagcttttgcagtttttctgggaatccgccatgaggctggccgatatttcctttaaaaagctccacgacagaatcagggaaatctaaagattcacctttttcgtaaacgtctttttcagtcagattgttttgcaccatgtagagtgccatatctccgactacttttgaggaaggcgttaccttgacgatgtcaccgaacatatcgttcacgcgtctgtacatttccttgacttcgttccagcggtcgccaaggcctactcccttggcttgctgctgcaggttgctgtattggccccctggcatttcgtgttcataaatttcagtatgcggagacttcattccgctttcaaattcactataatatttacgcaccgactcccaatattgggacagcaattcaacgccttggacattcatttccggacggcggtcgttgccttccatcgcatgataaaatccgctcgcgctaggctgtgacgttaatcccgccattgagctgaccgccacgtctatgatatcaacgccggcttcaacagctttcgcatacatataaataccgtttccgctcgtatcatgcgtatgaaggtgaaccggaatgtcgatcgtttctttcaacgcagaaacgagctcatatgcagcctgcggttttaacagccctgccatatctttaatcccgagaatatgggctccggccgcctcaagctccttcgccatcgatgtataatatgcaaggtcgtacttcgtccggttcttgtcaaggatatctcccgtataacaaatcgcagcttctgccactttgccggtatccctaacagcatcaatggctaacgtcatcccttttacccagtttaagctgtcgaaaatacgaaacacatcaataccggattgagctgattgcttcacaaattctttaatcacattgtccggataattcgtatagccgaccgcatttgatgagcgaagcaacatctggaataaggtattcggcacttctttgcgaagatcttccaaacgtttccacggatcttctttcaggaatcggtaggctacatcgaaggtcgcgcctccccacatttccatactgaatagttcaggccataacgcagccgtcggatttgcgatttttttcaaatcatgcgatctgattctagttgccaataacgattggtgggcatccctgaatgtcgtatcagttaaaaggacagatttctgctccttaacccaatttgcaagcccttctgcacctttttcatcgagaatttgctttgttcctctggcaggctgctgatcaacgtctacctttacgcttaacggtttgtcaaacgccggtttttcttttttcccgattccagggaagccgttcactgtcacattgccgatgtaagtgagcattttcgttccgcggtctttttgtttagggaaattaaataattcaggcgttgtatcaatgaaagatgtatcatattgccctgtcaggaacttctcatgctttgcaacgttctcaaggaacggaatgttcgtttttatgcctctgattctaaactcctgaaggtttcgcaccattttggcagctgcctgttcaaacgttaaagcccaagttgaaagcttaacgagaagtgaatcatagtatggtgtgatcacggcgccctggaagctgtttccggtatcaagacggacaccaaaaccgccgcctgagcggtaagccatgatttttcctgtatcaggcatgaaatcattttgcggatcctcagtcgtaacccgtgactgaatggcatagccgattgtaaaaatgtccttttgctcaggaatatttacttttttgctgtgaaggctgtgcccttgggcaacaaggatctgagtttgaacaatatcgacaccagtaatcatttctgttatcgtgtgttcaacttgtacgcgaggatttacttcaataaagtagaactcgttgtttgcaacaaggaattcgaccgtccccgcatttatatagtttacatttttggcaagcgcaactgcagcctcacaaatttggtcccttaattcaggtgacagcgagacactcggcgccacttcaatgactttttgatggcgtctttgaacggagcaatccctctcaaaaagatggacgacattgccctgcttgtctccaatgacctgaacctcaatatgtttcggattctcaattaatttttctacataaacttcatcattgccaaaggctgctttcgcctctgatttagcacgctcatatgcttctttaacttcactttcagatctgacaatccgcataccgcggccgccgccgccaagcgaggctttaatgatgatcggataaccgttagcttgtccaaattgttcgacggcttcaagcgtttcggcaggaccgtcgcttcccggaatcacggggattcccgctttttctgcctgctcacgcgcttttaccttgtcaccaaacatatcgagatgctcggattttggccctatgaatacgatgccttcttcttcacatcgtctcgcaaaatgaatattttcagataagaaaccgtatcccggatgaattgcatcgactttgtttcttttcgcaatatcaatgataccttcaatatccaggtaagcatcaatcggttttttcccttcaccgaccaagtatgcttcatccgctttgtaccgatggtaggaaccggaatcttcttttgaatagaccgcaactgtacgaatattcaactcggtacacgcccggaatattcggattgcaatttctcccctgtttgctactaatactttttgtatcgattgctgagacaaacttttctcccccttacccgaatggaatataatctatcatagcggaatatccttcccctgtacacacttgttttttacagataaacagtttttttgagctgtttctttttcattcccttcggcgccaagggctctttctttttcttattctctgaatatttcacaaacatgctgatattcgctaatatccccatactccccagcagcagcaccaaagaagagcccccgtaactgataaatggcagcgtaacccctgtaatcggaattaatccgctgacaccgccaaggttaataaacgactggatggcaatcatgcttgaaatgccgatcgccagaagacttccaaacgggtcctcgcattttctggcaatataaaaaccttttatgacgacaaaacccaataagaaaatcacaaacaataccccaaaaatgccgagctcttcagcaatgacagccataataaagtcagtgtgtgattcaggcagatatccgtatttttggatactttcaccgagccccaggccgaaaatgccgcctgagctgatcgcataataagaattgatcacttgcaaacctgatgaatttgcatacttaaatgggtcttcaagactctcaaaacgcgctaaacggccttcagttaaaattttgtcctgattcaaatagataatagggctgactaaaatgaaaacaattccgcccagtatcacaagcctcaccagcgtctttccgctgaagccggagcacaagatcatgcacgtcgcaattaaccctataatcatggctgtaccgaaatctggctgcatggcaattaacccacaaattataagcgtcatgactaccggaggggctactcccgttaacagatggtcgatataactttgtttttttgcatatacggctgcaaggtataaaatcacgaccagtttcacaaactcccccggctgaatactcattccgccgattttaaaccagctctgcgcgtttccggcaacatgcccgaaaacaaacagtgagataagcgcaagaacagatacaagcagtatccccttctgaaacttttgatgggccagtgctttataaggaaacaacgccatgagaataaatagagcgccacccgcaattaaagcaaacagctgccgcatgaagaaaaaattactgcttactccataccgggagacagccgtaatcatgcttgagctgtataccatcactaaaccgaatccgcataataaaacgattgcgaatatcagtgagtaatcataagattttagcattttttttaacataacatcctcttccctgcttctaacttccattatctatggtttttatgtatttatctttttattttactacaatttatcaaacgagacgaagaatctctatacgattcggaaggaatgtgtaaaaaaagaccgtcttttatgagatgagagaaaaatagcggttataaaaaaacccaaactgttaataagtttgagttttatcatttatttagctgtaaacgcgtcatgcaaagcagacaattcgcgctccaatgtgtataaaaggtctttaccgtctttttcatcaaccaatcccaggcggacagcaaaatcgatttccctcgaaagcccgaacatttgagtatctaaaaacctcttcatatagaggacattgaggcatcgttaagttatccatttgtactcggatcagcttcaaaatcttctcagcgtccacttttaagagttcaaaagctttttgccgatggtcaactatcatctctgaagccaaaagtatccctccgttccccaggcgagtacctaattcttctatttatcataaagggtatcaacagaaaatgcaagaggatttaagcatatgacataaattaaaaaatactcagcctgtacatctcagacattatttccaaaagctttacacctgcaatgctgttccctttttcgtctaatgcggggccgaatatgccgatcccgaaatcgtaaggcgaaatgcccattatcccgccggatacgccgcttttcgcaggaattccgaccttaattgcgaattccccgcttgcattgtacattccgcacgtcaccataaacgttttgcaaattctagcgacatcttttgagatgacctgctccccagtctctggatgtctgccgttcaatgcgaatacagatccgattttcgctaaatccaagctgttcatctcaatcgcgcattgcttcgtatataaatccattactgcctctacatcatcttcaaaaatgccgtactgcttcatataataacacatcgcccgattaatcattgaagtgctgtattcagattcagccacttcccggcagtatgtaatctcttggttgtttgtcagccttctgataaaagaaagcaaataatcaagtctctcttttaccgttcttccccttatcagacttgtcactaccaatgccccggcattaatcatagggtttaacggcttgctcggattcactgtttcgagcttgataattgaattaaacggatcaccggtcggctcctgtccaacataactgaagaccttatctttgccgtattccattaacaccaaagcaagggaaaggactttcgatatactttgaagcgtaaatgttttttctacgtcacctgctgacagacaaacattattggaataataaatcgccactgacaggtcgtgtttatcagcttttgccaaggcgggaatatagctggctacctcccccttgtccgttacttttttcgcctttttcactaaggcttcaagctcatcattatgctggcataccatgcaaacaccctcgttccctcagcatttcaatacacataatttgtacacaaagtgacaattcatgcgaaaacttttataattttgagagaagggggtcatatcatgagcgttatccaagtaaaaggcaatgttacatatccaattaccattgatccaagcgtatggatttttgatgatcgcaaattttcgtttgaccgcaaaggggacagtcaagacacatatttacaatcagccggggatgaatccgaccttgatccggaacgcgtcatcagagaggggcgaatcgcgccgcctacattaaagacggaaaagcaatatgagaagcaaaaactgatgaacggcagtttcgcaatgagacttgggactgtcctgaaaaatgctgagccgaacagctctgcgacacaatgtgtatttgtcacaagttcgggaaaggccgccgtttctctggaaaccgctctgaacagtattgtccatttcagtgaggcaggcaagccgattcaagaaggcggccccgtgcatatttactttgaagacccggttcatcacaaacagccgattaccgatgtaaaagagatcgaaatcatttaagtgttacagcaaatcagctgcaagctgggcgagacctgatctctcaccttttaacagcttcacgctgcctgagatgggttgtcctttaaaccgctcaaccacataggccaaaccattgttcagactgtctaaatatgggtgatcaatttgttcagggtcgcccattaagacaattttactgccctcaccgactctcgtcagcaacgttttcacctcatgcctggtcaaattttgcgcttcatcaatgataataaattgatctggaatgcttctccctctgatataagtcagcgcctctacctgaattgagccaattcccgccaaaatagcatcaagctcccctggttttttcgcattaaacagaaactctaagttgtcaaaaatcggctgcatccaaggctttagcttttcctctttttcgcctggcaaatacccgatgtccttgccaacaggaacaatcggccttgcgacgaccagctttttatatattcccaagtcttctgtctgtaatagccctgccgccaaagctaagagcgttttgccggttcccgctttgccgatcagggtgacaagcggaatatcttcccgcagcaaaagctctaatgccattgtctgctgtacatttttcggcctgattccccatatatgttcatcatcaaatacgagtctttttaataccgttccggttttgtctgcaattccgactgccgaggaggaccctcctagctcatccttcattaaagcaaactgattcggataaaacgcatgctgtttcacatcgtttactgaaatttgatttttcccgtaaaaagagctgaacagctgctggctgatatataaatctttatagccgctgtacatttcatcattgtccacaacccggtcattcaagaaatcttcagcaagcagtccgattgcgtcggctttaaccctgaccagtacatccttactgacaaggataaccggcctgccattttccttggtttcttcctcgaggcttaagtttttcgcaacggctaatatgcgattatcgttcgtcttttcaataaagatctcttgcagctggtgaaacgaacgatgattcagttcaattctcagtgtgccgccggtgtcaagcggtacatgctcatgcagcctgcccttttgtcttagcgcatcgattagcttagatacgtgccttgcattcctcccaacttcgtccatataccgtttttttgaatcaacctcttctaaaacgacagcagggatgacaacctcattttcttcaaaagaaaatatcgcgttaggatcctgtaataacacattcgtatctaacacataaattttactcaagtctcagcctcctgatataagggtcaaagttcttcctgcttctcttttgatgaaaaaggtgaatgcctgctaaaatatatgtttttgtgcataaagatagaaggttaattcaacaataaaattaatgaaagcattttaaggagggaacccgcaagtgcgaattcttttcattatcatacagctgacacttatcctgtccgcttgtgcctatcaacaaggaaaacagggccagaatgttgaaaaagaatcaacaagacagcaggagactaaaccgattcacgtaaaggacacaactcaagaaacaaaagacaatggaacaagaacggatattgccaagcatcttgtcagcgttgctgaaaaaaaccccgacgtcaaggatgcaacagccgttgtgctgggaggctatgctgttgttgggattgatgtcgatgatactttggacagaagcaaagtggaaaccattaaatattctgtagctcaggcgctaaagaatgatcgatatggcgccaacgcagtagtcattgctgatcccgatacggtcagccgccttcgcgaaatgagcagagaaatcagcgagggccatccggtaacaggtatactggatgaattagctgcaattgtcggccgagtgcttcccgaagtgcctaacgatgtgattgacaatgaagatgaaccgcaaacaaagcagcaaaatgaccaattaaatagaaaacagcaacaggaaatggagaaggaacaaaacgatcaatctgatcatcatatgaaaaagaacaacaatgactaagctatagccttgcgctttagctttttcttattttggacagcttctgatccgtggtataatacatgttagtgaaagaggtgatatgatgagggtcaaatgttctatttgcgataaaattgaaacaattgatgatgataccctgatcgcgaaacggcttcgaaaccgcccgatccatacatatatgtgccaggaatgccacgatcggattgccaaaaaaacagaggaacggctgaaaacgggaaaatttacttttcacccgggacagcagaaaaagaaaaagtcaaaaaataaagcggccgcttaaccatacagaacacaaaaaagactcagctttcagctgagtcttttatgattttgcagactgtccttttttcgactgatacagccggattttgtaaatgattaaaatcagcgcagcgacgaccaatccttctgccacgggcaaaaacacccctaaaaaagtcaaaacagtgcagcccaaagccaaaaatacatacaccactgcagattttaatacaggaagccgtttagcaaatccaagcttaaatacaataacggccaacacaaaaatcgtgccgtacagcagccacatgcctgccgcaggctgccggtctacttgatatagagcggcgaagaacgacaggcgttcgcttacgtcattcaaaaagattccctcccctgtaaacgtacgggttctatcttttcaaattctgcacgagattaagacaatcctgctgtttttttctttttagctgctttttcacgttcgttcttattgaggatcttctttcttaaacggatggattcaggtgttacttcacaatattcatcttcgtttaagtactctagagactcctcaagagacatgatgcgcgcttttttaattgtagttgtctgatcctttgtcgcagaacggacgtttgtttgctgtttcattttgctgacgttaacaacaaggtcgttgtcacggttatgctctccaacgatcattccttcgtatacttcagtacccggctcaacgaagatgacaccgcggtcttcaattccttgaataccgtatgatgttgcttttccgttttccattgacacaagtacaccttgacggcgtccgccgacttggcctgcctgcatcggctggtagctgtcaaacgtatggttcaaaataccgaatccgcgtgttaatgataggaattctgtagagtaaccgatcaatccgcgggaaggaactgtaaagatgagacggacttggccgtttccgttgttgatcatatcaaccatttcgcctttgcgggcacccattgattccattacagagccagtatgctcttcaggaacatcaatttgcacacgttcaacaggctcacagcgtacgccgtcgatttctttgataataacttcaggttttgacacttgaagctcatagccctcacgacgcatattttcaattaaaattgacaagtgcagctcaccgcgtcctgaaacaacccaagcatcaggagaagctgttggctcaacacgcaagctcacatccgtctgaagctgtgattgaagacgctcttcgattttgcgggccgttacatatttgccttcacggcctgcaaacggactgttattcacgacaaatgtcatttgaagtgtcggctcatcaatgcgaaggaccggaagcggatcttgatggtctacaggacataccgtttcaccaacgttgatatcttccatcccggaaaccgcaacgaggtctcccgcttttgcttcttcaatttccacacgctttaagccttggaaaccaaaaatctttgtaacacggaatgactttgccgttccgtcaagcttcataagagaaacctgctgtccgactttcattgtgccgcggaatacgcgtccgattccgatacggcctacatagtcgttgtagtcaagaagggcaacttggaattgaagcggctcctctgcattatcaacaggtgccggaacatgcttaataatggtttcatataaagcttccatgttttcatcctgttgtttcggatcaagactcgctgttccattaatcgcggaagcatataccactgggaactcgagctgctcttcattggcatcaagctcaatgaacagatccagaacttcatcgataacttcctctggacgagcaaagtcacggtcaattttgtttacaacaacaacagggttcaggttttgctcaagagcttttttcagaacaaaacgagtttgaggcatacagccttcatatgcgtcaacgacaagcactacgccgtcaaccattttcataatccgttctacttctcccccaaagtctgcatgtccaggggtgtccaaaatattgatacgtgtatctttatagttaatcgcagtatttttcgccaatattgtaatgccgcgttcgcgttcaagatcattagagtccattgcgcgttcagcaacctgttcgttggcacggaacgtaccagcctgatgtaaaagctgatcgactagagtcgttttcccatggtcaacgtgggcaataatcgcgatgttgcgaagatcatttcgaagtttcactttttcatctcctaaaaaaattagataactttcatattatatcacacatcctctttaaaagcgtcacgtttttctgtaaacttaatataagacgtaaaaggggatggaatttatgaaaaaaatgaattggcttttactattatttgcatttgcagcggttttcagcattatgctgatcggcgtctttatcgctgaaaaaagccctgcaggcattatcgccagcattgtacttgtttgcgctgtcatgggcggcggatttacattaaaaaagaaaatgcgcgaacaaggcttgcttgattaaaagcattgccccgccggcgacattgtaatcaaaaaacaccgcaaagaaagcggtgtttttcatttctttaagccttatctcccctgtttcttagtcaggaagatgcaaaacagccttcatacatagacaatcgttctaacgatcacacgtgcagccttcaaaaagtagttcggcaacgatacacataaaataccatagcgcctattcctccaccggaaactactccctataatggaatttgtagcacaattcataaaagggagagaagaaacatgaagaaaacatttgtaaaaaaagctatgttaacgactgccgcaatgacctcagctgctctattaacgttcggtcctgatgcagccagcgcaaaaacaccggttgataacactgctgttcaactccagcatcaggcgagcactaacgaagatctcaatacattcattgatatattaaatcaatgtatatacgaacaagacggtgtatattattttgacagcgaaaaagctgtcgagttaggaatgacaaaagaagaggctcaggtaattgctacactctgggaatcgacatcagaatttttcagcattgtttcacaatgtgtgtatctcgaggatggaaattacaaatttgatacagaaaaagcagttgaacttggcttcacagaaaaagaagcacttgcacttgaacaatttttctccgctgtttctctcaagattcacattcttcaagcagccattgtgctacaagatgatgtgtacagctatgataaagacgcagcgctacaagcaggtgcaacgccactgcaagctgacgtttatgaaaaactcttcagtgccctgtcacaagaacagcttgccgctatttacgatatgattcatccccaggcttaatgtaaaaaagcgcttgccggaatcggacaagcgctttttttatatcagcagtttgatgatcagcatcatggcaaccgccgctccaaaccagcaggcagctttcatgatcagtaatccatagtacctctgtttaaaacgcagttcttcttccggcagataagcctcctcaacggcctgttcgctttccaattcaaatggctcagccatcgtgtcatacatgtctctgcagctgctgcacatttttaaatgctcttctataacgtgttccgtttctcttttacaatcaccttcaagatacagaggaagcaggtctcttactagaaagcaggtcatatccgctcctcctctctacttttcgtcatgtttttctttagctctaatctagcccggtgcaatgtggtattcaccttagaaagactccatcctaatatctcagcgatttcttcataagaaagctcttggaattctcttaaaatcaaaacggattgatgctgatcttttaacttcaggagctcctgccgcagtgtttcgcttttcaccgtccgtgacagatactgttcaggctggtcataagttgtttgcgttaacccttcatttttgctgatttcagtaaattggtatttgacatcccttcggtaccaattgataaaggtatgatgcgcaatggtgtagagccatgttctgatggaagaatgccccctaaacgaagccagaccgttaagagcttttacaaacgtgtcctgcgctaagtccttggctgtttcaagatgatgagtccttctgaataaataatttaaaatttcttgataatactgccgatacaagtcctcaatggaatccctatgcttcattaaaaataaaaccacaccgtcatccaaatggccaataaaatgaaacagatatacatggaagacaggtatactttcatatatctgatttggctttcttcttcagcaccgggacttctctttaaacaagttttactctttaagtcttccgcattcttttgaaatagggattcatgctgtttcatccattccattgattcatcctctagctctccttctttatacaggtcgtataagtctacaaaaacagactctttttctttatgattcataaagacttttcacctcttgtgtttctccatccactacataggcatcatggcgatttgaaccaaacggctgaataatgatcagccatgcataatgccgttcatcccctctttgaacgataatcggacgcatacgctttttgtaaatgacatcctgatatagagaagctactttttcgtaagccaatgttccattacgatacgtataggggaatgactgatcaggtgtatcgctgtatacataaacgtttagctgaccttgagcttcaacaaactcatatgttttagaagaatcagtatacatcaccatgtcaccctgactgctttttttcttcttttctgatccacgagcatcgaagatcgataatatctgatgctgcagccggctgttagccattgagatattctttttcatcggaagcgaaagactatgtaaacaacctgattcgccctcaaattccaaaacaattccaacttttgtttcaactctcaccatgcttccaagcaggctgtcgctttcaatatcagtgatctgataaggctgttttgatatgttcagcgctgtaaacatttgttccactttgtcgtgaatgtcttgttccgttatatgaacatgcagaagagagtcaagctgataaatcgaaggatcttcactaaaccccattaaggtttccttttcccaataaaataccgcgccatcatcagcatgatcttttttatgaagttgatttttcaggtaaatacgtacgactgtctggccgtcttcttgagatacctttgtttcgatatgatccttatgtaacacacgtccgtgtcgctcaaggaaagcgatggactttcgcttgtactcctgattcgttagctttttcccatgtgctttttgtaagtattcataattacgaattagctgcgatacttcatctacctcagctttgtaacctttgctttcaaatgagtagaaataatgcacatccatgtttgtatcgtgcaaataaagtgtttcatccgtaggaaaaaatgactttagtatctgttccgctttttctgatgaaatgtgctccccgacaaaattgaatgaatcatggacatttgctggctttgatacagcgaaagcagccgttcctatgttatatatcggatttaacagcaggacaaaaaacaccatgacagccatcgtcacccacttattcacacgcacataaacctttcctgacttttggaacagatgatagctcatcaaaaatcccgccattgccaaataaatcgtatatggcattactgcaccataatcttttgagatttgattgggatatggcgcaagcagcaagacaagcagtccgataatcagcgtataaaataagcctagtaagatcttatccgttctccaatacagcttgaaaaacactacattcaacgcaatgggaagagtgatgatgaaaaacagaaacacgaatgcaatcggctccatcccatccgggtattccttccaatacgaaaagaaactaaaaatcatttgtacgatcggcaaactgacaacagcaaggtcgaacgtataaaacttaccctttccgccatgatcacgcggcatcagcatatagtgaaaagccgtcagcagcacatatccgtataacaaaaaatgcagcagcggcagcagttcttttccgtcctctcttaagtaagcgctggtgaagtttgttgattgcacctggtgaataagttcaacagacactcccgccagcagcacaatccgcaatataacacccgccaagaacattgtgcgctgccggtttattttgggatgatgcaccaaaagatataagcccgccagaacaacaattgaccattgaatcagcagggtgctttgtctgcttaatataaaataacgttcgaaatgcaatacataatgactgaataactccaacacgaacaacaatcctttacttcttattaaggcctcattcggttagacagcggacttttcaaaaagtttcaagatgaaacaaaaatatctcatcttccccttgatatgtaaaaaacataactcttgaatgaaccaccacatgacacttgactcatcttgatattattcaacaaaaacaaacacaggacaatactatcaattttgtctagttatgttagtttttgttgagtattccagaatgctagtttaatataacaatataaagttttcagtattttcaaaaagggggatttattgtgggtttaggtaagaaattgtctgttgctgtcgctgcttcgtttatgagtttatcaatcagcctgccaggtgttcaggctgctgaaggtcatcagcttaaagagaatcaaacaaatttcctctccaaaaacgcgattgcgcaatcagaactctctgcaccaaatgacaaggctgtcaagcagtttttgaaaaagaacagcaacatttttaaaggtgacccttccaaaaggctgaagcttgttgaaagcacgactgatgcccttggatacaagcactttcgatatgcgcctgtcgttaacggagtgccaattaaagattcgcaagtgatcgttcacgtcgataaatccgataatgtctatgcggtcaatggtgaattacacaatcaatctgctgcaaaaacagataacagccaaaaagtctcttctgaaaaagcgctggcactcgctttcaaagctatcggcaaatcaccagacgctgtttctaacggagcggccaaaaacagcaataaagccgaattaaaagcgatagaaacaaaagacggcagctatcgtcttgcttacgacgtgacgattcgctatgtcgagcctgaacctgcaaactgggaagtcttagttgacgccgaaacaggcagcattttaaaacagcaaaataaagtagaacatgccgccgccactggaagcggaacaacgctaaagggcgcaactgttcctttgaacatctcttatgaaggcggaaaatatgttctaagagatctttcaaaaccaacaggcacccaaatcatcacatatgatttgcaaaacagacaaagccgccttccgggcacgcttgtctcaagcacaacgaaaacatttacatcttcatcacagcgggcagccgttgacgcacactataacctcggtaaagtgtacgattatttttattcaaactttaaacgaaacagctatgataacaaaggcagtaaaatcgtttcttccgttcactacggcactcaatacaataacgctgcatggacaggagaccagatgatttacggtgatggcgacggttcattcttctctccgctttccggctcattagatgtgacagcgcatgaaatgacacatggcgtcacccaagaaacagccaacttgatttatgaaaatcagccaggtgcattaaacgagtctttctctgacgtattcgggtattttaacgatacagaagactgggacatcggtgaagacattacggtcagccagcctgctcttcgcagcctgtccaaccctacaaaatacaaccagcctgacaattacgccaattaccgaaaccttccaaacacagatgaaggcgattatggcggtgtacacacaaacagcggaattccaaacaaagccgcttacaacaccatcacaaaacttggtgtatctaaatcacagcaaatctattaccgtgcgttaacaacgtacctcacgccttcttccacgttcaaagatgccaaggcagctctcattcagtctgcccgtgacctctacggctcaactgatgccgctaaagttgaagcagcctggaatgctgttggattgtaatattaggaaaagcctgagatccctcaggcttttattgttacatatcttgatttctctctcagctgaaacgacgaaaagatgctgccatgagacagaaaaccgctcctgatttgcataaagagggatgcagccgcaagtgcgcattttataaaagctaatgattcagtccacataattgatagacgaattctgctacaggtcacgtggctatgtgaaggatcgcgcgtccagttaagagcaaaaacattgacaaaaaaatttatttatgctaaaatttactattaatatatttgtatgtataataagattctcctggccaggggaatcttattttttgtggaggatcatttcatgaggaaaaatgagtccagcttaacgtctctaatttcagcttttgcccgtgcatatcacagccgatatgacacacctcttatttttgatgattttatcgcaaaagatctcattaacgaaaaagagtttatcgacatcagtaaaaatatgattcaagaaatatcgtttttcaacaaagagatcgccgaacgtcttcaaaatgatcctgaaaaaatattaaaatgggttgcacaaatccagctgtctccaacgcccctagcacgtgcttcttattgtgaaaaagtcttgcacaacgaattaatcctgggggcaaaacagtatgtcattcttggagcgggactggatactttctgctttcggcatccagaattagaaaacagcttacaggttttcgaggttgatcatccggccacacagcaattgaaaaaaataagctgaaggatgcaaatctgacaattccgggtcatcttcattttgttcctatggatttcaccaaaacgttttcgtatgatcctctcttagatgaaggatttaaaaacacaaaaacattcttcagccttctcggagtgtcttattatgtaacacgggaagaaaatgcaagcttgatcagcaatttattttctcatgtcccgcctggaagctctattgtttttgattatgcggacgaaacactttttacagcaaaagggacgtcgaatcgagttgaacatatggtgaagatggctgccgcaagcggggaaccgatgaaatcatgtttcacttatcaagagattgaacatctgttagagtcatctggtttactgatctatgaacatctatcaccagacgacatcaatgaccttttctttagtaatcgaaaagacaatttgtcagcgtttgaaacgattcattatattcatgcggtaaaaaaataattttcaaatcatcagaagcctctcaatgtttgagaggctttttattgaacccgcatgcagcaaataagctgccattatcatacggcagcttctgctaaaggcttcaccaagatcataaatgatttgcctttctcatctttttccgttttcagctgttcaaagccgcattggcttaaaaacagtatccattccctgcgctcaataggaactcccgcaaacatcgctttatgtttcgctctaagcaatttgctgatctgttcaatgatcatcttcgcatgtccctttttttcttcagccgggtcaatcaggaccgttccgagccacggcttaccgtttgaaggagaccactcgagatggtagctgacggcaacaggcataccgtctttttcccatacaagccatgaaccgttgtacatggagtaggaaatgatatagtcttctgcatctttatctccaaactcctcctctttccatacaggatgagcctccgcgagcttttctaacaagctgagatcatcctgctcaaatggcctacttccgagcatgaagatactcttcaaatatcgttttatgtatagatgggtttccggctagcacactgtggttttctaaaaaggtaaacggctctccttcaatggtcgtataggtgcctcctacttcatttaacagcacacagccggctgcgtagtcccatggcgcaagccgcatcgtgatgtaagcatctattcttcctgccgcgacatttgccagctctaaagcggcagaaccgtaggagcgtgtgcctctgactcttttcacaagtggcgctaacacactttgatcaattcttctgttttccgttacccatgttgcattaatggcaagaatcgcttcttcaatgacggtttcttttaatggagccagcttcgtttcattcatataagctcctctgccgctaaatgcgtgatacaactcatcgtgcaccacatcataaattaaaccgattttaccttcaccgttttcaaaaatcccaatggaaatcgcaaaatttctttgctggtgcacaaaattcatcgtcccatcaatcggatcaataatccatacgactccctcaagtgagtggattttgtctccttgcccctcttcaccgagtatccgatgtcccggaaatgtttcttgaattcgatcaatgaaaaacttttcggtttctttgtcaatattggtgactaaatcattcggatttgatttcgtttcaattgtcaggctttcatgcatggattgtgtaattctcgcgcctgcttctcttatccatttctttgcaatctcatcgatttccgtccaatttgtcattcgttcgtacctctcttctatgtagaccttttattttataggatactgataacggcaatgaaaaagcaaggaaaatgaaaaatatcccttctcacgtaaaaacgaaccattcatgcggttcgttttcactatcgcttttttacccgttaagacgaatccattcttttctaagtcgctcaagtttgtttttgctttgttcaatctgctcttcattttctttctgcattgcttcatatagggttgccaattcataatcaacctctagtctccagacagcaacacgattgtttttctcttccttaaatccctcttttacaacttgcctcattgtctttcgccccttccagagatcatttgtttgtaaaaaagcatcccattttgccattcaacaatgattacttcttatatcgtatgattgttctatttacgcgcaacatgattctgaaaattgtgtgtttacctactcgtttattaccacatttctccttacttcaaacgcgctcaatctttttgaagctcgtatgaactgtgataaaatatgtatacttagcatgaaggaggaaaatcatgacacaaatgcgtttcactgaagaagactttaacacatttacaatagaaggcttagacgcgcgcatggaagtattaaaagagacggtccgtccgaagcttacagctctaggcgaacattttgccccaactttatcagctttaaccggagatgaaatgtttccgcatgtggcaaagcacgcaagaagatccgtcaatcccccggctgacagctgggtggcgttcgcaaacagcaaaagaggctataaaaaactgccgcatttccaaattggtttatgggaaagccacgtctttgtatggttcgcgattatttatgaatcccctatcaaagaagaatacggcaaattgcttgaagtgaaccaagaaaccattacgaaaaatatccctgacagcttcgtttggtctgcagatcacacaaaaccgggagtacataaacagtctgaaatggacaaggaacagctgaagacactgtttgagcgtttgcagactgtaaagaaagccgagctgttatgcggcatccagctccaaaaagaagaagtgctgaatatgaataaccaggaattccttcagcgtatcgacgatgcctttaaacagcttgcttttctgtaccgtctcacccaaaaagtaacacaagcataaaaaagagccgggatatcccccggctctttttcttacatcttaatcttcgcgtgatcagattctctcgcctgtttgaccgtgcgataaggagaatatgtactttgttcctcaaactcgccgcatagcttttttcttcggccttccccggtacaatttccttgaaacggcggtaagctttaagcagttcttcacgatccgcccctttttcatatgcaagctcaacctgctggaaaaatgcaatcacatccactgcttcttcggttgtccaatcttcattcatcggatattgatactccattttcttcactccttgtagatttacttcccttaagagaaagcatcttcatttgatcataaattgttctttacattctttcaagttcataatataattcatttgttttacgtctaaaaaacggttgagaaactgattttaatacacactattatgcataggtatgattacaaaggtgggaaaacaattgtcgcaacatgaaacacccttatacacaggactgaaaaagcatgcaagcagacagcctgttcaattccacattcccggccataaaaaaggggcaggaatggacccagaattcagacaatttatcggtgaaaacgcgttaagcatagatttgattaatattgaaccattagacgatctgcacgcgccaaaaggcattattaaacaagcacaagatctggctgctgaagcatttggagcggatcatacatttttttctgttcaaggaacaagcggcgccattatgacaatggtaatggctgtttgcggacctggtgataaaattattattccaagaaatgttcataaatcaattatgacagctattgtattttccggagcggttccaatttttattcatcctgaaattgacaatgaattgggcatctcccacggaattacacttgaatctgctaaacgggcgcttaccgagcatccggatgcaaaagggcttctcgtcatcaacccgacatatttcggtgttgcagccgacttaaaaagcatcgtagaactcgctcattcgtttgatgtgccagtgcttgtggatgaagcacacggcgttcacattcattttcacgacgaattgccgctatcggctatgcaggcaggagcggacatagcagcgacaagtgtacacaagctgggcggatcactgacacaaagctctattttaaacatgagagaaggccttgtatctaaagacagagtgcaatccatcctgagcatgctgacaactacgtcaacttcttacttgcttctcgcttctttggatgttgccagaaaacgccttgcaacagaaggccgccagcttgctgaggaaacactcaagcttgccaatcagacgagagatcgcctcaatcagattgaaggcatttattgtgtcggttctgagattcttgggtcgaaagcagcttacagctatgatccgacaaaattgattatctctgtgaaaagtcttggcctgacaggacatgacgtggaaaaatggcttcgtgaatcctttaatattgaggtggagctttctgatctgtacaatattttgtgtattttcactcctggtgacagccaaaatgatgcagaccggcttgtagaggctttaactgagatcgcacagcaaatgtcagaacaagatgtaacacatcagcaaactgaggttctgcttccagaaatacctttattggcaatgactccgcgtgatgctttctatgcaaatacggaagtcatcccattaaaagaagcatccggacggattattgctgaatttgtcatggtatatccgcctggtattccaatcttcatcccaggagaaattattacagaagaaaacatcagctacatttttaaaaaccttgacgcaggcctccctgttcaaggacctgaggactcgactttacatatgatccgggtcatcaaagaacaaaaagcaattcaataaaaactaaaaagcatgcggctttaagccgcatgcttttttttactcttcatcaacaggacattgacattgtccgcagcaagttccatataatgttgtcactttctcatcttcaaagtaatgaatggcttcgttgcaatcttggcaaacaatcgtacccatctcttattccccatttctttgaaatttgaaaacgcttaatttcttttgttgttattatattaatatgtcacatttaaaatgtcaacaacaaactgtataacacattttatttcatatcatcatattcaccttgtttttccattttccatcatacaatatcttcttcatacagaagctttactcgatatatatgccacagcacataatgtaattgcacgttttcttgaactttcatccaagaatgcagcaaaaaattcaatataccccaggttgctattttaaacgattgatataatatgtaatctcactttaaaaacggtttcaattatataacaattaggtaacaagaagcagattaagccgtctctcgtgataaactaaagctagttaactactgtttatacagaggagaagatagatgcgatatcgcgcggtattccccatgctgataatagtatttgctttatcgggctgtacgctttccaccatcaatccgatgaaaaaaagccggattgacaacattcatcatacacaaatcctgtttttttctgatgagaaccaaatagaccaggaagcgccttattacgatgcactgcttgatttagaaaaagattatcccgagcaaatagataaaatgaaggtctatgataaaaaagaaggctgggaagatgagattgaaactgtccctacccttatggttgttgatcagcgccatgtcgtggtgaaaatcgagggatgtgtgaaaaagaaagaagacatcattaaaccattacagcatgtgctgtcaaaataaaaaaacagccctcgctcaaagcggggctgtttttgatatgaaaattattttacgatgtgaatcggacttccgattgccacttcagcagcttccattgtgatttcgcccaatgttgggtgagcgtgaattgtcattgcgatatcttcagcagtcatgccgccttcaatcgctaagcttaattcagaaatcatatcagaagcacttgctccggcgatttgcgcaccgatcacaagaccgtcctctttacgagtgatcagcttcatgaagccgtctgtttcgttaagagaaagcgcgcggccgtttgctgcaaatgggaatttagcagcaacaatgtcaagaccttcttctttcgcctgtgcttcagtgtaaccaactgatgcaagttcaggctcagagaaaacaaccgcaggaataccaaggtaatcgatttctgcaggctctccagcgatagcttctgcagcgattttaccttcgtaagatgctttatgagcaagcggcggtccttcgatgatatcaccgattgcataaatgttaggtacgtttgtgcggcactgtttgtcagttttcacgataccgcggtccgtcatttcgataccgacttgctcaagaccaagctcatcagtgtttggacggcgtcctactgtaatcaatacgtaatcagcatcaacagttttttcttcgccttttacttcgaaagtaactgttacgccgtctggtctttcttcaacgcctttagccatcgcgtttgtatggatttcaacgttgccttttttcttcagtctgcgtgtaacgagagaactcatttgtttttcgaagccaggaagaatttcatctccgccttcaagaataacaagttcagtaccgaagttagcatacgcagttccaagttcagttccgatgtatccgccgccgataacaacgagctttttaggaatttctttaagagccaaagcgccagttgaattcaggacacgctcactatatttgaagtttggcaattcgataggacgagaaccagtagcaatgattgcgtttttaaacgtgtatgtttgagcagagttctcatccataacacgaactgaattgctgtctacaaagtaagcttcaccttttacaacatctactttgttgcctttaagaagacctgctacaccgccagtaagcttgttgacaacagaagctttccattcttgaacttttgtgaaatcaactgttacattctcagcagtgattcccatgtcatcagaatgttttgcattctcataacggtgacctgcattgatcagcgcttttgaagggatacatccaacgttcagacaaacgcctccaagagttgctttttcaacgactgttactttttgtccaagctgtgcagcgcggatggcagctacatagccgccaggtcccgcaccaattacaagagtatctgtttcaatagggaaatctcctactaccataacattacgcctccattaaaattaattgtggatcgttcagtaaacgcttgatgtgatttaatgcattttgcgcagttgctccgtcgatcatacggtggtcgaagctgagagaaagagctaagactggagctgctacgatttcgccatcacgaacaatcgctttttctgcaatgcgtccgataccaagaatcgcaacttctggatggttgataaccggagtgaaccattgtccgccggcagaaccgatgtttgtaattgtgcaagatgcgcctttcatttcagctggagcaagcttgccttcacgagcttttgttgcaaggccattgatttcatcagaaatttcaaagacagatttacgatctgcatttttcacaaccggtacaagcaagcctttttcagtgtcagcagcgataccgatgttgaagtaatgtttttggatgacttcatctgttttatcgtcaattgacgtgtttaaaacagggaattttttcagtgcagatgtaagagcttttacaacgtaaggcaagtaagtcagcttgattccttgatcagcagcaacctgtttgaactgtttacgatgtgcaacaaggtttgttacgtccacttcgtccattaacgttacgtgaggagcagtgtgtttagagttaaccatcgcttttgcaattgctttacggataccgctcattttttcgcgtgtttctgggaattcgccctctggagctggtgcagcagccggtttagcagctgtttcttgtggtgcagctgtttcttgcggtgcagcttcttgcgctcctccgtttacaaagctgtcgatatcttcttttacaacacgtccgttgttgcctgaaccagtaaccttacggatgtctacacctttttcacgtgcatatttacgtacggaaggcatagcgatcacgcgtttgttcgggtcaacttcagcttgatcctgctgtcctgcgccagtagcttttgcaggctcttgagcttgctcttctttcgcaacgtcttgtccagcttctgcagttgactgaacttgtgcttcagttttcgcatcgtcagactcgtcgctgcctttaaattgaagatcttcgtaaccaggtgcatcaaacgtaataatcgtttgtccaacagttgcaaccgttccctcttcaacttttaattctaatacttttcctttaacaggtgaaggaatttctactactgctttatcattttggacttcagccagtacatcatcttcgtctacctcgtcgttaggcttgacaaaccattttacgatttcgccttcgtggataccttccccgatatctggaagtttaaattcaaatgccacagttctcgacctcctagtttgattaagcaattttaaagtttacatcgtaagcattgaaaacagatatataatagagggaaaacgttcatcttccctctcgattatgcagtttgattaaaattcaagcacttttcttgctgtttcaagaacgtctttatggtttggaagccatacgctctccgcttgagagaaaggaaatactgtatctggcgctgcaacgcgaagtacaggtgcttccaagctcaggatcgcacggtcattaatttctgctactacgtttgcagcaataccggcttgtttttgtgcctcttgaacgacaatcgcgcgtcctgttttttctacagaggcgataattgtatcgatatcaagtgggcttactgtacgaaggtcgacaacttcagcagaaatgccgtctttttcaagctcatcagcagcttttaatgattcatgaaccattgcgccgtaagtgatgattgaaagatcagtaccttcacgtttcacgtcagcttttccaagctcaattgtgtattcttcttcaggaacttcctgacggaaagaacggtaaagcttcatatgctctaagaagacaacaggatcattgtctctgatcgcagaaattaaaagtcctttggcatcgtaaggagttgatggaataacaactttgataccaggctgttgtgcaacaagaccttccaagctgtcagcgtgaagttcaggagtatgaacaccgccgccgaatggagaacgaattgttacaggtgaagtccagcgtccgccagaacggtagcgcatacgagccatttggccagaaactgaatccattacttcataaacaaatccgaagaattggatttccattaccggacggaagccgtttaagcctaaaccaagggcaagaccgccgataccagattcagcaagtggcgtgtcaaacacacggtcttcaccgaattctttttgcaatccttctgtcgcacggaatacgccgccgtttacaccaacgtcttctccgaaaactaagacattttcgtcatttttcagttctgtgcgtaacgcatccgtgattgcttgaatcattgtcatttgcgccatggcttacttcgactccttctgtgtataaatttcaaattgctcctcaaggttgtgaggcattttttcgtacatgattttcattaaatcagttactttttgcttcggttcagcatcagcttttttgatcgcttgcttaatttcttctttcgcatcctcaatcacttttgcttcttcttcttcagaccataagcctttgttttcaaggaacgcacggaaacgtacaagcggatctttttgttcccactcattttcgatttcttttgtacgatatttagtaggatcgtcaccagccattgtgtgcgggccataacggaatgtaagtgtttcaattagtgttggaccttcgccgttgattgcgcgctcgcgtgcttcagcagttgctgcgtatacagcaagcggatccattccgtctacttgtacgccgacaataccggcagctacagctttttgtgcaattgtttcagctgcagattgtttttcaacaggagttgaaatcgcgtaacggttgttttgcaccacgaagattgcaggtgctttataagctccggcaaagttaattccttcgtagaagtccccttgagaagctccgccgtcaccagtgtaagtgattgcgacagctttcttaccgcgttttttaagacctagcgcaacaccggcagtttgaatgtattgagcaccgataatgatttgtggagaaagggcattcacatcatcaggcatttggtttcctctgaaatgtccgcgagagaaaagaaacgcttgatataatggaaggccgtgccaaattaactgaggcacatcacggtatccaggaagaacaaagtcttctttttcaagcgcgaaatgcgttgcaatctgagaagcttcttgacccgcagtaggagcgtaaaatccgagacgtccttgacggtttaatgagatagagcgttggtcaagcacacgcgtaaataccatgcggcgcattagctcttttaattgatcatcagttaaatcaggcatcgccgcttcattcacgacttctcccttttcatttaaaatttggaacgtttcgaactgctttttaatggcatcaaattgcttcttactgtcaacgatagcttttttcgtttttgcagccatactaagtcacctcttcctttcttttaaacagtcattagacgtgcattccttttatacatacaaacttagggtaccctaaagtatcagcagtaagtcgtattatattttagccgatccccagtttgccaaaaccttttatgtaggatagttacactctgctttgaactgtattatttcgaagttgtaaaaaactaatacaacaccgcttaacatggattagtttacaccaaataaagaagaaccgtcaatcgttttcatcgctgattttcaataaatgtattcgctttacattttcatcaaaaaaacagatgccaaccgcacccaaaactgtactagtataccttactatgctgtactacaatagaaatgaaaattttgaacgaaatccgaatcgcatttcattcaaaaaaagagctgatcgagtcagctctttttcacacgatagcctgcagcatcatataaatcttcccgggctttattatatttttcggtttgttcattaaattctccgctatatttaaggatcttttcataagaagcattgactttatcgatctgctgatccagatcatctcttgtcaaatctttgtctttcagctgcatatacagttttttattaagctcaagcgcttttttatactctttatacatagtgccatatgatgtatatcttttctccatatggtttgctgcggcatcggccttttcttttatgtctttttccttaatatgttccgctgacgtttttgcttcctcaaattctgtttccgattttttcatgctgtcattttcaagctttaggtgttcttcgcgcttgctgacattttcaagcgccttattagataaagcaacaatttttttataatcatccatattgagcttcataacactatcgtaaagctgattttctttggcctctaattctttgagtgtgttttgttcttcttgaaacggcttttccgattccgcggctttttctaatgaatgatgaagtgaatcaaccgggtcctgtcccatgcatcctgttaatatcagtgccatggcacaaaaagctccgatcttgattccaggccgccgttttatagcgtctttcacgttaaatcccccaatcttgacaatttctactatagaatccatggggacatttggcaatagccgtgctgtataaatgcaatactgaaattaaatcaaaaaagtgaaaaatcaggacagatgaccatacaacttttttgtttttacataggttatattagacgctatgcctacttataaaggctctggcgtaattaaaagaggaggttatgtaatatgtatggatatggttacggcggaggctgctgcagttatggtggttacggatatggtggctgcggatatggctacggccgcacctttgcgctaatcgttgttttattcattctgttaatcattgtcggagctgcttatttaggtggaggctgttgctaaccacacagcatgaaattgaccagccatatacggctggtcattcgtttcgttgcacctttgtgaagaaatccgatataatttacatattaagctttaggagtgaagtttcttgattactatggaaaacatcgtacgtgacggccatccagccctcagagagactgccgaacctgttgagctgcctccaactgatgcagaaaaacagcagctggccgacatgatcgaatttgttaaaaacagccaaaatccagaattagccgaaaaatacaagctgcgccctggcgtaggactcgcagctcctcaaattaatatcaaaaaacgaatgatcgccgttcatgcggaagatgcttccggtaaattatacagctatgctctgtttaatcctaagatcgtcagccattcagttgaaaaaagctacttaacaagcggcgagggctgcctctctgtggatgaagcgattcccggttatgttccccgctatgctcgcatcagagtaaaaggaacaacactagaaggcgaaaatattgatattcgtttaaaaggatttccggctattgtgtttcagcatgagatcgatcatttgaacggcgttatgttctatgatcatattgataaggaaaatcctttcaaagaacctgaaaatgcaatcgcaattgagcgctaaaagagaaaacggctggcacaatgccagccgtttctttattttaaaaggcccaattctttgacagcgtatgcaattccatcctcgtccaccggttttgttacaaagtccgcgatttctttcagttcgggaacagcatttcccatagcaacgcctgtcccaacgtattcaatcatttgcaaatcatttaatccgtcgccgaaagcatatgtatcgccgatatcaaacggaagacgctcaatcacttttttgattccttctgccttcgaacctccgtgcggcagaacatcagtcgatagctcatgccagcgaactagatcaaactcaggaaaagcggcataagctttttcttcttcatcctgacaaaataaaagaagctgaaaaatttcttttccttcataaaaaaggtcatcggtctctggataatctgttttaaggctgccgattccctcgagaacatgggggtgatccgcaacagtcgctttcatcgtgtcctcagccataaacacaacaggatgcttgccttcatccgcctgctttaataatcgcctgattgcattttcaggcagcggatttttataaatcacttgattttcaaagacaacaaactgtccattgtaggaaataaatgagtggatgcccagctcctccaaaatcggcttaaccaaaaatggagaccggccgctggcaataaacacatgatgcccttggcgctgaagctccgccacggtttttctcgtactttccggtatattcttatcatgatcatatattgtgccgtcaatatcaaaaaagattaatttagaatccatcgcaacttcccctttatcgtcttggtctgcaattcccaccctcatcatacaaaaagattgtcattcagcaaacaatttcgttcaaaaatcatattaaattccattaataaccacgaaaagtcttcctcaatctccgtatactatttgtataaaagaactctgggacaaatttttcattaaaggagggactggctaatgctgcgtaaattaagaaagaaactcagaagacaatggaacggaatgctccgtaagaaagcaattgcctgacaagggatctttcactttttgagagatccttattttgctcaaggctttccttatattccgttttcgaatataatagaatgagcgagtctaacatacggcatttaaggagagatttggaatgatttataaggtattttatcaagagaaggctgacgaagtacctgttcgggaaaagacagattcactttatattgaaggcgtatctgagcgtgacgtcagaacaaagctgaaagaaaagaaatttaatattgagtttattacacctgttgatggtgcattcttagaatatgaacaacagagcgaaaattttaaagtattggagttatgagcggtatgaaatttgtaaaaaatgatcagactgctgttttcgccctcggaggtttgggcgaaatcggtaaaaatacgtacgcggtgcaattccaggatgaaattgtactgattgatgcggggatcaagtttcccgaggacgaactgctcggaattgactacgtcatccctgattatacgtatttagtcaaaaacgaagataaaattaaagggctttttatcacccacgggcacgaagaccacatcggcggtattccatacctgctcagacaagtgaatattcctgtatacggcggaaaactcgcgatcggcttacttcggaataaacttgaagagcatggattattgagacagacgaaactgaacattatcggcgaggatgatattgtaaagttccgcaaaacggctgtgtcattcttcagaacaacacacagtattccggattcctacggcattgttgtaaaaacgccgcccggaaacatcgtacatactggggatttcaaattcgactttactccagtcggcgagccggcaaacttaacgaaaatggccgaaatcggtaaagaaggcgttttgtgccttctttcagacagcacaaacagtgaaaatccggagtttaccatgtctgagcgccgtgtaggagaaagcattcatgacattttccgcaaggtggacggccgaattatcttcgccacatttgcgtcgaatattcaccgcttgcagcaggtaattgaagctgctgtacaaaatggaagaaaagttgccgtatttggacgcagtatggaatcggctatcgaaattggacagacactcggttatattaactgtcctaaaaatacgtttattgagcataacgaaatcaatcgtatgcctgctaataaagtaacaattttatgtacaggaagccaaggggaaccaatggcggcgttatcaagaattgcaaacggcacacaccgccaaatttcaatcaatcctggggatacagtcgtattttcttcatcccctatcccaggcaacacaatcagcgtgagtcgaacaatcaaccagctgtatcgtgcgggtgctgaggttattcacggccctcttaacgatatccatacatccggtcacggcggacaggaagaacagaagctgatgcttcgtttaatcaagcctaaattcttcatgccgattcacggtgagtacagaatgcaaaagatgcatgtcaaacttgcaacagattgtggcatcccagaggaaaactgctttatcatggataatggtgaagtattagcacttaaaggcgatgaggcttcagttgcaggaaaaatcccgtccggttcagtgtacattgacggaagcggtatcggtgatattggcaatatcgtacttcgtgatcgcagaattctctctgaagaaggacttgtcatcgttgttgtcagcattgacatggacgacttcaagatttcagcgggtcctgatttgatttccagaggatttgtgtacatgagagaatctggtgacttgatcaacgacgctcaagagctcatttcaaatcacttacaaaaagtaatggaacgaaaaacgactcaatggtctgaaatcaaaaacgaaattacagacacgcttgcacctttcttgtacgaaaaaacaaagcgccgtccaatgatcctgccgatcattatggaggtttaaaaaaagaggcactccctaagggagtgcctctttttattgcagtgatatgtgttgaaatgattttacatcgaataatcccgtagtcgtcattttaatatcaggaatgacaggcaacgctaaaaacgacaatgtcaaaaatggattaaatccgcctgtgaaaccgattaacgacaatttatcatgaagcgtcagcaagctttgattcacttgctctgcagattggtcggataataaccctgcaatcggcagcggtactgaatggagctcttccccattttttataattgttaatcctccgccaatttcctgcagcttattaactgccgccgcgatatcctcatcattcgttccgacggcaataatattatgggagtcgtgtgaaatggttgtggcaatcgctccgctcttgaatccaaaacctttcacaacaccaagtccggtttcttttaatcctttatgccgctcgacaactgcaatctttaacaaatcaagctcagtgtcaggctcaaattcgcgggcaacaggagccggaacttgtactaatcgtgtttcaagctgatttggtatgatttgaatgacattgatctgctgctctgaatcgattggcatatgaaaatcctgtttgttaagaggagcagcaagcttaacagaatcaagcagtgcctgatctggtgctgcagttgaagcatgatcctgatagaccgctttgctgtcttcagcaacagtctgcccttttaccatcgtcattgtgacagtgacattttccagatcagatacaaaaagcaaatcagcgtcaaaacccggggcaatcgctccctttgtatctaatccgtagcattcggctgcattgaggcttcctagctgataggctaaaaacggattaagtccggcttgaatcgccattttcacctgatggtttacacttccctctgacaataaatcatccacatgcttatcatccgtacagaaaaagaaccggcgtgcgttcttttcattcaccgccggcagcacattgagcgtgtttttggcgactgatccttcacgcatcatgacatacatgccccttctgatacgatcaagggcttcttccttcgatgttacttcatggtcgtttaagacaaatgcggttctgtaaatgttaatgaggtctgttgataaaccagctaaatgaccgtctatcctttttcctgccacacgggcatcaagcagtttctgaaccatgtctttttcagcctgctgaaccgacacataatccataacttcagccagccctaatacttcttcttcttcataaaaaggcttgagatcggcagctttgagaattgcgcctgatcgctcaaaacttgcggcaggcacactggaaggaagcataaaatggatattcagcggtgtatgccgagcttgttcaagcataaactcaatccctttttcaccagacacattcgcgatctcatgcggatctgtaacaaccgtcgtcacgccatgaggcaacactgctttagcgaactcaatcggtgtaaccattgacgactcaatatgtacatgtccatcaataaaacccggaacaatcatttgtccctctgcatcaatgatattttcgccttcatactcaccgaggcctacaataactccatctgtaatcgcaatatcttcatatatccattcttgattatatacgtccatgatttttccgtttttaatgacgatatcagctttttgtcttttggctgaagcattcagcctattgactagcgcttctttattcaaataggcccctcctttttttattatatggtacaatatgctatcggaacgcctgtgcttagtcaatgaaattttaagaaattgacgctcagttcattaaagttgttatattctgataatatgaaaaaccgccctttgaggacggcttatttggctgctattttgtatgaagaactcttttttcgaaacgggagatgtctgtaactgatccaataacaatgagtatatcttcttggtggatgacttcggttgcaagcggtgatacgatgacttccttgcccctttttatggctacgatgttaataccgtattttgcgcgaatatctaaatcgagaagcgtatttccagccaggcggctgttagctacgatttcaacaagactatgctcttcagacagctccaaatagtcaagtacattgttggacacgatattatgcgcaattcgttttgccatatcgcgttccgggtggacgatgtgatccgcaccaattttagacagcactttttcgtgataatcgttctgcgctttaactgtaatcgtatggacgccaagttctttcagaatgagtgtcgttaaaatactcgcttgaatattttccccgattgctacaataacgtggtcaaaatttcgcaggcctaaatttttcaggacagattcgtctgtcgaatcaccgataactgcgtgagatgcaatcttggcatactcgttgactttatcttcatcgatatccattgccataacctcgacgccttcttcgcttaatgctttgcaaatactgccaccaaaacggcccagcccaattaccgcaaattcttttttcatcgtggtgctcctttatatgacatgatattgatcaaattttatcatattcttttgttacagtgttatccttttggcagcgaattcatatgccgcttgagcttttcagtaaactcaggcgacaaatacagctccgctccgcgttcgatttcaatctgatagtgctgaggcggggcaatttccgcttctttttggaggacgagaaaggttaaacagtctttgtagtgccttccgccagcttcaacgtctacaaatgccggccgatacgtaagagattcgacgccctcccttttatatagataggagagagcagaataagggatacggtataaaacgccttctgttgttcctccgtcttccaacatgtccgctcttgaaccgtcttccctttttagcgtgaagcgggttgtgtatccttttaaaacagctcttcctactggatcttgaaaatagtgatcgactcccgctttttgaaagcgggcattatccatgcatgatccataggcaaaataataaatgggatttttcgatttgctgatcatctgatgttctttccagtcgccgctgcttattttcgtaaaaccggcacacccgtctttgttcataaaataaataagcgcaattttaatcccgacatccgtttctacaaacaccgtttgtttatgatatccttgaaaaaattgatcgagcttatgtatacacaattcatctgcttcatatacttcgccatatatatagccttcatcttcatcattgaaaacaactgtgggcccctcttttgcagcaaacaaacttccctttgttctcgcctgctcattgatacatgccgattgtgccagcaaatgatggtttttttcatgctttcttaatgtcccgtatacaaacagaagcgagttcactttatttttctcctctcagctgtctgattttaaaggcaaaaccacttgaaagacgctgccttttccagcttcactttcgattttcaattccccgtcatgttccttcaggattctcaaacaaatgggaagtcccagtccagtgcccttttcttttgttgaataaaaaggtttgccaatctgcttcagcttttcctgcggcatgccgtttccttcatcctttacgcttatcactgcatgagaggcggttttagcagttgaaatggttacgacaccgccctttggcattgcctcaattccgtttttaatgatgttgataaagacctgcttcagctgattttcgtctccattaatcatacagccatctgtctctttgaaatttttctctatgacgatattggacagaattgcattggtatcaagcaatgtcgtgacttgtttcaagatctcattaagctggtgtgttttaaatgtgattgcctgcggttttgcaagcagcagcagctcgctgagcactaaatcgattcttttaatctctgaaaagatgatgtcaaaatagtcttttctgtccggatattgtgttttcataatctggaggaaaccgctgacagatgttaaagggtttctgacctcatgagcaatacctgcggcaagttcacttgtgattgatagtttctgggattccctcgccagccgttcattaatctcaatgagctcatcttcagcctctttccgctcagtgatatctgacattgtacccaggctgcctgtaaattggtcatcccggtcatagtaaagtttataatgaacttctccccaaaaaatcgtgccgttttttgtcacgtattttgccgtaaacatgccagaagacgctttgttttggatttgggtgttaatgtggtcggctacgtgcttttcttttatgaagtaatcgttatacattgttcccatacattcactgattgaaaacccggttatagatgcccacgcttggtttaaatatgtaatttcaccttttgcattcgtttgaaatacgatttcctgcaaattatccatgatgcggtttttttcttcagaaagctgtttatacttccattcgttatccttcattttcttaaccagctgctgtttctcatcaatataataagccaacatccagacacttaccagcgtgactgcagtatacacaatatcaacaggccaattaatcgggtttttgcctataaaataaaataaataatcccaaaacattataaaaatcattgccaaaatgatggaaatgatacgagcttgatattttctcatatgaccacctgccgcttgtgtttctctacttattgtaccattcttcgacaaataattgagtaaaatatgtaaagtatcccaaatcattcattaccaaatatcttgatgtcttatcttaggcggcggtaatcaaaaattggcacgcaaaaaaggcggagatgatatcactccgccttttttagcataattttattcttttaaagcggcttgaatttcttcgagaagcagctgtgcaccctcagggcttagcgtaattttaccgttgccgtattctttattttctgaagtgatttctccagtcattaaacaaacgccatgaggtttgtactttttcaagataattttatctccgtcaacaaaaaactcaatgctgtcttttatggcaatatccaatgcccgtctcaactcaatcggcatgacaatgcggcctaattcatctacttttctcacaacacctattgatttcataaaaacccttcttcctttaaatgtttcttttctcatgtaatgttttaaggatgtacctcaatatatcgtagacgaatgaaactttgaaaaagtttcccgctttctataagaattacaagatattttttccataaaaccgaaaaatgtattacttctgttacacagttccttgattttttacaaaaacatttctttaccgacgcacacccccaaaaatcgcagtatttctgagaaactttaaatgtagaatcatattaaattaggatagagattgggtgaaaacatgtttcaatcaactgaaatcgggattgacttaggaacagctaatatacttgtttacagcaaaaataaagggattatcctaaatgaaccatctgttgtcgcagtggatacgacgacaaaagcagtgcttgcaatcggagctgacgcgaaaaacatgatcggtaaaacaccgggaaaaattgtcgctgtcagaccgatgaaagatggcgtgatcgcagactatgatatgacaactgacctgctaaagcacattatgaaaaaagccgcaaaaagcatcggcatgtcgttcagaaaaccgaacgtagtcgtttgcacaccatcaggctcaacagcagtagaacgccgcgccatcagtgatgcggtgaaaaattgcggcgcgaaaaacgttcatttaatcgaagagccagttgcagccgccatcggagcggatttaccggttgatgagccggttgccaatgtggtagtagatatcggcggagggacgacagaggtcgctattatttccttcggtggcgttgtttcctgccattctatcaggatcggcggagaccagcttgatgaggatatcgtttctttcgtccgtaaaaaatacaatttgctgatcggcgaacgcacagctgagcaggtaaaaatggaaattggccatgctctgattgaacatataccagaggcaatggaaattcggggacgtgacctcgtgacaggtcttccaaaaaccattatgcttcaatccaacgaaattcaagatgcaatgcgtgaatccctcctgcatattcttgaagccatcagagcgacacttgaggactgtccgcctgaattgagcggagatattgttgatcgcggcgttattttaacaggcggcggcgcgctccttaatggaattaaagaatggctcacagaagagattgtcgtgcctgtacacgtggcgcaaaacccgcttgaatctgtagcaatcggcacaggccgttctttagaagtgattgataagctgcaaaaggcaattaaatagtctttacccgcaaaattctcacacgcggcaaatttcttgcttcttttttcctcacttccttcatattgtgggaaatggagaaacgttaaggaggaaacagatgctaagagatttaggaagaagagtagcgatcgcagccattttaagcggaattattcttggaggcatgagcatttctttggcaaatatgccccattcgcctgcaggcggcactgtaaaactgaatcatccataatattgaaaaaacccaagacgtgtcgttttgggtttttcactttgggctccttctttcctttataggatcatatttgatatgatgagaaaaaagcttggaggaatgcttcatggattcattttcacagaaattaaatacatatgcacagctggcggtagaagtcggcgttaatgtccaaaaaggccagtatgtagtcgtaaatgcttcaacagacgttcgggattttgtccgtttaattgtaaaacacgcatatgaaaagggcgcaaaaaacgtcaccgtgaattggcaggatgacgaagtcgccaaattaaaatacgaacttgcgccgtttgaagcatttgaagaatatcctgaatgggaagcaaaaggcagagaagagcttgccaaaaatggagctgctttcatttctgttgtgtcgtcgaacccagacttgctaaaaggtatagattccaaacggattgcggcattccaaaaagcagcaggcaaagcattacatacatacagacaatatattcaatcagacaaagtcagctggactgtcgtaggtgcggcatcagcaggctgggctcacaaggtgtttcctggcaaatcagaggaggaagcgatccaccttctgtgggaagaaatttttaaagcgacgcgcgtaaatgaagacaacccggttcaggcgtggatcaatcatgaccaaaatcttcatgaaaaagttgaccatttgaacgagagacattacgctgccttacattatcaagcagaaggaactgatctaacaattaagctgcctaggaagcatgtttgggcaggtgcgggaagcgtgaatgaaagtggccatgagtttatggccaatatgccgacagaagaagtgttcacgctgccgcaaaaagacggggttgacggagtggtatcaagcacaaaaccattaagctacggcggaaatattattgaaaatttcaccctgacgtttgaaaatggccgtatagtcgacattaaagctgaaaaaggtgaggatattttaaaagaactggtggaaacagatgaaggttctcactatttaggtgaagtggcacttgttccttacgattcgcctatatcacaatcaaacattcttttctataacacgctgtttgatgaaaacgcgtcaaatcatttggcgatcggaagcgcctatgcctttaatattgaaggcggaaagcagatgtctcgtgaagagcttgtcaaagaaggcctaaatgaaagcattacacacgtggactttatgatcggttctaaggatatgaatattgacggaattacggcagacgggaaaagagagcctatcttcagaaacggaaattgggctttttaagtaaataaaaggaggcttttccgcctccttttttatttttctgcttcatacatttgcagattcgcataaacggtttctaatactggtgcagcgagagataaacgttttgctttttcaatcaaaaatccatgcaggtggtcgccttctgtcgtttggccgttttccatatcccgaagcatggaggacttcatatggtaagacatgctggtcatcgtacgaaagctctcttcctcaagagccggatcagccggaacaccttcttttcgtaaaacagtgcaaatttccccaataagagtttgggccgtgtgacgtccggcttctgtggcgaggattgggccaagcggtcgttgaaataacgttgtgatccccgcttgcgctgcaataaagagatactttttccaaatgtccttctcgatatgcccgctaatgatgacttcagccttcacacctgaaaatgcctcttcaagcgctcttatccgctccgtacgctcgccgttccattctccaaatacaaaacgatgcgatgcgctcgtatgatgaatttctcctttgttgtctaaagcactttctataaaacacaggccgcccagcacctgttcttttgaaaatgccgcaaatagctgctcatagtggcggtacccatttaaaaaagggataatgacagattcttgatggataaatggtttgacatcctctatcacttgaccaagcgagtatgctttagaagcaatgataacgacatcaaattgccctgtttctccggcactgattagttcgggctgaaatgatacattccctttttcactatggatgacaagcccggtttttttaagctgctcagctcgtttttggcgcacgagaaatgtcacatcatttcctttctccgaaagccgtccgccaatatacccgcctactccacctgctccgacaaccaaaaatttcatgttgtgatctcctttcacatttaggtatcaaaaaaagcagagaaatctctgcttttttattcggcgtatagttcagtcaattttttctgcacatcagcattttcaaggaactcgtcatagctcatttgcttatcgacgatgccgttaggtgtaatttctataattctgttggcaatggtctgcacaaactgatggtcatgggaagtaaacagcatagcgcctttaaagctgattaagccgttattgagcgctgtaatggactctaggtctaaatggttggtcggctcatccaaaattaaaatattggcgccagaaagcatcgctttcgacagcatacagcggaccttttctcccccggaaagtacatttgcttttttgtggacttcttctccagagaacagcatgcgtcctaagaaaccgcgtaaaaagctctcactttggtcgtgcggagaatattggcgaagccagtctacaaggttcagatcactgccttcgaaatattcgctgttgtcttttggaaaatacgcttgagatgtggtaacaccccatttaaacgttccgctgtcagcttccatttccccggaaatgattttaaacagcgtagtaacagcaagttcatttcggccagtgaaagcaattttatcttctcgattcataataaagctgacattgtcaagcacctttacgccatcgattgtttttgttaagccttccacgcgaagaacatcatttccgatttcccgttccggcgtgaagttaacataaggatagcggcgggaagacggtttaatatcatccagcgtgattttttcgagaagtttctttcttgatgtagcctgcttagatttagacgcattggcgctgaatctagcgacaaactcttgaagctgtttaatctgctcttcttttttcttgttcgcttcttgagaaagctttaacgccagctggcttgactcgtaccagaaatcatagtttccgacatagatttgaattttgttaaaatcaaggtcggcaatgtgcgtacatactttatttaaaaagtgacggtcatgggatacgacaataactgtgttttcaaagttaatcagaaactcttcaagccactgaattgcctgaaggtccaggtggttcgtcggctcatcgagcagcagaacatccggcttgccgaataatgcctgtgccaagagaacttttaccttctccgaaccgccgaggtctgccatcttttttgtgtgcagatcttctgagataccaaggccttttaacaggatcgcagcttcactttccgcttcccaaccgttcagttccgcgaattcaccttctagctcagcagcacgaatcccatcctcatctgagaaatcaggcttcatgtaaatagcgtctttctcctgcatgacttcatacaggcgtttgtggcccataatgaccactttcagcacttcatactcttcgtactcaaaatggttctgcttcaagacggcaagacgctcgccaggactcatatgcacgtcgcctgtctgaggctcgatttcgcctgacagcacctttagaaacgttgatttaccggcaccgtttgcaccaattaacccatagcagttgcctggggtaaatttaatattaacatcttcaaataacttgcgatccgcaaaccgcaagcttacattatttacagcaatcatttattatcctccatcatgtctatcatcaataaaagtataccatgaatgcagggcaagagaaatgattccctgataaaacagagagaaaacacttatacacccaaaccagccagctgtgttacaattaaagagagagaatgcatccgcctggaaaattacacactctcatggaggaacacgttgaggcttttaacacttactgaatattgcttactgatcttttttacgggcttttaccttgccgtaacaggctttaccgccaaagatatcggcttatatataggcatagcccttatttacatattttcgcacattttttctaaacggctattagaaaagcgcggaaaagagaacaaacaggttcaccttttcttcagtgtgctggctattatcggttcagtgttcatcacggttttatgcattgcattggtcgcttctttttcaaaataaaaacgcctgctgtcctaggccagcaaggcgtttttattttgtttgacgcatttcgttaaacgggaaaaagacaaacttcgatgtgccgacaattcgatcttccgcgatcagtcccagcccgtttcggctgtccatagaattcagccggttatctcccatgacaaagtatttgcctttcggaaccttaaccggtccaaagtctcctgtcagactgacaccaagtttttctgcttccttcttgtttttagacaagtaaggctcggctacttttttaccgtttatataaagcgtgtcatccttcatttgaacggtttctccaggctttccgatcaatctttttacataatggattttagaagtttcaccgttgataataacgatatctccgcgcttcagctcgccgatatagttgactgttttattcacaaacagcctttctccgtcatgtaatgtgggatacatagatgaaccttcaactaaatacggttcaaacaaaaagtgacggatcaggagagccagcagaacagcgatgacaatcgctttaccccattccaggtacgtattggtttttttcttcgccgttttctcagtattcgtatttttttcctcggtcaaagtgtttcctcctagacaattgctatgtcagttgtttctcttcttttactttatcataaaaaagaataaaatacataacttaaccgcgctccctgccggccggataagaaaaagcgtcctttcgaaccaaggacgctttttttcttatttttctgtaacaggttttttgacgataccgaggataattgccatcacgacagcaccgatcacgatacttaaaaggtaaagcatcggatggtttgtaatgaaagctacgaatactcctccatgaggcgccggaagcgttactcggaagaattcagttaatccgccggcaacagctgcaccgactacagcagctggtatgacgcgaagcggatcagccgcagcaaatgggatcgctccctctgttacgaaagcagctcccatgaaatagcatgtaataccagcttcacggtcacgctgagtgaatttgtttctgaaaatggttgttgcaagtgcgataccaagcggaggaaccataccgccggccatgattgctgcatgaggcgcatagttgcctgcatcgatcatggcgataccgaacgtaaaggctgctttattaagcggaccgcccatatcgatcgccatcatgccgcccaagataatacccattaacacaaggtttccagtaccaaggctttcaagccagtttgttaagaaattcataaatgccgctacaggtgtattgacgacaaattgcattaatacgccagtgataaaaataccgaacagcgggtaaatcaaaacaggttttaatccatcaagtgactgagggataaacgtaaatacttttttcagtaaaatcacgacataaccggcaaggaatccggcaattaagccgcctaagaatccagcattcgcttgagttgccataaatccgccgaccataccaggcgcaaaaccaggacgatctgcaatactcatcgcaatgaaaccggccagaactgcaacaatgagttttaatgcattgtcgccgccgataaagtttaatgctgctgcaaacgtgttgtagctaggatcattcggatcagcagagtgaattccccagaagaatgaaatcgcaacgagaataccgccgccgactacgaacggaagcatgttgctgacaccgctcatcaggtgcttataaaacgtgtttccgataccgcttccagacttgcctttcgcttcttcatcatcatttgaagctgctgaaccgccgccgctgccttgataaatcggcgcatcttgattcatcgctttttcgataagctcttgcggacgtctgatacccgccgttacaggaacttgaagtacgcgcttgcctttaaaacgttccatttcaacctgcttgtccgctgcgacaatgattgcaggtgcatcttcgatttcttgggcagtgagcttgtgcttaatgccgcttgacccatttgtttcgaccttaatttccacaccaagctctttcgctttttctttaagggcatccgcagccatgaatgtatgggcaatacctgtcgggcatgcagtaaccgctaaaattttcccttttccggcaggtgctggtgccgcttcttcttcctcttcctcttcgtcatcatctttatcgtgctgattaataatgtcgatgatggcatcttcagactcagcttcaaggagctgcttacggatttcttcacgcattaacagcgttgaaagtcttgacaatgcttcaaggtgagtgttgtttgcgccttcagtcgccgcgatcatgaacactaagtgagccggctggccgtctaatgattcataatcgacgccgtcttttgaacgtccgaacgcgatcgccgggttgataacgcttgccgttttcgcatgggggatagcgattccttcaccgatacccgtggagctttggctttcgcgatttaaaatggcttctttataggcttgtcggtcatttaactttccagccttatcaagaacagtgaccatttcgtcaataacattttctttttctttgctctcaatattaagctttatcgtatgcttcgttaaaagctcagttattttcacttgtgtttcctcctctatagacgtgtgaccttaacttcaggaagaagctgctggacaaattcttctgttccaagttcttcagagaacgcggtagcactgcctgaagtaactcctaagcggaatgcttcttcaagcggcagctgtttggaaattccggcaaggaaacctgcaacaacggaatcccctgctccgactgagtttaccaatttcccctttggcacgttagcaaaataaacagcttcgttcgtaaacagaagcgctccgtctccggccattgatacgattacatgttcagcgccttgttctacaagctttttcccataaggaacggcttcctcaacagatgtaatggccgtgccgaacatttctccaagctcatgatgatttggcttcatcaaaaatggtttcatttctgttgctttcaaaagagcctcgcctgagatatccagaacaactcgtgcgttctgctgtttgcaggcctctgcgattttttcataagtatcgtgagggagtgaagatggaatgcttcctgcaagaacaacgatatctccctcttgcaaagattggaactgttctaaaaaggctttgaaatcttcatccgaaattgtcggtccctgcccgttaatttcagtttcatcacccgttttcagctttacattgatacgggtatccccttttacttcagaaaaagctgtttccaggttttcttcccgtaaaaatgttttgatatattctccggtaaatccgccgacgaatccgagcgctttagacgccacatggtgtcttttcagcagtctcgatacgttgatgcctttgccccctggatacttggtatcatacgaagaacggttcaggcctcctacagtaaaatcttcaacgtgaactatataatcgacagatggattaagtgttacagtgtaaatcatggtttcactacctttacgacagttttttcttggtaattatcgaatgtaagctcttcagcgtcagtcgtaatgattgttgcgtcgcctattccggcgaatgccgaaaatgaaatttctccgaacttcgaagggtctgctaagacgtaagcgtgttttgcctgtttgatcgctttctgttttaaaagggcctcatcagggtccggcgttgtaaatccagcctctgtatggacaccgtttgtccccagaaaactcttgtcaaatctgtactggtccatggcaaccaatgaagcgcctccaataatcgcgcccgttctgtgctttacgtatcctccaagcagataaaaagaaatttctttccttattaatgcatcgatatgcattaccccgtttgtgacaacgacaatatctttggttttatccataaaatcaatcatgtgcaatgtcgtcgtgcctgcatcaaggtaaatgcaatccccttcttctaaaagagaagcagctttttcagcaatcttcagtttatcgtgaaggtttttggatgatttttcaagcatatcgggttcaagtctgatatcggaaagcttggccgctccaccatgaacgcgctttaaaaaaccgcgttcttcaagggtcgataaatctcttctgattgttgattcagaagcattagtcagatttataagctcttgaatctttaccacatcatgcttttctatttgatcaataatcaattgatgccgttcaggagttagcatgcttcacctcctaatgaaaacgtattcattttgaatacaatttcattgtaaacgctattttcggtttaggcaactaaaatcattcaaattcattcaataactatcaaaatctttcacgtttctccatattaacgtatgtctatagggtttgtaaactgtaaattcgacaaaaataaggacaattgtacgacattttcttcttattttaatgaaaaaagtcttttatattcatagtagaaatcactaaacataaaaaaacctcatgcatgttgcatgaggctactcataacgcagcgcttcaatgggatcaagctttgcggctttatttgcaggaagcatgccgaaaataacaccaatgagcatactgaacagcacgcccccgcatacaacctgccaggatatgagtgacggccagcccgcaatggctgaaacaagcgcggcccctccgtatccaataccaatcccgaccagaccgccaatcagcgtcaatacgactgattcaattaaaaactgagtcagaatctgtcccctcgtcgcaccaagtgattttctgattccgatttcccgcgtccgttctgtgactgatacgagcataatattcatgacaccgattccgccgaccaaaagggaaatacctgcaattgagccgataatcgtcgtcataattgcagttactttgccaattccggccgcaatctcttccatgttcatcacttgatacgaatcctctgtgccatgattgtcatttaccagctgtgccgcttcttttccagccgattttatgtcgtctgctgattcgacctgcaatgatacgttactgaaatcacttgtgccaaaagaggatttcatcatattaaatggcacatacatttcacttaaatcgaaagaaagcaagcctgttacttttttcagcacgccgataatttcaacgggctgtccgttaatccagacaacttcacctagaggggaggttttatcaaacagctctttagccattttttgagagatgattccgactctattccccgcgagaaagtcattgtcggtaaaggttctgccgctttcgattttcaaagaattgacattcatgtatccatcatttattccgttaaccgtagcatcggtttcttcttcgtgataacgcgctttcatactttcagaagtcgaagcaacgacttgtttaatgccttctattccttttaaacctttaatatcgttttctgtaaacgtagattcagctgcggcattcgggttgcttgcaagctcctcgtcgctaggcatatagtacagctccacagtatttcccgggccgctgatcgactgcttcagcatttgctcgccgccctgtcctaccgcaacgacaacaatgacagagcctacaccaatgataatgccgagcatcgttaagatcgaacgcattttatgggcaaggacagagcttagagccattctgatgttttccaacaggctcattctcccacactcctttgtccggagctggcaggaacaatgtttccgtcacgcaccatgacgatccgattcgtgcaatctgctacttcaggctcgtgagtaaccagaacgattgtcgttccctcggcatttaatgctgtaaactgatccataatcgcctcgcttgttttcgtatccagcgcgccggtcggttcatcagctaaaatcaatttcggctcattcacgatcgccctcgcaatcgccacccgctgcttctgcccgcccgacagctcgttgggcatgtggagcattcgatcggctaacccgaccttttccaatgctctctcagcccgctcttgacgttcctttttgcctatcccggaataaatcatcggcagctcgacatttttttttgcgttcagccgcggaagaagctgaaattgctgaaatacaaaaccgatggaccggttacggactgccgccagttctttatctttatatgaagaaatgtcttcgccgtccaattgatatgtaccggaagtcggccgatcaagacagccgataatattcatgatcgtcgattttcctgatcctgacggccccataatcgagacatattcaccttgatgaatgtccaaatcaatagaatggagaacatcaaacgtttcctttccgatctggtagctttttcgcacattagaaagctgaatcatttaggatttcacttccattccgtcagtcacctgatcagatggattcaaaatgacttgatcatcttgggtaagcccctctttaatttctgtcaggtcatctgtcacttcgccgattttgacatcaactcgctttgcttttccgtcttttactgtatacacataatattggtcatcttcttttttgactgcctttgaaggaagcgtatttgctttccgtttatctgtttcaatattcatgataaatttaaagcctggctttccttctggaagatttccttttattttcacttgaagcgggtattggaccgcctgttctgttccttgtgccgcagcgctctcctgctgatccggaacaagcccgactgcggaaaccgtgcctttccatgttttaccctgtattacatctgaagtgagtgtgaccttctggccttttttgactttcaatgtatcgtattcagacaatttccctgagacgacaaggtcttttgggttgccgatatgtatgacaggctcttgaatatctgactttttggatgccgcttcttggttgacagaaataacggtgccttcaatttcgcttttcacttctaaatctgacacccggttggcaagtgactgccgctgaagctcggtttgttttaattcgatctccgctgtttttttctgcatttgaagctctgtccgttcagattcgatttgtttttctgcttctttctttcctacctgtttttccagttctctttctttgctgtccaaggcttttaacttttcttgaatttggtcaatttgaagccggttggattcagacgttaactggttctgttctttttccaggctcagctgctcatttgtataggtgactaaagccgtgccctttttaactttatcgccttcctttactttaatgtcttctaatgtccctttatccgcttcataaaagacatactgttcatttgaaaattttagcgtgccaggaaccataaccgttgatgagatttcattttcttcaacgctccccgtctgtacctccttgccggcgctgccgcttgtcggagcggcagaccggtatatattgattccaacaaaaagagcgactataactgcgattccaattccgatccagacttttttcatgagcttatgcacccgccacagaattgattaaacctgaaaaaagcgaaaatacaactaaaattccgaatagaatgattgctgaaatccacccggctttttttgagatgcctcccgttttgtgaagtccgattgctaataatacaaagctccagatgctgaaaatttcaaaggtatttaacacactggcgagagccccgtcagatgggataatccctgcgagtgacgtcgtgctgtaaagaggattcacgtcagtcgtaaaagcaacgattccattaaccaataatccgagactgctaatcaaagagacaaacagactgagagaaagcatttttttatatgtcgtaacaccgcctgatacttttacacagagccaataaataagaggggcaataaataatgctgcgataccgccgataatagcgcctgccattccgccaaatttggttattgttgcgacagtttccatttgttcagcagatagcccttgcgtatcctggcttttcaaaagctcactataatccgtaccgagtgattgcagcacggcaccgacgatgataattgctgcaacaatcaaaagcggtccccatacagccggcctttctcttattctttcaaattgaacggacggacttgtgattactccgaaaagtgaaggcttttcagtcgccgttccgctgtttttttctacattcgtttccatttcaaaacctccttgagaatatctaacaaatagtacgggaaggatatcaaaaagtttcatgtttttctaataaatttccaaaaaccttcaatattgaaggcttttcatattattctatcgctgtgctgtattgcgctttcacaagcccggcataaatgcctcctttagcgagcagctgatcatggttcccttcttctattttcctgccgtgatcaagaacaatgatgcggtcggcgtcgcggatcgtagacaatctgtgagcgatcatcactgctgtacgccctttcagaagcgtttttaacgcttgctgaatttttacttctgtctctgtatcaatgcttgccgttgcttcgtcaaggatgataatagccggatcggcgagcaatgctcttgcaaatgaaatgagctggcgctgaccggcagacagtacgctgcccctttcctctacctctgttgcgtatccttccgctaaatcggaaataaactcatccgctccgaccgcttgggacgctttcatcacctcttcatccgaagcatttggccttccaaaacgaatattttccatgatggtcccggagaaaataaatgtatcttgcaggacaatgctgatttgagagcgcagactggcaagggaaagatccttaatcggtataccgtctattttaatggtgcctccggccgcatcataaaaacggctgattaaattggcaatcgtcgtcttcccgctccctgtatgcccgacaagcgcaagcgtcgatcccgcaggaatagagaaagaaacggcgtgaagggcttttcgtttttcatcatacgaaaattcaacctcttcaaaactgatctccccatttatcttttcattatgaatggcattcggcttctccttgacatttggctgttcgtccagaaactcaaaaatccgttctgatgatgccatccccattaacagctgattatagacctgacccagtctcgaaataggttcccaaaacattcccagatagaaagcaaaagaaacgaagacgccaatcgtaatggtttcattcatgatgagtgtggctccataccaaatcaagacagccgtcccaatcgcattcgtcatttctacaagcggacggaacatggcattttttctagttgcttcccgccatgattcgtagttctcctgattgacaccgtcaaaatacgccatgttttcttcttcctgcgtaaatgcctgcgtgacccggatgccctgaatgctttcgtttagatgagagttgagcttcgattgcttcagccgtaccgtttgccaggatcggcgtattttttttctgagacttgttgaaataaaaaacataatcggcaatgtcaccatgatggctatagtcagctcagggctcagcgtaaacaaaataataatcacgccggccagaagcagcaagtcggtcaacaaattgatgactccgcttgtaaagagctcctgaagagagttaatatcattcatgatcctgactaagatcgatcccgccgaccgctgatcaaaaaatcgatgggataagcgctgcacatgggtaaataaatgctgtcgcaaatcgtaaatgacatgctggccaagctgattcatccacctgattcttaacacattggcggcgtaattgaggacatataaaccgctaataataaaaatgagctgaatcagcagctccgagtttctccctgtaatcgcttgatcaagaacataaacgccgatcaaaatggggatcacaagcttcacagcagtgccaatcaatacagtgagaaaagaaagcggcaaaattgtttttcgatatggtttgacatagctcagcagccgccacatttgagcccagttaaacggcttttcaatgatttcatctgaagagtaatagaaacgctctaaaaccccctgttttttcgcttgtttcatttggcccctccctatccgacctcatgcggctcattaatcattttgacatcacggtattgcaaatcgtaaatctttttatagtagccgcctttttcaagaagctcatgatgtgttcccctttcacgaatgcgtcctttattaaaaacgagaatttcatcagcgtgtttcagtgaagaaatgcggtgagcgacgataaaggttgtgcggtttttcatgacttcttttaaggcaagctgtatgctgtgctccgtttgcatatctactgcgcttgtggcatcatccaatattaaaatgctcgggttcaagcagatggctctcgcaatggcaatacgctgtttctgcccgccggaaagccccattcccctctctcccagcatggtgtcatacccatcaggaagctccataataaagttatgagcctgcgccctttttgccgcttcgatgacgtcttccattgaggcatccggccgcccatacgaaatatttgatctaatcgtagatgaaaacaggaaggattcttgaagtacgaccccgatattggagcgaagggtttttaacgaataatctgtgatgggtttgtgatcaatggtaatcattccgccaacaggactgtaaaatctggtgagaagctgtgtcactgagcttttgcctgaacctgtcgggcccaacagtccgattaccttcccgctgtttgcctcaaagcttacattgcacagcgcgtttgtttgttcttttccgtatgcaagagaaacatttttgaaatggacatctccggttaatttttgtttatgcaaagcatgaggatgatctgtaatgtcttcttctttttccagaatgtcgagcaggcgttcccctgacgcttttgcttgagagaacatattgatgacaaaacctaagttcataatgggccacatcatataattgacaaggctgaagaaagcaacaagctcgccgggattgagctgattttgcataaccaagtaaccgccgtatgagagaagagctacaatacaaatgttaccaatgaactccattaaagggaaatacgcagaccaaatggatgatgtttgtaaatactgcgccctgtattctgcattggctttattgaaagtgctgatctgaaaatcttccctggaaagagatttaaccgtattaatgccgctgatattttcctgaacttttgtattgagtttcgcaaacgatttgcggatgcctctgaaggcgggatggactcttttgtcaaaccggtataccgcaaccgcgagaaatggcagaacagctattgtcacaagcgtgagaggaacagaatagtaaaacataaccgacaggctgatggctaccagcaggccgaagcgaatgagctcagcgagaccgtatgataagaaaaaacgaagcccttcaacatcagcagtcagcctggacatcaaatctcctgttttcgcgttatcatagtaagaaaaagaaagccgctgcagtttttcatacagaccatttctcagccgataaacggatttgatcccgaacatatcacctaaatactgatgaaaaaaggtagccattcctttcaaaaccatcaccgcaataaatcctaagctgacccacgccgcaagctgatactgccgtcccagtacgatctcatcaatcgtaatttgcaggataatcggataaacgacagtaattgcagtcatcaaaagcatggctagaagcgaccacataaacacttttctgtacggccaataatacatttttaatcttttaaatgtctccatatccagcacctttccaacatttatcatcttcactatatcgatacccgaaataaatttctattatttttcaaaatttcagtctaattatggagtgagtctcttactttatagggagtaacatatgtagaataaacgcttacagaaaatcattgtatgctgaggatacttggggatatgccaatgaaatacagaaaaaccggacggctgaaatgccgtccggttttcatcccccgctgaccggcggtatgatggctaccgtgtcacccgaagatacagaggtattttcttttacatagctttcgttaacggcaatcatagccgtatcaatagattcaagaccgtattgttcttttagactcgcttttatttcatctgtggttgcttgttccatatctatttctattgcttgtgtaccggcctgttcagcaagccctgcaaataaaagaattttaatcatgctgctctccctcgcttaggtctggttttccgttcggataagctgtcgtttctagctggtcgccgatccattgctcaccgtcttcccaaatttcttttttccaaatcggcacaatctgtttaatgcgttcaatcgcatactcattggcttcatatgcggcttttcgatggggagaagatacagcaatcactaccgctgcttcaccgatatcgagcacacctatacggtgcgtgatcgcagctgaggcaccttcccatttttcttcgatttcagcgccgatttgagcaagcatttgcacggccatcggttcatatgcctcatattcaagccgaaccgttctttttccgtttgtccattcccgaaccgtaccaataaatgttgtaatggctcccgcttcccgtttctccacttttttgatgatgttttcagtattaatgggtgttttcgtaatctcaaaccgttccattatgcagattcccccttcagctgtgaaagcacaaaatccacggcaaccggatcatccgcatgaaaaacgggtaatccctgatgctctgtcatatgctctttttttctatagatgatggcgattatatttactgcttgcagcgcttccagatcttccttttcacttaggataaccactttaggataaggggcttttttaaagccttcaatcagaagacagtctgtttcgagaaattggtataactcaatcagccgtgccaaatcccaattgcggcgggcagtcagctgtaacacaccagcaccttctaccgctgttacatcagcacctgccgccttgtaacggtccgtgtcttttccttccgtgagcgtttgcggttcaccgccgtgaccatggtgcttcaggcagcccaaatggactccctgttcagaggctttttcaagaatgcgctcaataaacgttgttttcccgctgttttgaaatcctacaacttggacgatcgggaaaggacggaccaaggccattcacttccattctcttctctgatgagcagcacttgaaccgttctgccagattcgtagcctcgcgtaccgcccggcaggataataaatgcattggcatctgcaagtgatgtgacagagctcgacttatctaagccaacgggtgtcgccaacagcttcccttcctgatggtgcacgagcgcacgaacaaatcgggtaaatgggttcggcttcggaaaatccttggtcaaaacagcttccgcacaaattgaatgcggtgtttcattgagcagccatgtctggattatcggtttgacaaacagttcaaaaccgacatagcatgccgacggattacctgaaaggccaaacagcagcatatcgtttgcatgcgccaccgttgtcacgctgcccgggcgcatggcaactttattaaacagcacgtccgctccgagtttttcatagatcgcaggcaaaaagtcaaagtcaccgactgacacaccgccagttgtgatcaggaagtccacctttttcatcgcttctttaactgcagcaaagcttttatccagttcatcagagattttccctaaataaagcggtgttgcgcctgcttctatcgcttgcgcatataccatactcgcattgctgttgcggatttttcccggttccagcggatcactgacattcagcaattcggtaccggttgcgataatcccgactacaggctttctcacgacaggcacagatgcgtatccgaatgttgccaaaagagccgtcactcctggtgtcacccgggtgccctttgtcagtaaaacactccctttttgagcgtcctcacctgtttttgaaatattatcccccgtctgaaagcggcgttttaaagacataaatgacttcccattctcctcaaaggcttgagtcagttcaatcatgacgactgcatctgccccttcagggatttgcgcgccagtcataatccgcacggcctgaaacgggccaagttctttttcagatactgctcccgctccaatatggtcaataacttcaaaccgaactgggttttcacgtgaagcttctgccgtatcgcacgctctgacagcaaaaccatcgtatggcgaacggtcaaacgcaggtacgtggtgatccgcagttatatcttcggctaaaaaccgatgaaggctgtcttcaagcgccacccattctgtttcaccttgtttttgaaaatggcagacacgccgaactgcctcgtctaccggtatcggtgttcttttctccagcattctgacccctcctgttgttacagtccaatcactcttgccaacacggagttggcttctttcacatcatttgttccatgcaccagtgcccgtccgtcattgaaaatgacaattctgaaatcctcgtaaaaaatatgcagcaaaaacgcattagcctcgaccttgccgattgttttcagccgcttaatgagctcctgtttcgggattctttttaatgattctgaccttacctgcactgtatcacggccgcatagtacagcagcttttggtgtgttccaatcctgaagataaggatataccgcattagctccgcaagatgggcattcctcacggcgtacatgattaacgttaatcttcatatgcgaattgttccagacatcaaatgtcacaaacccccgctgtattgcttctttttggccggttaacagctttaatgcctcagcctgctgatatgctgaaacgatatgcacagcaggcggaataatgccggcagtatcacacgtcgccccgccgacaggaatttgctcaaacaaacaagacagacaaggggtttctccgggaatgacagtcatgaacattccctggctgcttacacaggcgccatagacccaaggtgtctttgttttctgggcaagatcgtttatcagcatgcgggtttcaaaattatctgtcgcgtcgatcacgacatctgctttttcaatcagcggctcaagcgtttcggctgttccttcggtaacatacgcctcaatatgtatctcgctgttaatcgctgatagatgctctttggcagccatggctttcggcatgcggagtttggcatcgctttctgtataaagctgctgcctttgaagattgctccactccacatagtcacggtcaataatggtaatcgtaccgactcccgctctcgaaagcccttcagctcctgcagtgccgagcgctcccgctccgacaatcagcacatggctgtctgccagtcttttctggccctcttccccaatttgcttaaatctgatttgccgtgaataacgttcctccatcaaacctgttctccttatcttttatgtcatcttatcatgttattgccccgtcagtcccgcttgagggagttcgatttttcttccaaacagctaaaatcatcacgtgtattaatgttgataaactctgccgggtttgctccgatattttcagcctgtacgtaacaaaccgaaattctgcctaataaatctgatattctcaacctcttctcagaaagctgatcgtatagaactggcatgatacgtttgtggtaaatcgcaatcaatggctgcacttgtccgtctgaaattgggactaccgcgtccgcaccggcaatcatcagacgtttgagctccagcatcgtccttctttgtatcagcggtgtgtcacaggaaagaacagtataaagatcaccgtctgtctttttaaaagcggtatatataccagccaatggccccatgccttgaaatggctcagcatcttgatacacttcattttcaccgttttcttgaaatctatcaataaattcgggacggctgatgataaccgtttgttctccaagtgcctctttagcgcattcgtaaagcatcctgcccttccatttgacaaacgccttcggttctccaaagcgacgtgaggctccccctgccagcagtacgtttacatgcttcatatcatctcacctctagtttcgttaaaagcatagcaaaagcaaaggctcaacgctactgcttgtctgtttattaaagaggaatagctgttcagtatttgcatattgtagtgttaacatcatgagggagatggttcgaatgaaaagatcaggtccttttttccacgacgtgtctcaggagaacctttatttaaaatccgagctttcaaggtgccataagctgatttctgaacttgaagcaagctactttcatcagaaaaataacaaactgctcaaagaaaataccgatatgaaagaaaaactccagcagctgtctgccgaattaacacatatgtcaacaaaagaaaaacatgcctcccacaccagccaaaccctgcaccaaataagagctgaactgcttgataaaatcgttgttttgcaggagcttctatctgctgaaacctataaacgcagagccgaaatcgaagaaaaacataaacttcatattgcgaaagtcaaaatcgaagaagaaaataaaaatcttcataaacggatcagcgaacttcaagcctcaattgagcaggaacaaaatgcactgcttcaggcaaaacagcaagccgaattgataaaagccgaaaacgggcgtctaaaagagcaaatggtagaaaaagaatatcagctaaaacatattaaaatagaagttgatcatatgaaagatcgaatcatagaaacgaaagaaagactgctagacatagaaaaaacgaaagaaaaattatttcacgaaactattatatcgtataaacggcaacttgatgaaagcgatgcctggattgcttctcattttgccgatattgatggcggcacgaaacaaaaagaaaaaacggaagaagaagctccagcggcctacgcgcagccaaatcatgtagagactatccttgaagatgtcaccaaacagatacatgtgcttcaaaaacagcttgcccacgcccaatcatcagaccaggccaagagccatacaatcgaagagctgaaaaacagagccgctgaagaaaagccttatcaaaagtgggtgtataagcttaatcttgaaaaagaaaacaaaccttcacagaaaaaacctcaataaaaaaactgcttgagcgatgccaagcagtttttctttatatttattcgtttgctgattctgcagattcgatttcaccctctaaaatgtactgcccgcgatatggctttttcacttccgggtacattttaattaagctttgcataaacgttgtcatattagggatttcaagaccgctttctttttcaatctctttttgaagctccgagctcttaatcgccgcgttgtggcgttttaatgttttaatagcagcttcacgcagcttagctgcttttgatcccggtcttgccgttcctcttcttcttcgtgttgttccgtctggtataccggcaggaagagaggaaatagattgaagctgaggctgaacagactgctgctgtgattgcggctgatagcttctgatttcctgagccgcaagctcagcgagaaccggcagagagtcaggttttttttcagaacggaaatcctttttgatttcggaagggcttccatttctgtccagctctcttaattttgcgtatattttatcacgttcaatttgatattcacgaatgactttcacttcagcttcatttaattgttctaaccgcaagcgcaaagcttctctttcattaaacattcctcaatgtaccccctatcaaaattaacatctttaattaagatattagattacaaaagtaattttatcaactattattttagcattttactattatatttactctatgaaaaattccttattttctgaaaatgttttatttttcaaaagagtcctttattctcaagggattaaggggctttctagtttatttggtataatgttgaaaatatatattttacttacttctttaaagaaatttagtgtaatatctacaattttcgagttatgagatatgagatttatctaaaattgaggaaaaacatcaaaaattagctgtgttttttagcgtatcaatcaaacaaatcatcaattcctatacccaaatttggaaaaataagcttcttactcttcttccattgctttttgcacaaataaaaaacctgatgaggtcaggtttttaggaaatactatttagtcagatacctattccgtttcagccagaacgcggttcacacgtttttcaagcattttcataccgctcccgccggcttggaagtgacggagctgtcctgttttatcaaacacataatatgcaggtacatattcattttcaaatgcatcggttaaagcatggtcactgtcaacaaaaatcggctgagtgatatcgtgttcagcagctgtttctttaattttaccagggtcaagatcatcttcggaacggggcatgtgtacagctacaacattcagctgatcttgatatttatcacgaaattcattcacttgcggcatcgcttctttgcacaagtggcagctgatggaccagaaatgaataagcgtcggcttttccccaatcaattgctctctcgtcacttcaccatttaaccaagctttttctcccgtcaattccggcatgggctgacgtaatttcattgctttttccctcctattttaaaagagaggcctaacgaatatgctagaccgcttttcgttcttggaaagaattaaagtgttttttggcctggtttccagttagccggacagagtccgccagtttgcagcgcctggagaacacgaagcgtttcatcaacatcacgcccaatgttgttatggaaaacagtttgatattgaagctccccttcaggattaataataaacaatccgcgcaaagccacaccttcttcttcgattaaaacgccatattcccgggatacctcatggtttgtatcagcagcaagcgggtatttcagctggccaagaccgttttctttgcggtctgtattgatccaagctaaatgagtatggatggtatcagttgaaaccccgatgacttctgcatcaagatcttcgaactcgtcatagcggtcagacattgctgtaatttctgtcggacaaacaaaagtgaagtccattggatagaagaacagcactgtccatttgtcgtttttcatgttttcctcaagacttactttgccgaattctttgcttgcaaggactgcttccatttcaaaacgaggagcttgtttacctaccatacgttctgccatatgtatccctccaatttattgtttggcttaaaggtcaaaatcgcatgaaaataaagggtgatcaaccatttttagttatattgcaatgccattatataaaagcagatttcctgagtcaatttttaacaaatcatgtatgtctttggcttcgacatttttgaataaaacgtttaacatggtcatgtacagggtaactagtctcaatgtgcagcaatcaattagaaaaggagctcaacatggactttattaaacaatatgattgggcgggactgattacaaatgccggtgttctgctcattaaactcgccattatgatattgctctattttatcgttcgatcattaggcatgaaaatcattaaacatctgtttgcaaaattcgaggagcagaatagcttgtctatcggacgtgcacatacgctccgaagcctgactcttaacatatttgcttatacattgattttcatatttttcgtcatggttctagatttgtttcattatgatccaagcgctcttttagcgggggcaggaatcgtcggcctggctgtcggatttggcgcccaagggcttgtcagtgatatcgtgacaggtttttttattttgcttgagaaacaattggatgtcggagattatattaccgtttccacctttgacggaattgtcgagcaggttggcttaaggacaactcaaatccgcagctttgacggaacactgcattacatccccaacagaaacatcacaaacgtgagcaatcattctcgtggtaccatgcaggctcttgttgacattaaagtgccggctgaaagaaatattgatgaaatgattcatattttacagcaggtttgtgatgaaacggcagcggctcttccacaaataaaagaaggcccaaatgtcatcgggattcaagaactggggacttctgaaattgtaatcagggtcattgccaaaacagaaaatatggaacagtggcgagtcgaacgagtgttgagaaaagaaataaagaacgcgttcgaccgcgctttccctaaagaaacagaataaataaaagaaccgaagctttttgcttcggtttttttattactgaattctgctctcaacttcgctacaaatttcttcagccgtcatcccggaagctgtaatgacaggtgcttgtgttaccgtatcggctatcccttgcacattattatcaagacctgttacgacacagcagtcacagccttgagcatcagcagggcttttcatcattacaacgtcatatcctttttcttttaaagcagcttctacatctgataacgattgttcaattccaatttttttagccatttttgaacacctccgtttactagagtgctcattttatggaattttattctttcatttgtacttaattggcataaacagaaaaataacctgtcatgacatgaaccgctgtttctatcgcattttcatcgggattcagcttagcatgatgaagcccatgttcagaatcagcgccgagccagaacatgaatccgggatattttttcagcatatagccaaaatcctctccagtcattgcttcttttgcttcaattactgtcgccagttgatgttcagcaacaaaagacataaattcttctgttaatccgctcgtattgtaaacttggtgatatacagacggatatgtcacttttcctttgcagcggaatccgatttcgattcctttcactacatcttcaatccgttcctttacttgtttcatcgattcttcagaaagcgtgcggatcgtgccttccaggtgggccgtttctgcaatgatattttgtgccgagcctccggtaatggtaccaactgtaataacagcactgtctagcggatctgtgtttctagagataatcgtttgcagctgggtgacaagtgtacttgctgctacaaccatatcctcagccaaatgcggatatgccgcatgtccccctttgccttccagatcgatgactagctctgatgtattcgcaaatagaaggccgctttttgtcgcaatggtgcctaccggaagctctggagcaatatgaagggcagtgatgaaatcaggctgccatttttttaatacatcgctctcaagcattggttccgcaccgccaggcccttcctctgccggctgaaacagaaaaagcaaatcatgtttgactgggtggtgaacaaaatgatcaataatgccgagtgcaattgtcatatgcaaatcgtgaccgcaggcgtgcatgttgccgtgatgctctgatgcgaatggaagaccagtttgctcttctatagaaagcgcatcgatatccgctctgtatgccagcattttttccggcgccgtcccgttcacttttacaaaaagccctgttcgccatttctcaatttcaattctgtcttgcggatattgttccaagacatttaataaatactgctgggttttgaactcctgaaatccaagctccggtatacgatgcagatctctgcgaattgcgatgagctcctctatcttcatttctattcctcctgcctatacgaataaggcgtggatatattatccacgccttttttatcaaacttttccttacagctggcgtaattcctgcttgatttcagttttgccttttgttttttcatcaatgtctttgatttttttagctggtgtgcctgcaacgacagtgtatggctcaacgtcgtttaccacgatcgctcccgcagcaacaacagctcctttacctactgttacaccttcaagcacaacagcatttgcgccgattacgacgtcgtcttcaatcacaaccggtttagcggatggcggctcaataacgcccgcaagtacagaacccgcgccgatatggcagttttttccaacagtagctcgtccgccaagcacaacgttcatatcaatcattgtgccttcgccgatgactgaaccgatattaatagaagcacccatcatgatgactgcgttatcaccgatttcaacttggtcgcggatgatcgcacccggctcgatacgcgctttgatgtttttaagatcaagcattgggatcgcagaattgcggcggtcattttcaaccacatagtcttcgattttgctttggttttcttcgattgctgtttggatttcgctccattcaccgaaaacgacaccagtgtttccattgataaaagctttcgcagattcaccgaaattgattccttccagctcacctttcacgtaaacctttacaggtgtagattttgtactattttgaataaatgaaataatttcatttgcgtccatcattttcatatgtatagtcctcctcctgattttctacctcattactgtatcaaaggaaagatacaaagacaagaaaaaaaggaacagccgttttagcagttcccagtgagtgatcagacagcgcacccgcttttctttgcgaattgtctcccgaagtttattaattcttcctcttcttcaccttctggattattttcgatttttaccgaaggcagcacaatgtctccaccgcgttcttttatttttgcctctagcgtatcaaccgctccgcagaaaaattcatatgctgtatcaccggaaccgaatacagcgcatgttttgccggaaaaatcaatctcctccatgtcttcaacaagatctaaaaattcatcaggcagatctccgtctccccacgtgtaggttcccattatgacatggtcataatcggtaaacagctgggcatcatcaatatccattgcttcgaaacggtctacttctgctaacgcctcctgaagccccttttcaatcaaatctgccatagcttcagtgttgcctgacattgttgcataaacgagcaaaatcttcgccaattccttgttcctcctctaatgaatcattgctgaaacttcgtacggctggacaaatttacattcatacaagcctgcgcaaaagaaattctctttctgattggccactctccatccatgtcccttaatggtatcgaaccattttaacgaccgggcttcgagatcaacctggtaaattctcgaaaaaccattttcatcttgtgttgtagtgacatatataatgccatcatcctctgaaagatcaagaaatgattcttcatttctgatcatactggattgtatggtgaattcttcaccattcaaaagattccttacagtgacagcaccgtgctttcctttcacagaacccatcgccgccaccagccaattttcattgaacacgagcatggatgccgtcatccggttttttcttttttgacaacttggacagtgtcacgcttaatgtcgtaagcccaaatgccgccaaaatattcgtgtatttgcgtgccgataaagagattgcccccgtgaaggcataacgaccggataacagggggattatgaaattcggcaaaaggtttggctacgcgccatgagacaccaaaatcatccgatacataaatacaatgcttaccgtgggcgcagacaaacccgttgtttctgccggtaatcgcccacactgttgcatttgtcggaaagctcgacatcgtccaggttttcccttcatcagccgaacgaatgactgttcccttttcaccaacgccaaataagtaaggccctatgtagctgatacagtgtatcttacttttcaaacgaaaaagctttctccagccctgctccaaagagtaatgaaaaatgccttctctttgtaccgccacaaaatatccagaaaacgccgatgccgtaacagcggttgcccctttatgaaacatggattttttccttgttcatataatctgcccatgcaagaaaacctctcgcaaacgctcggcagctttccacatcttcatctgtttcaggcgctaattcaatttttagtgtttcctggtaaacagcagctcccgcctcttgcagcatgacattgaacaaattcaccgcttcgcaaaactttggataagaataatcgccagacccgaagcaggctgtttttaaaccattaagctgaatctgtttgacctcttcgaaaaaatcctccgcttcgtagggcaaatcgccgtccccccatgtataggtgccaatcagtacataatcataggaggttaaacaagacgcatccatatcatttatctcgacacaatcgatatccaactcatattcctgaagcgtatcttttattatgaaggcaatgtcttctgtatttcctgacatgctggcatatgtaatcaaggctttagccatgttatcaccccattagttgataatgattttcaatatcatatgtatcactttaaatgataatgattttcattgtcaacagataaataaaaaaagacagcacctcgctgtctttaaaatggattttcctgatccagcatatcctttatcacttgtacaaaagcttgaacttgtttcagttcaaaggcaggctcataacctaataaccatgtatcccgaccgatcggatgccctttcatgtctaaaagaggcattttattcactttatcttcattttgaagggtaacagacggcaaaatggcataaccgattccgtgcagcgccatctgtttgcacgtttcaatctgatcaaccaatatcgtctgtttcggcgacgttttaaatttttgatgccaccagtgctgaatttcctgaaaataagtgctgtcacttttaaactggataaacggacgttctgtatgggcaatatcttcgatgcaggaaatttcagtatccactaaatacagatgatctgtcattaagtaatctttgcgccccttccactcagggttgcctcttataatgccgatatgaacctgatcctcatacaagcttttcagcatttcgctgctccacccggttatgagcgagatctttgcattcggatacttttccacatacgtcttcaggactttagggagccaatgctgaccgattatggaggcgacggcaagcttcaatgtgccgtgaatttcaccttcaagctcgtcaatattttctcttattctttcctgctctaatgtcacatcattcgcaaactgaatgattttctcaccggcgggcgttaccgttaatcctttttgagatcttaaaaagatttttgttccccacgccttttcaatggtttgtaagcgctgagataaagccggctgagatacaaaaagccgttctgccgcctttctcatatttaattcctcagctaaaactacgagcatatgaagctcttgaagctgcatgtcgtcctcctttttgttatcaataagtttttcttatctcccattctaataaaatcttagtttcttattcaagccctattctcgtttaaattatgtatgcgctttcttttttcactctgcctatataataaaaataggaccgtacagcctacttattcaatgagcgtatatgcttattcaattcctttaaaacgactcttctcgtaaaaatcccttcaaatacctgctcgtcattttcaacacagacaaatccgttattaatgaccatgccgaatcccttcataatcggatcattgatatgaaggcgcggaatgtcggtcagcatgacttcctcaacagtgatttggtcaagcttttcaaactcaattcgctcaagtccaaaaatactgttcatgatcatatttgtcccgattaagccatgtaaacggtaggaaggatccagaaccgggatggctgtgtatccggtttttgtcaatactaataatgcatgctcaaggttatttccgacttgcacgtgcgctactttgtccgcctcaatcataaattgtccgactgttgcctcaagaagttgatctgattgtaagcttatcatgttttcgaccccttttcattttcatcatcaatacattccctatattgcaataatataaactttatcagtatttgtcgaaaagtttcctttcaataaaaaagatactctttgtggagtatcaattatagggtgtcccattaattttcaaatcgaaatcggtcgtatagcgttacaagttttttgtaggtggttccgtcaacgtttttggtccctgtctctatatcgttgatctcactgcttaatagctcgatggcatactcatggttgatcaggatattcagcagaagtttttgttcttcttctgtaaatcgttcaccgataagactcattcgcaatcaggccccctgttttatactgaatacctctgaaagcaagacaacttactttcagctctaccgctagaataagtaatcagataacaaacgtcaaccgcataattcgacatttaccttggctttttcagccaaattattttgtgaaacgatttgcatagctgaaggcagtgtatgaatccggctttattttggcctcaatccccatggaggtaatacgtccagtcatttcttggatcagatcttttgtaagcccttttttcccaatatccaagtgaacttcaaaggtaagatccgccccctcaccggtaaagggcaggagcagatcggtaatatccattaagtgtccatcaagaatatgagcggccgtttcttggctgtacgccgtttctaacgaaatcttctcccgaaggctatgtatgggtctgtcgactgtatgatttttcaagcagccccaagctcccttgcctgtacgatgcaaatgcaatgcggtaataaactttgtgtaatcgcggtaaacctgtgaatcggttccgatcgataacacataagaagaacgggggtccttttgaacaaaggctttaagccgttccatcacatcttgaaaggtcatctgtgcttctgaaagattataaaacagaaaagaatcagccatcacgacactccttttcaaggatttacaaccatgaaacaagtatgttccttaccgtttatttcgattacttttgcaaaggcggaagcttgttccccctatttcaggaatcttactgaagaagttcaaagatttcgatggaaaccatgtcgatattatcaaacggatatgtgttaggtttttcacccttttggaaaaccgtcagttcaaacgtttgatttttttcgaaatatttaacactgcatattttctcaccattcacttcgaaataacgctgcattggctcgttagccgcttccgctgtttcttgcagactttgcagccgtgtgatgatacccattaattgtgacattctaaaaaaagactcctttcaaaaagcaacttcaaatcaacaagtatttattataatacaagttctattgagcatcataccataaagtcggacaggatggcattttcactgctgaatttaagcaaagaaaaaaagtgaaaaaaactatttttctttagtttgaggctttttttgaatgtcatgcacataattataatttttttcgaatctttggcagcattaagaatgcctttttgcaactttgtcaaaaccttcttttgaattttatggtgaagtcccgcgtggccataatcaatgggagtcatgctggatagaggtaaacaacggaactgaaataatcatttcagaacgaattttcctcctcacccgtgcagcagtgtcaggggtgttcggcactcaatgtttctccccgtgttaaacgtttaccactagttaggtttattgtttcattggattgtcctatgctttgacaaataaaaaacttggcgggggtagcgccaagttttttcggatcttgatctgatagaggggttggggaacagagagtagcttctctctataattaaatgataatgattctcagtatcaatgtcaatcgttttttgatatttttttcatttcataaaaaaaacggcctttcagccgttaaatcagtccgtcctgctcatataaataagaataaggcaagtctataaataaatacatctgatcatccatcggatatgaaaacgttctgatcatttcacctgtttccaaatcactgtacagatcactgaaaaaaccttttctgagatttctcattctcataatgttctccagaaaataagggcgccagctccagttcttttccgcatattccggctgataaatccattctccatcttgcttaaacacatttcccgtcagctgatcgccttcttcatcacacatgtaaatcctgaagctgcaatctgtcagctcttccgccagctttttaataaagtcatcatcagaagacagattgttttttctcaaagaggtcacagcctgatgcactcgtttgtaaaactgttcagagtgctcatagacggtctccagtttctttttctcatgtgtgataaattggtgaaattcagttttaagtctttgtttcaatacatctctctctagaaacgtttcagatggagacactaagtaatagccctgaaaatagcggcctccgtttctccaggcgtactgaagctggaagttcgcctcaatgtcttcatacagcagcgccgcaccgatttttcttgctaataaagatatgctgtacagcacatgctcatatgacggtgacggctgtgacactttcagcgcctgcaaatcgatttttaacagatctggtgagagcagcgcgattctgtccaagttgctgctttcttttccgatgttgtcaactgcgattttaattccgtatgtacgatagtatgcaagcatatggtagagctgctcaatatccccttcaaaattgtgctctgtaatttcaagcacaaaacggtggagttcgattcccttcgcttcatattctttcagaagctccagaaagctttcaccatgatccagcatcagcagattggcatcctgattcataaaaatcagcagatcagaatccgcctctaaaaagcggtcaagagcctggcggataattctgttatcaacctctaatttatattcttcgggtatccccgcatctaaaaagaagggcccgagactttggatttctgaatctgccaaaattcgtccaagcacctcatatccgacaaccttctgctcctcggcactaaaaatcgcctggtaatatggaaggacatcatcaatgttcgttaaaatatcaagtggatccaacatgttatcacctgcttctctatctttgtctgattatacgcacaattataactacaccacaaatttcaaaaaaatcatagtatggaaaagtaggtcgtatggagtatgttaaaagaagaggaaaatttttttgagattatcaatctacatactggttaattaagaattttattcatttgtttcacaataaccaaaacaaatacaaaaataacagcattataactagcagctgtccaaaagtaaagattccagtcagtgcctttatacatccaatcatcatcatgtttcatattatagaaagttccttttttatcgtaagtgccaaatgtaagagttgttaaaccggcgacactctttgaaacgtcaactccatacattgaaccgacattgtcagtatagtttattttcatatacgtgtaatcagataaaactttttctacccgcttggttggcagagacacatataatacagctgacgtatctcctccgggcccagccaaatactctctagctttaataaattttgtttcatcaggaaaatctatgtggtatagtttttcaaatcttattatttcattagaagtaagatttgtattttgataatactctggggaaaaagcacaaataataaagtaccaaacattaaagatgataactaaactgcttaaaaataatacaactaacttttttaacaatttcttcaatgaatcactccttaatctttaaaaattatatcataaatttaaatagaaaataaaacaagcgaacgaccagttttaacgttcgcttgttttgcagtttattcagatatcatttttttctcgataacatctctaaatgcttgtgctgttatttttccaatctcttcactataatcctcaacatcaaaagcacgtttaaaggctaacctaattggaacaacaactgggtcaaggtttgtatttaaataatactctgcttcagagaaaattttgtctaacgaaccatcaaatctattatttacaaattgagtgaacctattcatacagtcattattactataataatctctaattgcgatatttagaggttgtgcattagcaccaactgatgttttattcgctagattaattgcatctacatcactaaataaatcatctaggctaaattgatacatattacctattattttcatagccgcatcataaggcgaattaaattcttgagcgtgtaatttcatgtcctgtattgttgttaatagatctccagtccaaccagcaaaatctcgtagtgtttgagagtaaccaccactataaataatggcattataagttgccataagatgctgcgttcctatgacagtttttgatataggatcaacaattccatttactaggtcttcccctagcgctttactgcccattcacgataaataggatcaatctggcctgcggtagggacccacttccaccctttgtagtcatcctttcttaaatactgggcaaccaactcattagctaattgtgttttttttaccccattatttaagtcgctttgcatttgagcatatttttcagcagtttcatataaaacatcaatttgatcaaaaaacttcttattctctgaaggcactatatttatggtattaactccattatccaaacctgaacaaatatcattatcaatttcaatcattccagaaccatttccaacagtaattgttgaaatttggtcaaacgcccaattgtaaggcaaaggatatcctaagtttccgctaaagccagtagacataccacttacaaaacttgcaaatgctaaaccttttttagaaactatagtacatacattcctaggggcataaataccaattttgtaagttgaacctaaaaaaccgttcattatttcatttataccttcgaagtgtggaataatattgttgtttaaatcgttaccatatgcatcataatctactgcaaagtatattacagtgttatttttaaacccgtattcttttgctgctttataagcagcaaacgcatctttctttccttgttctttattaaaataatttgttgctcccccataggtttgataaatcggaaaaacatttaaacctgattttaagatagtttctaattcacctggttgtattttttatttagtgtactccccggcgcatttgttagataccgccctacaatcttataacctgccctcttaagggactccgccctgtccgatgtaatttgagtaattgagtcacaagcaactccttttcgattggggtctccagtacttactagaagtgaagcccatgtttgaaagtcggcagtaccactctgttgtaattttgcaaaagactgaaaagcctttacttttgatcttacagattcagagtatactccatcaaaaggaacattgtagccattaaagattagagcagcttgaaataaatgaataaaactgtttttttcatctgtttctccaattcttaatacaggaatcaatctttgagtagttggtccaaaattcccattagctatactatcacttaacccttcctcgtactgtattgcataaacaagagacttttgagtatcccttgaatacaggccatcacagggcataaagtagaaattctctctattgtaatatttattatttagccattgctgtattgaacgaactttctctgacgccccatttaaaaggatataagagtccatgtttaataaagctttaaacaccttaggcgttactacaccgtctgttttagaaagccccatatgcaattgcatttctgctatcgcctctttcgttccctgaccaaatgtacccgttaatccacctggaccataacctttacaataaagagcaccttgaataattttcacaatattttttttgaattagttgacgtagaaatcgggcctaattctttaagctttcttaaagttgtaggaccaaaactgtcggaagtctgtgtaattcccaattctagttgtaatgctctagttaatgcatacattgttttccagccagttttcccattttcctcaatggaattgtagccactttttcctttgtacgtttcattgagccattcctgagttaataataccatctcgtccattatattaccttcctcccaatctgatgtaaccttgaaacctttcattcttataatttctctttttagttaacgaagtaattatatgaatgttttatttgaaatctaagttcttcatatttcgtctccccttttaaaatatacctttcatatattaggtggcttacgtatgacacaacacctcataaacaaataaagctctatgtgttatcaaattggataggaagaaggttaattgtggaggtattacattcgaacataaaagttcttaataacttaaatattcacttataaatattcagattaaaacggataaggattcagccattgccccccgtccattgtgatacaatccccgtttatataggatgcttcatcagaaagcaaaaacgctgccaaagcggcgatttcctccggtgtgcccaatcggccgagcggcacactgttcatcgtgcgggccatcgctttttccgattcaaatagcttctccgcaccgcctgttcgttcaatcggtccgggggctatcgcgtttgtacgaatgccgtatttgctcccccattcaacggccagcgttcttgtcaatgacaatacccccgctttggctgcagcggaatgaacgacccccgctcccgctccccaagcgtacgtggctgccatatttaaaatgacaccctgctgcttctggtcaatccaatgccttgccgctgcttggctgcaaaaaaactgtgccgtttaaaacaatctcaataacggctttccatccattgggcgtcagcttttctgccggacaaataaagtttccggccgcgttgttaatcagcgcgtcaagccggccaaaggcttttaccgcttctttaatcatgtctgaagcggcggaatcggaacggacatccatttgaaaacaagcgacctgtccctcaaaggtctgaatttcttttttgtttcctcaagtgcctcatggttcctccctgtcaccataacgtgccaccctaattcagcctgtttttttgccatcgcttttcccatgccgcttgacccgccggtaataattaccgcctttttttccatgtttatccctccaattgtgaatgattattcattcaataatattctatcattatatccctgcctctgtcagcacatgctcatatgagatttttatcagatacagatgatataatagaaaaactctattaaaggttggtttgaaatgaaaaagatgtccagaagacaatttctaaaaggaatgttcggcgctcttgctgccggggctttaacggccggcgggggatatggctatgccaggtatctcgagccgcatatgatcgagacaaccgaacacacaataaaaagctctctcatcccgcacggatttgacggttttaaaatcgtgcagttcagcgatgcacacttgagtgattactttactctcgaagatttaaaaactgtcattcttacaattaatgaatctaaacctgatctcattgtttttacaggtgatattattgataatcctgatacgtaccagcaccaccaggcagtcattccattattgagaaagcttaatgctcccttcggcaagctttgtatttacggcaatcatgatcacggaggctatggaactgccgtttacaaaagcctgatgacggccggaggtttcacggtatatcgcaatggctatcaaacattgtcactcgcagatggcagcaaaatcgagattgcttcgcttgatgacttaatgctgggaaacccagattatgaaggcaccctttcaaggctgagcgacagacttttttccattcttctcgtccatgaacctgatgcagccttgaaaacaacagattatcccgtgaaccttcagctttccggccatacacacggcggccagattcagctgcctttttacggaccgattattacgcctccatatggaaaagtctacacagagggaatgtatcaaacgggcagcactcatatttacgtaaaccgaggcctcgggatgaccaggctgcctttgcggtttcttgccaagcctgaaatcactgtcttcaccttaaaaagcacaaattaatgtagcaggatgggctcctcatcaatacttataagtaaaaaaggaggatgaggaaactgcttacgtaccaggtgaagcaaggtgatacactgaacagcatcgcggctgatttcagaatcagcacggctgcattactccaggctaatccgtcactgcaggcagggctcaccgcgggacagtccatagtcatccccggactgccggacccttatacaattccgtatcatatcgcagtctcaatcggagcgaagacccttacgctgtccctaaataatcgggtaatgaaaacctatcccatcgccgttggtaaaatactaacgcaaacgcctactggcgagttttacattattaaccgccagcgcaatcccggcggcccatttggcgcttattggctgagcctttcaaagcagcactacggaatacatgggacgaataatcccgcttcgattggtaaggctgtttctaaaggctgcattcgcatgcataacaaagacgtgatcgaacttgcttcaattgtgccaaacggaacgagagtcacgattaaccggtaatgttttcttatttgtttcaaaaacaggcggtttataatatgataaagtgggacctttagggtaaggagcgtttttatggatatatttaaaaatcgtaattttgttcgtctatttttcgcagcactcgcttctcaaatgggcacgacagtaggcaacatggcctttgctttttttttgctggaccgattcagcagccagccttcatatacgaccttggcggagctgatgtattctcttccgaccatatttgtatttctgatcgtgggagtcgtcgcggaccggtttgatagaaaaaaggtggcagaaaattgtgattggatcagagcaggcctgactgtcgtgctttttttcactttatttaccggcaatattcctcttgttttttgtatcttatttatcagaagcgctgtaacaaagtttttctttccggcagaaaacagtttggtacaagccattctgccgaaggagcattatgcgaaagcggcagggcttaatcagatgctttttagcatttttatggtgtttggagtcggcataggcgcgtttatgtacaacacaatcggtattgaaggcgccattattcttgattttgtcagctttatcatttccgggctgctgatccgcagctgccggattccaaaagaagcccgacagccaaacggtgcattcagctggagaaagacttctgttaaggattcaataaatgactttagagaaggcatcctctatattttaaaaaacaaattgctggcatctcttatttttggcttcttcatttttggatttgtcaatggaggattcgccgtattgccgatgtttacaatgaaatatggattggcgcctgaccgttatgagtggcatacgtctgtatttacgatcgcactcgggtttgggcttctggcaggaagcgtaatcggcacgctcatctctaaaaaagtgaagccgcactttttaatgtcgataccgattttcattgcaggtttgctgatcttcgtcctcggctacaccaatattttatgggtgtattacgcggcagcttttgcactgggaatgtgtatcggaccgatcaacattgcaatcggagggtggatgccaaaaattgttcatccaaaactgatgggacgtgtaagcggcatgcaggacccttttatgatgtttgcacaatctttgacactcggcttagtcgcgctgttattccctaagtttgtttcaaacattgattatctttattacggcatgggtgttattatcctgctcgtttttatttttattttattgcactgccaaaatacagtgctcaggctgtggaagtgaatgttcaggaagcatttcaagaacagccgaaaaagaaggcaagatctgtataatgcaggttaaaaatgcgctttttttcttagtaaaaaagcgcatttttacattcaatatttgcatttcaactttaaaaaagtataatctaaacatatagaaattgataagagcaaaggagagaaataatggacgaccatgcatatacgaaagatctgcagccaaccgtagaaaatctttcaaaagcagtttacactgtgaaccgccatgcaaaaaccgcccccaaccctaaatacctatatctgctgaaaaaacgggctttgcaaaagcttgtcaaagaaggtaaaggaaagaaaatagggcttcatttttcaaaaaatccaaggttcagccaacagcaatcggacgtgcttatctcaatcggagactactattttcacatgcctccaactaaagaagacttcgaacatcttccgcatttaggtacacttaatcaatcgtatcgaaatcctaaagctcaaatgtctttaacaaaagcgaaacacctattgcaagaatatgtcggcatgaaagaaaagccgctagtgccaaatcgccagcagccagcttaccataaaccggtctttaaaaaacttggcgagagttacttttaaaataaaaacagccgtgcctctttctggcaacggctgtttttatttattcaataacatacgtatccacttttttaatcaaatcactgatctcaggcttgctgatttgctcatctgcgcctacaacttcgccgcggtgacgcagatcatccgtaattaacgatgagaaaatcataaccggcacatctgagcttttcggattttccttcagcagctttgtgagcctgtgtccgtccatttttggcatttcaatatcagtgatgatcatatcaatctgttttgataaatcagtttcgttttcagcaaggttcataatgtattcatatgcctcttttccattttcaaacgaagcgatattgttgtaccctgcttcttttaattcatcctgcaagaggcgcatcaaaagcggtgagtcctctacaatgataagctttttatcagttcttctttcatcgaagccctcggtatgcatattatacgtgtcaacacctgaatctgattcaatgtcataaataattttttcatagtcaggcaaaaagatcatcaggtcttcgagcttaataataccggtaaggtgccgctccattccttgatttaacgatgtcggcttttcaatcgcttcccaggatactctgtgaatttgagaaacagagccgacatgaaaaacaattttccgtttattaaattcagtcacgatatatttctcatcttttgatccttcaggctctactccaaaaaatgagaagagactgatcacagggaggatttctcctctgagtttaatcattccttctacatgctgatgggagtgaggcactgatgtcacctcgacaggctgaataatttctcttaccttcatgacgttaattccgaaagcattttcacccacgccaaacttcacaatttctaattcatttgtaccagaatccaataaaatttcgtattgttgtaacgacaattcaatccctcgctattcgcattcagtattgtactgtatatatcggcgtaatttgtaaaaagtgaatggcagctcttcaaaatcgaattccgaaggcaacaagccgcgttcctcaaaaaagaaacttttttcctaataaccattgactttccaactaacagtgataaaatagtcaaggatttttccaaagaagggtgtaaataatgggtaccttagtaatatttaaagaaaacgaaatgactgttttagaggatatcagtgaagaaacttacctgaatatgaagaaagaatcagctgaccttcaagaagagcatcctccgtatctgatttggcacgaagaccttcattttgattatggctattaatgaaattggcacatataaacaataatagaacatgatacaataaagacaatcaaatcgctggttgtcttctttttttctgaaaagaaaggtatgtttagaaaaaaggcgcatacaatcgaaatatatcagttaaaaaggtgacaaatgatcagctagtggtaaaataggataaactcattatatttgttaaggtgatgaattatggaacatttgctgaatccgaaagcaagagagatcgaaatttcaggaatacgcaaattctcgaatcttgtagcccaacacgaagacgtcatttcacttacaatcggccagcctgattttttcacaccgcatcatgtgaaagctgccgcaaaaaaagccattgatgaaaacgtgacgtcatatactccgaatgccggctacctggagctgagacaagctgtgcagctttatatgaagaaaaaagcggatttcaactatgatgctgaatctgaaattatcatcacaacaggcgcaagccaagccattgatgctgcattccggacgattttatctcccggtgatgaagtcattatgccagggcctatttatccgggctatgaacctattatcaatttgtgcggggccaagcctgtcattgttgatactacgtcacacggctttaagcttaccgcccggctgattgaagatgctctgacacccaacaccaagtgtgtcgtgcttccttatccgtcaaaccctaccggcgtgactttatctgaagaagaactgaaaagcatcgcagctctcttaaaaggcagaaatgtcttcgtattgtctgatgaaatatacagtgaattaacatatgacagaccgcattactccatcgcaacctatttgcgggatcaaacgattgtcattaacgggttgtcaaaatcacacagcatgaccggttggagaattggatttttatttgcaccgaaagacattgcaaagcacattttaaaggttcatcaatacaatgtgtcgtgcgcctcatccatttctcaaaaagccgcgcttgaagctgtcacaaacggctttgacgatgcattgattatgagagaacaatacaaaaaacgtctggactatgtttatgaccgtcttgtttccatgggacttgacgtagttaaaccgtccggtgcgttttatatcttcccttctattaaatcatttggaatgacttcatttgattttagtatggctcttttggaagacgctggcgtggcactcgtgccgggcagctcgttctcaacatatggtgaaggatatgtaaggctgtcttttgcatgctcaatggacacgctgagagaaggcctagaccgtttagaattatttgtattaaaaaaacgtgaagcaatgcagacgataaacaacggcgtttaagccgttgtttttattttttggaaatgaaattttaaacgctgtgcctttttcaggatggctgtccacatgtataactccctgatggttttcaatgatattaaatgtcaccattaatccaagccccgtacctttttcttttgttgttaaaaatggctctccaatccggtttagtaccttttcaggtataccttccccttcgtctttgacagtaacatgaacagaatgctcatcttcggttatgataatgtctactgttcccccatcaggcattgattcaactgcatttttgattaaattaatgaatacctgctttaattggttttgatccccgtttatataaatgctgtctttttcataacttgttctgataaaaatgccatttaaattcgcctgcgtttctaacagggctgaaacctcaccaattaattttttcaagttcaaatattctttgacagcattttgctgaggtttcgccagcatgagcagttcactgagtattaattcgatacggctgagttcagaaaacacaatatcaaagtaatgttcgttgccttccattgtcggtttcatcagctgtaaaaatcctttgatcgctgtaagagggttgcggatctcatgggcgattcccgccgcgagctgccctgcgattgataatttttccgatttcagcatcaattcttctgtttgttttctctctgagatgtcccgaagaatgacctggacggccgcttcaccaaaaaaggtcgtcggaatgcagaccatctccgtatagatgaccctgttctgaaaggtgaaccaggattgcttgacaatttcagattctgttttttgctcggcaatgttttggattctctcttttacatcctcgtgatcgcaaggatgcagctgatcgtatatgtttttgccaattaaatcctcatatgtagccgcttcaaacagggaaattcccgattcattcataaatacccattttccattgtgaatcaccgcaatggtatcaatggaattttgaatcagcagctgatatcgttcacggcttttttgcaggatggtttggaattttttccttgaagagatatcgatcagcagcagcagctcagcctgctggtttttgtagacggtcggggatgctttcacttctaaatgaacaggtgtgccatcaagccttttccacgtctgttcaatcattccgacttccattcctttttgcattcgtataatcctgtttttcacgatatcatgatattcttcttcaataaattcataggacgatttaccaataatagcatccttgcttttggctcccagcattgaaagcatcgcgctgtttacatagacgatcttgcctttgacactgatgcatagcggactcgggagattttcaaccaaccgttcataatcatccgttatatatgtagtcgattccgggcttgcaggttcgatttcatgtttttcgcagtttagggattgatggcctgtttcttcttcaagaaccttcattttcaaaatgatttcccgttctgtccgctcagctcttgtcgtaacaatttctaccgcagcctccacccacacaatcgtatgatcttttttaataaaacgaaaggtgcacggcatcagatgatgttcattataaaaatagctttcaaccaaaaattggtcttcctcatgcagaaacgttttgaggaatgatccgatcatctctccttggagatagcccaaatgcagtttggagttggcagatatataaatgatgcgtccattagaggccaagactgcatgaatatcggtttttgtttgaagtggtttaacatgctgcgtatcctgttccacagaatccctcctttgcatgatcatcgtgtttcgacatatacagattgacttttacctagtatgattcgctagaaaatgagtattctccttctattcttatggtgaacgtcaatttttgaataaaagaaagggcacacaatcttttagttgtgcaccctgttttttattttttactgtgttttttttcgagctctgcgtaggcgtggatagctcttttggcaataattttattgatcttatcatcatcatctactgatggaacaacaacactaaaggccacttttggttttttcgacgggtaatagccgacaaaagtcagattgtatgtttttttcccccaccagttgcgattcgtgccgtagtaaaatgtttccgctgttcccgttttccctgatacatcttctgtaaacgtattttttgctgtccctgaagaagtgactaatttcatgcctgtttgtacttgtttcaaatcgctctctgaattattaatcttattgagtactttaggtttcctatgttcaatcgccttacccagctggtctttttttcctggcttatgaatacttgtgacgattctaggctgaacacgatagccaccattggcgattactgagatgtattgagccatttgaagcggtgtgtatgtatcgtattggccaattgctaagtctaaaattaatcctcctacagttttaggtgtggtttgcattccggctgattcctgcgggagatcaatacctgtctttactcccagaccaaactggctgtaatagtttctcattttcagtagatcgttctgatcagccgggagagatccatgcggcttgtatgttacgcctgcaatatgcatggcaacattgaacatatatacgtttgaacttttttgcaatgcggttaattcattgatggttcccatattagtataagatttttttataagattcgttcctaaaagcattggagcatcgatataatatttataatgcgggatcccgtcctgatagccggctagcacggtggccccctttactgctgatcccatttcatattgggtggtaaatgcccctatcgcataatcttcaattttgttggtttttaaatctatctttttccctgccattgataaaatatcgccgttattcgggtccatcattacggcaaaggctctgtcaagcatgtaatttccgcgtgcacggctgtttcttacttcttcttcaatgatcttttctacctttgcctgaagctccatgtcaaaagaaagctgaagatcgtatcccctgctgcccttatcaatggttttttggctgacgacatttcctttattatcttctacgtattccactttttctttatgcgaatttaaatattcttcatattgatactctaaataactttttcccaccctgtcattattcgcatagcctcttgttaagtagaaatctttccggtcgctcagcaggccctgatcaggtgtcgtgacgcccccgaaaacagaataaagggttttgtcataaggatattttcgtgtccaatcgtttacgatatcgattcccggaagttcttctaaatgctcagaaacaatggaaatttcatcatatgttaagtcattttttggtctttgcgaggagtttttcttctcatcaagcagcgctccgttttttccattgctattgctcttatttggattcattgcctttacgatttgaggttcgtaagcatttccgcttgaaaaccttgtatatatcgcagcagtttccatttcttcgtcatcttgctgaatagcctttaattcttgatccggaacacgctctatttgaagcttgtaagcctggtctcctttcagattgctttctgattccttaagcagagcggcggcttttttcggatgagctgcgatccagtaatcacgaagatccctttccttcaaaaattcggtatcaatatgaatgaaagaagcaagccgcttcgctgttttgattttatcttctgtttttgtgctagatgttgatacatacacaatttctggaacgctctggttgtcgacagcaactttctggtttctgtcgtacatcttcccgcgaggcgcaggatagtaagctgtttttgcatttgatttctcagcgtcttcttcatgctgttcgccttcaacaatttgaacaaccccgagcttaaaaattaatgcagtgaatagaacaaagacagctaggaaaaaaaggttcattctgattgctctgtttcctttgctctttttctttggttcacgtcctatttcagtcacttctggttacccctctcaaatcattcaatatatttacatatactgagattaattgtaacacctttgtaatagttgttacagcgaaaaggagtaaaaaaagctgtcaatataaaaacacattaaaatataactaacggttcaaaaaaaggaagctatgtaacggtacgataaaatcatatataccgctgattcccttattcttagtgattcaacggatttactttacgaaaatgacaatctctatttgtcaaaggaaagtgctggaatctttatgacaaaaaagctatgttatgatttttctgtagaaacaaacaactctaggaggttacgaactaatgaagaaagcatttattttatctgctgccgctgcggttggattattcacattcgggggcgtacagcaagcatcagcgaaagaactctcctgccagcctgtggttacagtaaaaacggggaacacagtacaaaacatgtcacttaacgatgcagtgaaaaaactgcatattaacacaaatatcaaaacgttaaacgctgcaaacgaaaaagagatgaagcagcttcttcaaaaacatgcgaagcaatctaacgtgaaagttcaggatgttcaaaagacagaaacggcaaaacctgcacaaaagactactgaaaaagcagctgctgatcaaaacactgcttctaaagcacccgcaactgctgaaaaaacaaacacaacaacgtctgcaccttcatctgtaagtgcatatgagaaaaaagttgttgaacttacaaatgcagaaagacaaaaacaaggcttaaaaccgcttcaaattgatgaaacgttaagcaaatctgcacgcgcaaaatctcaggatatgaaagacaaaaactactttgatcaccaaagcccaacatacggctcaccgtttgatatgatgaaatctttcggaatcagctacaaaacagcaggtgaaaacattgcgaagggccaaaagacaccagaagaagtagtaaaagcttggatgaacagtgaaggacacagaaaaaacattctaaaccctaactttactcacatcggtgttggttacgttgagtctggaagcatctggacacaacaattcatcggaaaataaataaaaagattgcctgtttcgtacaggcaatcttttttatttcacccaaagcttatatatactctgtgttccgctgttttcttcaccttgagcagctagcttgtcatataaagattttgcgagcgacaagcctggcatttcttcccccattaattctgcttcctctagtgcaattcccatatccttaataaaatgcttcacataaaatcccggttcaaagttgccttgcagcatacggggagcaagatttgacaatgaccagcttccggctgcgcccgttgtgatgcttttcagaacattttccggctctaggcctgatttttgggcataagccatcgcttcagcaacaccgatcataccggctgcaattgcaatctgattgcacatcttggtatgctgtccgcttccagccggtccttgatactgaatattctctcccattaaagagaaaatcggcatgcaggcttcaaaagcttctttttctccaccgaccataatcgcgagtgttccgttttgtgcaccgatgtctccaccggaaacaggagcgtctaaagcgaacaatgctttttctttggccgcttcagcaatcttcttcgcaagcgaaggcttagatgtcgtcatatcaataagatatgcaccttcttttgcgttttcaataattccattgcttccgaaatacacttcttcaacatcactgggatagccgaccattgtgatgataacatccgcttctttcgaaagatctttgaccgtatctttccagatcgcgcctttttgaagtatgctttctgctttttcttttgtccgggtgtacaccaatacaggatggccgtcattgagaatatgtgatgccatgctttttcccattactccaagaccgataaaaccaattgtttttttcaaggtcattcctcccagatgtttcgtttagattttagttaaaatttatcatttttccttcattttctagactaccatatctattcatcttataaaataaaaaatccccaaaacaaatgatgtttggggatgtaattggattacaatgtgaattttgcaattgtgttcataagctcttggcttgcatgttttagtgtttccgttgagtgtttgactttatcaagggtgacaagctgttcatcggttgatgcgttcacttcctctgctgcggcagctgattcctgtgatatggctgaaatgctttgaatggcttcagaaatcgcaagctgttcttcactcattctttgaatttccgcgtaaatgtgatcaataccttgtaccagtgactgcatttctgcagttatcgtatttaatacctctccagtttcgtgaattgcactgttttgttcatcattcattctgcttgcctcaaccatcgcgtgagaggcctcttttgtctcaagctggataagcttcacagtctcgctgatatgctttgtagaaagggctgattgctcagctaacttccgcacttcatcggctacgacggcaaaaccgcgcccgctttctccggctctggctgcctcaatactggcatttaaggcaagcaagttggtttgatcagatatgtttgaaatcgctgtaacgacttcttcaatattcttagtttgattttccaaatccagcagcatcgtttcaacctttttcgtttccatattggcttcgtttgatttcatcagcagctggccgagcgcgtcaagtcctttatagcttgcatcctcggacgattttgagcgttctttaattccgcctgcctcctcagcgatttgcctgattttcgttgacaggctttccgatttttcattaatggtttcaacttcagaagcctgttccgatgcccctgcggctacttcttcaatcgcttttgcaatttgtccgcttgtttcattagtttcggcagccacagccgttagttgttcagaggtgtcagatactttccctgaagagagtctcacttgctcaaccatttccttcatattttcaaccatcagattgaaatctcttgttaaaataccgacttcatccttagattttgattccgcgcgcactgttaaatcgcctgcggaaacagctttcgtttttacgatcagctgctgtatcggaccggttatcgttttggccaggaagtagctgagaataattgttatgataagcgcaatcaatgatatccaaagattggcccgattcattttatctgaaatccacattaattgatcggtatcaaattgcgttccgaccttccagcctgtctcgccaatcgtttggtacacaaccattttcccattcacatcttgtatcccttttttctcggatgcgatggtttgcagtgtttgatcctttgatatattttttccttgatttgacggatgggctaaaagattgccgctcgcatcagctaaaaaggcaaatcctttgtaaggcaccttttgtttattgaccatactctggatagcagagagtttcaagtcatagctggcaacccctatcactttttgcctgtctaagatcgctttcgatgcagtaacaatcatgtctcctgtcacgacatctttataaggttccgtccaaacaacttgatccggggtttcagctgcaagcttataccatggtcttgatgttggatcgtaatcctcagcgaaatccgcttttggatatgtaaacatttctttttttgcggtgcctatgtaagccatcgcaacataatcatcgttgtctttgatttgcttaatgtcatcgtgaaacagccgagaagcttctttacttggtttcgttacaaatgtatgcgttaattccccattagccaatcttgataacgaaatggcataactctttaattgcaattcaatattttgttcaagtgactgcgtcacgttttgagttgtatttttcccatcctctgtaatcatcggttttagcgtcaaataagaagacagcattaagagaacaactgtgatgattaacataatcgaaacaaaaacagcaatcttcatgtgaagttttttaaacaaaccaatcccctcctaatttctatatcggccctttcgtttgaaaaatgaataatcaaaaaataaattataagaaaatcggaatatatttactgaaaattcaatcttcgttataatgaaacaacataaggagagtgatgatcatactaaaacaaatgtatgtgcatgacggcagaaaatttgaggctctgaccattagaaactacactgagactgacatcgagaggctgatttctcttcaagaagaatgtttccctcctccgtttccccaggaattgctgtggtcagaggaccagcttgccagccatatcaaaacctttccggaaggcgctttatgcgcgctcatcaatggcagaattatcggttccatgactgctcttattgtacaatttgagcctgattctcctgatcatacatgggcacaagcaactgacaacggatcgattaaaaatcatgaacctcatggaaatactttatatgtagtggatatttctgtttctcctcattatcgaaagcttggaatcggaaaatggctgatgaatacgatgtatgagctgactgttgataaaagactggaacgccttctcggcggcggccgcattcctttgtattataaatacgcacacgagatcagcgctgttcagtacgttgaagatgtgatggaaggcaggaaaaacgaccctgtgctgtcctttctcctccgttgcgggcgttcacctattcgtgtagtcagcaattatttggaggataaagaatcattgaattacggcgttttgatggaatggaaaaatgttttttataaaaaagcgagctgttgatcacaacagcccgtttaagtgaaatattcaatttttgcgttagggaaaaaggtatcaatataggattcaagtgcctctcgaagtgcatgctcttcatctttctgataaatatattttccgatcccgtaacggccccatttataacggcgcttttcttcatctaattcgagcttcgtcttcggataatttttctctatcactcgtttggccggttttgtaaaacggtgttgaattaattcaaacgtaatgtcatgtctaacgtcctgcggcaaagcagcatctagcttttcaaacagatgtctgtatccttcttcccagccttcatgaatataaatcggagcaacaataaagcctagcgggtagcctgcttttgcaacttttactgccgcttctatccgcttatcaagaggtgaagttcccggctcaaagtttttaatcacatagtcggcattaatactgaatctgaatctcgttttcccgttatgctttgcgtctaataggtgatcgacatgatgaaatttcgttacaaatcggagctttccgagatcactttggccaaaatgttcaatggcgcgcttcagcgtgtgtgtcagatgatcaattcctacaatgtctgacgtacatgatgcttcgaaccttgtgaactctggtgcgcgctccttcatatacttatctgcctgatctaaaatctcttcgacgtttacataagttctgatatacggctttgatcccatggttgtttgcaggtagcagtaatgacaatgccccatgcagcctgttgcaaacggaatggcatattcggccgagggtttggatgaatcaaactttaatgttttccggacaccgataactaaagttgatttcgcattgcgatattgctgaagatgatttttcccagggatattacgcacctgattgtgggatgtcgtttctctgatttcaatacccatattctcaaatttatcttgtaattcttggcccagcggatattccagcgccctcggttctatatacacaagctgcggaacaaatgggttctgcatgatgccacatccttttcctttactaacgttacttttctcactaggcggaaaggatatgagttgtaatgatttccttgttactcatacggatcaatatcaaacagttctttgtaaagcgatttagcttcttcatagcttgcaaacacagcatcgtcctctgcgaatggatgataggtttcataaataaacagggaaagctcgccttcatggtatggatggtgcacaatttcggcttcctttatgtgggctacattggcggcgtgcggatttctgtagatcacataaacagtatctcctgcgttaaattggtttgacatactatccctcctagccatgttattgtgtccttctatacccttacttatgaaaaaaaccagacaggccggaggccgtctggtttttgtacattacttgaatgtttcttttacgaacgcgacaacttcttctgtcgtgctcatagataagattttctctttgaatgactcagcttcttgtttagacaatttgctgatttgtgttcttgccggaaggatagacgttgcgctcattgagaactcatctaagcctaagccgagaaggatcggaatcgcaatctcgtctcctgccatttctccgcacatgccaacccattttccttctttgtgtgctgcttcaattaccagtgtaattaagcgaaggattgccgggttgtatggctgatacaggtaagatacacgttcattcatacggtcagctgccattgtgtattgaatcaaatcgtttgttccgatactgaagaaatcaacctctttagcaaactgatcagcgatgactgcagttgacggaatctcaaccatcattccgacttcaatatcgtcagatacagcctgtcccgcttttacgagcttttctttctcttcaagaaggatcgcttttgcttctttgaattcgttaactgtcgcaatcatagggaacatgattttcaagtttccgtatgtacttgcacgaagcagcgcgcgaagctgtgttctgaagatttcttgctcttcaaggcaaagacgaatcgctctatatcccaggaacgggttcatttctttaggaagctgcaggtaaggaagctctttgtctccgccgatatcaagtgtccgcacgacgactgattttccttccatacgctcaagaaccgttttgtaagcatcaaactgctcatcttctgtaggcagctgatctcttcccatgtaaaggaattctgtacggtaaaggccaactgcttctccgccgttttcaagaacaccttttacatcatcaggagtaccgatgttcgctgcaagctctacatgatgtccgtcttttgagacagtcggttcattgacaagcttcgcccactcagctttttgagccaaataagcattatgtttttcttcatactcttttacagtttccgcagatgggtcaataatgacatcgccattgataccgtcaacgataacagtcacgccgttttggatcgtgcctgtagcagctttcgttccaacaactgctggaatctcaagagaacgtgccatgatggcagagtgagatgtgcgtccgccgatatcagtagtgaatccttttacgaactcacggtttaattgagctgtgtcagacggtgttaagtcttcagctacaataataacctcttctgagatcatgcttgggtttggaatttcgacgccaagcaggtggccggttacgcgttttgttacatcgcggatatctgccgcacgctctttcatatattcgttgtccatagattcaaacatagtaacgaacatagaagacgtttcttttaaagcgaattcagcgttcactgaatcagtgctgattttttctttcacagggttcagaagctcagggtcactgagaactaaaaggtgagcagaaaaaatatcagctttatcctgacccagttctttcaaagcgtgctctttgattttttcgagctcttcttttgaacgtgcaatcgcttcatcaaaacggcttacttccgcttcagaatcagagatgtttttcttttcaaccgttaaatctggctcttcaagccggtacgcttttgcaatcgcgatgccggctgaagcaccaatcccttttaattcttgcattactcgccgagtccttcgcttttcattgtttcttctaaagcgttaagagcatcgttttcgtcagctccggaagcagagattgtgatctcagcgcctttagcgatacctaaagacataacacccataatagatttaaggttaactgttttgccgttatattctaaattaacgtcagcgtcgtatttgctagcagtttgtacaagaactgtcgcaggacgagcatggattccagaatctgcagttactttaaatgttttttgtgccatttttatcattctccttttaacttaaagctttattacttcacaatattatatcatacaaccgtacttgtcatctgacaagcacggcgtactaacacccttatttttcaatcttcacaatatcttcttgttctctgttgactgaaccgcttgctttaatgctgactgtttctccttcagcaaggtttgtaaatacaatcggtgtcatgagagatggtacattcggtttgactgcatccagatcaacttcaagaagtttttgtccaggctcaacgcggtctccttctgatacgaaagacgtaaatccttcgcccttcaggctgacggtatcaataccaaagtggattaaaatttctcttccgccgtcggattgcaggccgatcgcatgttttgtcgggaacacattgagaatttttccgcgaaccggtgatacgacaattccttcagaagggagaatcgcaaaaccgtcacccatcattttccctgagaagacttggtcaggaacatccgtaattgggtgaatttccccggtaatcggagaaacgaaaacttcctcgccgatttcattttgcagcggttctgcaatcacttcctcaacctgctggcctacttcctcttgagcagatgttttcggctcaggtctaggcttgcgtcccgcaataatgtcttgcatttgtgtttttaacccgtcagaacgcggtccgaaaatagcctgaatgttgttgccgacttccagcactccggaagcgccaagctgtttcagacggtctttatcaacctttttctgatcgtttacagtcacacgcagacgagtgatacaagcatcaaggtgtttgatgttttcctggtcacccattgcctgcagaatctcataaggaagatctcctgcttcacctgttttcccaggtgctgctgtttcttccgcagcatcctcgcgtccaggtgttttcagattaaatttgcggatggcaaatcggaatccaaagtagtaaatgaccgctaaccctaagccgacagggatgacaagccaccatgccgtccggtttggtaaaataccgaataggaagtagtcaattaaaccgccggagaatgtcataccaatcttaacattcaacagctgcatgaccatgaatgaaagtcccgcaaacaaacagtgaatcgcaaacaggactggagcaacgaataagaaagaaaattccaatggctctgtgatccccgttaagaaagatgtcaaggccgctgaacccataatacctgcaacgagttttttgttttgcggttttgcttcatgataaatggcaagcgccgcagcaggcagaccgaacatcataaatggatatttacctgtcatgaacgtacctgccgttaactgtacgccgtctttaatctgcgccataaagatacgctgatccccgcggatgatttctcctgctgcactcttatagctgaagaattcataccagaacggtgaatagaaaatatggtgcaatccgaatgggataagcgaacgttcaatcaccccgaagataaatgcagcaagggttggattcgcttccactaatcctgttgaaaaggcattcaatccatgctggattggaggccagatcactaacataataagacccagaatcagtgcagaaattgacgtaacaattggaacgaaacgtttacccgcaaagaaaccaaggtattgcggcagttcaattgtgtaaaatctgttaaacaataatgcagctaacacaccgacgataataccgccgaacacccctgtcgccaaggtaggtataccaagcatgtttacatatgcaggatggttttccgtaaagaacttggctctttcaactgaatccgaaggaatggttccgtttgcaagaagaaccgcactcatggatacattcattacaagataaccgataattgctgcaatccctgcaactccatcaccattggcaagcccgatggctacacctactgcgaaaagaagcggaaggttatcgaaaacaatctgcccagcactttccatcacacctgctacaagctgaacattgtcattgctcaagaaatgcaggacctgaatcatgtccttattttgcatcgcattcccgatcgcaagcaaaatacccgcagccggaaggatcgcaactggaagcataagcgcacgcccaattttttgaagaacgccgaataatgctttaaacataagaattgacctcctctttttactagtctgaccttacagctaaaaatcatgacaacgaattcacaggcgtaagtcttccagtttaaccgtttacatttgcccttttacacaacaaaaaggcatgagcaaaattgggtgcgcaaaagaacgagaatgaacttcccgtttttttccctcaatcactcatgcctgatcgaatcagtaacacgttataaggataaactgaatttatgaaattttattggttaatcggtacagatgaagcgtcagataaaccgcttccgcctcatgaactggtttcttcaatgtttgctgcaagattttaatcaatttccaagctgtattgtagcatagcggatattcatttttcaataacaacattaatttttctggttctttagtcggttcttcttttttaattctttctattgtaaatctgatatgcctgatcagccgcaaatagttgacactttccttatttactttcatttgaaatgagtcttcaatcacctcgacaagctgcgccatgagctgagagtgctgattgacctcggacagcggacggtttgtcaacgctgaatggatatgcagagcgataaaaccaatctccccttccggaaggcagagtcccgctttttcattgatcatatctatgacttctttggcaatttggtactcctcaggatatagtgactgagtctccattagaaatggatttttcatatcaaatccctgctgctgccttttgatcgcaaatgcgatatggtctgtcaacgcaatgtgaatatgttcatttaatgagtgattcgtcctattgcttatgtgatagatgacatcgtttgaaatatcaacgagcttttcatcaacatagtcaaggagctttttaaactgcttttgttccttctcgtcttttaaaatgaacattttatcgtagcctttatcttcaatgacatcatcttgtttttttccgaaaccaataccttttccgattaaaacgacttcgctgtatttatgatgagaagcaattaatacgttattattcagtacctttttcactgtgaaggacccattcacgatcctcagctcctttgtcattcaatacctcatatcgtacataacgaacagaatgcacgtcaaaccttttttcaatgcattcactaaacagtcgatctttcgatgagacggtaatccagaactttcctttcaatcggctgtccttgaattcttttttccaatatggcaaatgcctgctttcccatttcccttgtctgaatatcgatcgttgtgattccaagcgcttggctgatttcgtggttatcaacgcttaagattgcaagctcatccggtactgacacccgctggttctttgcttcaagaaaaagccctgctgagacttggtcattggcaacaaaaatagccgtcggcttttccttccacgtattccatttatgaaaaagcgccttcccatcattgattgtaatcgctttctcaattacccagtcttcacgaaatgcctcgccgatctcttccaatgcctctttgtaggctttgattcgaaaatggctgttcatgcctttttttcttgccaaacagatggctatttttttgtgccctttggcaattaaatagtccaagccgttccgaaatgcttcttggtgaggaatgctgatggttgggaagcgggcattatctgaattctggcaaagcaaaatcgggccctcccattccatgagtttctcatcagcaagcgcctttgagcaaaaaatcaggccgtcaacctggcgctgctttaattgggacagcgcaaagatttctttttgtacttcatagtttgtttggaataaagagaggtgaaccccggattccgcggctgcgtcggctattcctgcaatcagctctgcaaaatatggcagattaaccgtcggcaagacaacaccaatcatgtttgaaaatcctttcgacaaatgtacagcgtgaatatttctcgtgtactccaatgattccattgcctcaaacactctttttcgtttgtcttcactgacgtatggatgattgtttatgactcgggaaaccgttgtaacagagacaccggctttctctgcaatgtctttaatattagccatagattcccttctttctaaatccccttgatctggaatgcgtttcatacaatatgatatggacgtaccagatatctttttgtgtttttagctgaaaggagaagatcacatgggtttcttcattttaattgggttatgtctcactgttctcggtggcagctgtcttgctgtaaaacctctcaaccaaaaacatgaaattaaaccctttcgaacatttgatgattttttatttaatgcagataaaaaaggacgatgtcgagaacaaagtccttttttatttctattacagtatgatcaaatcctttggatattgggtcagagcaactgctccgtcctttgttacgtgaacgtcatcctcaatgcgtacgccgccgatctctggcacataaatccccggttcgatcgtgtagaccatgccttcctgcagcagtgtatcgttggcctggctcattgatggatactcatggactgaaattccgagtccatgcccaagccggtgaggaaaataatcaccatatcccgctttttcaatgattccgcgggcagttaaatccagatctccgattctcacaccgggtttgcttgcctcaatcgcggctttttccgcttgaagcacagtctcgtaaatggcctcctgcttcggattgatggttttgtatgcaaacgttcttgtaatatcagagcaatagccatcaagaataacaccgagatcaaataaaacaaaatcacctttcttcaacgtggctgtaccaggatttccatgaggctggccagatttttctccgaataaaaccattgtagagaaagacatgccctgaattccttttttcttcagctcatactcaatttgagcgagcacttccacttcactgatgccttcacgcaaagcggctgtgccgacttcaacaccgtaatctgcaagctttgccgcctctttcagcaaacgaatctcattgtcatctttaatcaggcgaaattgattgagtgtttcttctgctgaaacaaattgagccccgcccgtcgcatgcttcagctgttctgcacgtgacagcgagattgaatccttttctaccgcaagcatatgtatgctgatatttcgctttttcaaagccttctctatcagctcccacggattttcgtgatccgcatagccaatgatttcatgattccagcctgcgttgcgggcctgtcctgcttccattcctggacaaacaaagaaaggctcctcttcttgaaaaataaataaccccattaatctttcatgcggctctgtgtaaaaaccggttaagtaaaaaacattttctttcgtatgaataaatgcggcagtatgccccgcttccttcagccatgaagagacgcgttgtattctattcacttcttgttcctccctgccatttgcaatgcattgttctgtcttccattgtaacaggttttaccggtgtttgcctttcacgacgccttcattttctaatgcattttatttcctgctcctcttcctgtatactgacagtaacgttcaatcgcaggggggttgttccgtttgctgatgaattttttcagacgaaaagcagttatgctcttaacggttttgggaatttccgctccttttatcgggatgaagatggtgggcttttattattacagctctatcataggctgtgcagcgggtttcctttgctgcaccctcgctctcatcctagttatgaaaagatctgataaagacaaaaatgaagggaaagcttgatacataaaaagccagcagcctgattaggctgctggttttattttaggagtcttaaaccgtttagtatgactaaaatcgtgctgccctcatgaccaatcacgccaaatggcaattccatcgcctgcaaaaagtttgcacaaatcagcaggcagattacagctagagaaaacacgatattttgtttgatgatcctgttcattttccgagacaagcggcacatgtttacgagctttttcaaatcgtttttcatgaggaccatatcagcggtctcaagtgctacatctgttccgccgcccatcgcaatgccgacatccgctgctttgagtgccggcgcatcattgattccgtcacccaccattgcaatcgttccgaattcttcttttaaccgtttgatttcattcactttttggtcaggcaggcattctgccacgacagttgtcatgccggcttccttggcaatcgcttgagccgtgtcttcgtgatctcctgtcagcatggccgttttaatcccaagtcggttcagttcttccatgacctcttttgcttcaggcctgatttggtccttcagtgcgatacagcctgctatttgatcatcctttttcacaaatacaattgtatgaccgctttgaatgacatctgatgctgtttgtttcataaattgtgctgccatttcctcgccgataaaacctgctttaccgaccttccatttcgcacccgacacttctgccataacgccaaaccctgaggtttcttctatagatatgtagccggactgattcacgccgcggctttcagcgtacgccgttatggcttgggcgagcggatggcttgattgcgtttcgatggcatagacagcctcaagaacttccgcttcactgaatccttctgctattctgatcgtctctacggcaggctggccttttgttacagttccggttttatcaaaggcgatcatttgcactgagcccagctgttcaagaaagacgcttcctttcacaagcataccgttgcgggcgccatttgaaatcagggacagcgccgccggcataatagaggcgacaagcgcacaaggtgacgcgacaaccataaacaccattgcgcggtagaaggtttcactccagctccagcccagcgcaaagtgcgggacgaataaaaggagcgccaccgcaattagcacacctttcacataagcattttcaaatcgttcgatgaaagcctgcgcgggtgaaacactattttgcgctgattcaaccagtttgataatttttctgaataacgaatcttcatttgctttcgtgacacggactgtcaaggagccattgcgattcaccgttcctgtgaatacagtgtcgcctgtgtttttttctacaggcattgattcacctgttaaagccgactcgtcaagacttgtcgagcccgattcaatgataccgtctgccgctacgcgttctccaggtttgatcacaatcatatcaccggcctgcaagtctgaaaccggaactcttttggtttcaccattgaccatcaatgtcgcttcttcaggctcaagctgcattaaagacgttaaatctctgctgcttttattcatcgtgtatgtttctaaagctccgcttaaggaaaaaataaatattaaaatagcaccctctgcccagtatccgatcaaggcggaaccaatggcagcgaaaatcattaaaagttctacattcagcgttttggattcgagtgtttcttcgattccttccttcgctttagcaaatccgccgatcacaaaagccagcaagaaaagtattatggataatacctgatatccggataagagccagcctgccaaaataagagcgcctgatacaagtgctgcaataagctccgcgtgctgtgcccagtttttttccctcttgtctgttttcaatggctcatgcgggtcgcgttgaacgataacttgttcattcatatcgaattctcctctctaattgagaacgtaaatcatcttcatttctcttataaaaacaaaatcgctgcccaaaaggcagctttatcgtcagttatttcttgatgtcttcctttattatagcacgcacgaagagaatttcaattataattattttaatttctttttgataataattatcattaatgtttattcacttcttctctatatgaaaaaaagctgagagtctatgctctcagctattcttccgtccattccttcagttgttccgctgtcatcgggccaatttttgttttttcaatttctcccttttcattcagcaaaaatgatgttgggatcgtgatgatatgatactccttcatcaattccccttttgagtcaaggacaatcggaaacgtcagcttgtttgctttaataaagtcttcaacgacttgctgattttgttccgaattcactaaattcaccgttaccagctttacactgtcggatggatgggcatcataaaacgattgaaactgtggaagctcctttttgcagggcgggcaccatgacgtccaaaaatggagaattgttttttgccctttattcggaatcgagatgtcctccccttctatcgttttcataagaaaaacagcgggaacagcaggctgtttttcctcagcttgtgccgcacctggaaaccatgcaatcaaccctaataacataatgtatatagtaagcaagcgcttcgtcaacatggaatcttcctttcatgcttttcaattagcttgcccctgctgttcctttatcatccttcaattcgcggcgttctggtccctcccgtaagaaatacagataccttcaatgctttgcagatcgtggcatagtgcaggctcgtcaaaagaatcatgccagtgttcattccaaggataatcccgagcatttgcagattctccattgatcccagtacatacatcatacttagcgcaacgatatggctccatacattgtgataaaaagcctctttcacaaaacccatcccgattaagcacgcctgcagcggcatgacaaacagatgaaagagaaagtaaggccacaacagctgcaagtaatactgcgcttcaggagagtgaaaaaacaaatgcgtgagaggtcccgcaaactggaacatgacccagacggcaggtataccgtaacctaatgtaatgaaaatcgactgcttcagcctttttaacacgatgtcatactgagaaagtgcataagcttccgaaatactcggtatcatgacgaccattaacgaatgggcaataaaagcagggaacgaccctatcgtcacagccactcctgccagcattccgtattgatcgatcgccgctgtcccggcaacgcccgcagccaaaagagctccttttactaaaaagggttcaattgcattgacaaccgcatgaaaaatacgcagtcctgttgtaggaattgaaacagcaagcagtcttttccttacatcctttccgcgcaaatgaatgtgctgctggccggataacgcccgccttgccatgataaattgtgaatataaataaacaagcacgaccacatcactcacgactagaacaaacaaggaaatcagcacagccatgtccaattcaaatgagtaccattgaaaaaagaggaataagcacaagagctggatgatttttttcagcacattggcaattgcgatcttccccattttctgcacacccataaagtagcccctggcgattgaagtaaaggcgacaacaggaattaagccgatgacaatccctttaataaacgggtggtatgtatcaaataccggaataaacggaagcgcaatactagcggcggcagtagaaaaagcagtaaaaatggctgtcattctgaaagcgtgcctcagcatgctttcatgaagcttaggatttgactcggcaatgaatttagaaatggatatcggcagttccaggctcgcgatgacaataattaaaaagatcgtgggcaaaatactcatgtaaagccccatcccatgctcgccaagctcccgcgccaaaatcatattgacgacaaattcaaggcattcagcgaaaaaggcggcaatggataaaagaatgatccctttcacaaatcgattcatgatgtctctccttgtctcttgtactaccaacatcatatgagacaagttcaaaaattattttatttttactctttatatgaaaaaaagcacagctgagacaaattgtctcttctatgcttagacggcaaaaacgtgtctgccgattttttctacgatttttcttgaacgaatccaattatctgacgctgttttcggattataaaagaatatggcatctgtttctctattttttgaggacagcgcttcttcggcagcttcaatcgattctttatcaggcttttggttaatgctcccgtttgcgaccggttcaaaggcgtttttctgataaataactcctcttatcgtatcaggaaaaccttttttctccgtcctgttcagtacaacgcttgctacagcgaccttgcctttatatgattctcctttggcctctgcgtgaacgagacgggacagcaactctttttcagactgtgtatatgtttctttctcatcatttgttttgtccggtttatctttctctttcttttcagtgtgtgctgatagcttaatcggttttattttcttgtctttatcagcagacagtgaagggaaagattcattcgtatttcgatctatatgtgtaagccatttcgcttcttcatgttttgtcttctttgcgctcagtagtgaagcttgtgtatgctcaattttggctgcaggcatgaaacaaagaagaaaaacagccagagcagtgaatttcgttgtcatacagtttcctccttaaagtgctccaaaaaacacttcataaccttaacaagagatccattcattttcacggaaaaagattttccaactctcccaaggaggtatcaggatggaataaagaggatgactcactgcttaatggcaaaaaaacagtctgaaattctataaatattgttaaattaaaacatgtttatccatctttggtactttacattttatttacacctgttacagacagctgtaataaaaggcttgtgttctgtcatatatgataaaaaggcttctcacgtatgagaaaccttcagcttcttggctgttctaagtattgaaagataacatctccgccttgctgggcaattcctcggaaatgtttaaaatcatcttgtttagataacacggccctgaaatcaagaaaatgctctttctggactctcagttcgtttatggcgccggtgcgcagctgttcaatcatttctgttatttcttcgggacgcaacaaaaattccccccttttctttctattgacgaaaatcaatatatcatctttatagcgacagaacaattcataagggagataaaactccttatcgctttacttctcaatgaaaatactgcaaaatactttcaaaaggcattattatgtttaaaggagaggaagcttgtgaaaatcgctaaggttgggaatgtcattgaatttaaaaacggattaaccggtgttgttgaaaaagtaaatgagaattctgttatcgttgatgtgacgatcatggataactatcgggatcttgagttagattcattgacagttgttaatcataaaaattataagatcatcagagactcctattaaaacctccttatttccacatttattcaaaaaactgcaagacggacaatttaacaccttacatatgaaattcgctttctcaaaagctgccggccggcagcttttttacataaaaaacaccgatcatgaatcggcgtttttgtctatttccgttatttctatatagaactcgctgacggcccctggttcgtacaggttggtcaatgatgttgaataatttgtcatttccccccggaaggcaagatcgcgttccggaacctcgacattaaacgttttttcatacaacaggacagcgatatcatggtaagtctcactcgtaacgtttaaggtaaatgcaatttttcgcttcggctcgctctcctcttgatatgcagccatttctaacgttacattgtttaaccgcaatgtcttcacttcatatcactcctttatagtccatgcatcttagcataccttagcgaatgtttacaatgaatctgttcttaacggttatatgaaccaattcattcgaaaagacacctttacaaacatacgttcgttaaattataataaaacagacgagctgccatccagcatcccgtcttttcattagaaagcggcgagtggaattccccccggattcgctcgtcttttttatgtaaaaaccccctcatttctaaggagaaaccatatggtcgattatcaacaagtcatgcttcaccatgcgtacaatcaattctcatcatgttttttagataaaccagcatccattcaggaagtatatgagtgtatgcttttaaagttctagttagtcgtgcgcttccatatcgatcctgaacaattctgaatgaaatgcgataaccctgctatcaagtagcatgtgtatgattaaatcatggaagcagaataaattcaacacatccgtaaaatgcgtactataacataagtttgaatgtgtatttcaagcccaatgtaatgcctcgtgtagaacattttgggagaagggcctatggaatgccctcactgttttacccgcactcgtaataaactcctttcagtatgtccatttagagattcattgcaattatcttcgaattttgttctgaactataaatcattatatatttttaaacactgtattccagactgacgcatcttcttgtccaagactccagctgccaagacctttcagattatatttttgagcgagttttatttttgctctgagtgactgttcattttcaaaccataatgtatatgttcccgaaggcaacggcccctttttatcgtgattgacagtaaaaatagcttttggagattgactcttggtgtcaaaaataattgtcccgctatgcctttttactaacaacaaggtaaaggggaatggcttgagaggcagattggccttccatccagcagcggccatagaatggcaatcctaaaactagtttttgaggagagattttttgggtcagaacatattgaatggacttttccacccatcctacacttgcagtaggcccagcaaggcggctttcatcataggccataaccataagataatctgcatatttagctaaatactcgtaatcatatgatccgtgccagcccttcgtccagccaaaaggatttgccgccactgcaactgatacttctttatgtctaggaatacttttccttactaatctaataaaatctgtaaatagattccgatctttttctgtaaggttttctatatcgatattaactccatccaaatccagttcttctattgcatgagaaatttgtttagctaaaagaactcggttcattaatgcaaatcgtcccaaatcctgatcccaatgattgcttagaaaaggaactacttttaattttcttctatgaagagctttaatcacatcgggattagctgaacggagaagtaatgatccatcttttctgatatagaaaaaatcaggagacacaacatttaatactccgttcgtttgatcaacgtgttgaataaagtcccatcctaatccagaatagtaatagctcatttgaaacatctcataaccccttcatccccaaaaatatcaagttccccacaaataaaaaaatgaggattgtcatttcaatttgattcgcttccgaaacctcaaagattatctttctcttatctttataatttgtccaggataaattctatctgaagaaagcttattaagattcataagttgttgtaccggaatttcaaaggatttggcaatcgtccataatgtatcgccggattccacatgatatacttcgtatgtcacgggaaattccatataacgaggcgttctttttactttattcgcttgatttcttattttaggtattttccccttcattcatattactctcctttagaataatttgttattaatatttctaaacagtttctctctaatcttaatgatttgtccagcatatatttgatctgatttgaaatgattaagctccatgagttgctgcagggaaacattatacttactggcaattattgataatgtttcaccgggagtaacatgatggatcacgtatttttctttgagaacatctacataatgaatggtttcccctaagtttcttatgattcctctgctttttagcacctcaagcattctctcggctctatgccgataggaatcattctttacagcctttttaccgtttatctgaatcttttttctctcgctatcatgatttaaatagtatttaaccttttccaatgtttcttttggggaggaagaaacgatgagatcgcggccaggtttgaatttacctcgaactgctggtgtatccgatgtcaataaaaaccccccggaaccaagaatctcataggtgcgttgtgtaagttggctttcacagttttgcaaaccgataatgatttttgctgaactgtaaactttatatgcttcagtataatcaaggtatccatggatccaattgcggggaatttctcttcctatatatttactcattttttcccagtttctcccccaaaaatcaatgcgaatacccttccgtataagaggacgaataagcgtttttaaagaggacgaacggaacacttccggatgttcttcaagaaaattagggtaagcattagccaccactgctatatcacaactgtatttcgctaatggtttaatctggtgatgtatactttcgtgaaatgcaaagtctaagtgagctgctttaatccccatgctttcataagttttacacagagaaggcgtgaccgtgaaaacaaaatccggtttcatctttttaattaacgggatagtaaagttttgagtgtgcagcgggtcttcagttgcccaataaacgagagggatattcacctttttagtagcgttgcgaatccaggcctgcttttcccttgaatgctctggtgtccatcccatagatactattaaatctggtttaaattcgtctatcatttcagttatattttcccgacttacaggaccggaaatcattacggtatgtcctgcttccctaaacccattcggtaaaccatagagccacatgggatgactctcaaggaaaagaattttcacacatttccatcctctctttcactttttaatgtctactttattggtatgtatatgtaatataacttgtcgcggtactagtctataaaaaacgttcaggtgtgagatcacgagatagcttgtgtgggatgccccacaaaaaaagaaagcaacctacaacatattttcctatgtggttattcaggacataaggattcctttaaatatttttaaaagtattagaatacaaggacagggatattattttttattaaaagtcaagagcccccgttactttaagtacatttattcacagtgtaatcttttttacaggtcatttagtagtagccccaggaaaatgcgaatttacaacgttaatcaaattcaaatataaaaaagtcgaattccctgtcctttaaggaaaacgacttttttatacgacttcttcaagtaaatccccattaaccttttttggggactatttgtaatctctgcgcagtgaaattatacctgtgctagcccgccatctacgaacaattcaacacccgtcaagtaactgctttcgtctgaagcaaggaaagatacagcgtttgctacttcttcaggtgtcccaacttttccagctggaacagtatttctgctattttccagtacctcttcaagtgcatcaccaaaaagctcatcgtaggcaggtgtaagaatacctcctggactaaccacatttacacggatttcagtaccttttaggtcaagaatccagttgcgaactagtgctcttaatgctgctttagatgctccatatacactaaacgctgggttgccaattgatccagcagtagagcccgttacaataatagaacctactttgtccgggaatagtgataacgctttttgaacagtaaagatggttcctttaacgttaatgtcgaacgttctatcaacctgctcttcagtaatttcacctaatggaaggaagttgccgatgcctgcattagcaaaaagaatgtccaacttacctttttcctgctttataatgtcatatagtttgtctaagtcttcaagcttagaaatatcaccttgaacaccggttacgttcttgccaatttggttaacagctttatcaagttcgttttgtctacgtcccgtaatataaacatatgcaccttcgtttacaaatttttgtgctgtagcaagaccaatcccacttgttccacccgttacaagcgctattttaccttcaaatttacccatacttaacactcctttagaattaattttattttatgtctagtacctttaagtacttgaagaacaacttacaagatatagtatccttcagtaagcacattatcggaagtacccacttttttgtgatatagtaactaaaaagtaataaatgtggaatggagagctttagacatgaaaaaatttagctgtgggtttgaagtgacaaaggaagttattggcggaaaatggaaaggccttgtattatactttttaatgaatggaccaaagagaacgagtgaattaaagcgcattatcccaaatataactcagaaaatgctgattcaaacacttagagagcttgaagccagtggacttgtgagcagaaagatgtataatcaagtaccgccgaaggttgaatattcatccactgaacttggagaatctcttaaacctatcttgcaggagctctgtcaatggggaggctattatgcggagcaagagtatgcagaaggtgaatatgaaattgtacaaccagaacaactaagttaggattgatgtagctgctgaagtaaatgctaaacaacttcaataccatcacctaacagatgaagaacagtcagaaataaatgagatattcaattttgaaagtgaagttctaataagaagtgtcatcgactatattcaggagaattgatgaaattcaaaaaagagctgtttcaaatgttaaagagaaggttcagaaacttagccaaaaaataaatgaagatattgataataatatttaatgcctatgatctctagataggcattttttctttcggataaaaaagaaaagacgtacaaattgtacgccttaatctgcttctgtactatcaatttttcactgcataaaagtcacagttcaggttgcacctcaggtcacactttttaatacaattcccatgagtagagccattttcaggtgtgacttttcccacttttattgagcttagtgcgggtcacacttcgctgtgaccaggtcacatttccgctgaaaattaacgctgaatgttcggattttactgtgactccacttccttttacactccgtatcacacaacggaataattaacgattatcaattgtctccggatacaaatcatggttcatcatacggtattcggccattttctcatacttcgtgccaggctttccgtagtttgtgtacggatcaatggaaattccgcctcttggcgtgaatttgccccatacttcaatgtagcgcgggtccattaattcaatcaagtcgttcatgatgatattcatgcagtcctcgtggaagtcaccatggtttctgaagctgaatagatacagctttaatgatttgctttcaaccattttttcatcaggaatgtagctgatgtagattgtcgcaaagtcaggctggcctgttttaggacataaagatgtgaattccgggcaattgaattttacaaagtaatcacggtttacatgtttattagggaaggattccagcacgtccggtgcatattcgaacaaataatttgtaccttgattgcctagcaatgttacaccttctaattctgattcttttcttgtcgtcatgttcatcttcctttctattatactccgcgtttgttgccccataacagggtgtgcagctgcgggagcactctgacgagattcagctccgcatcgacagctaccttatcaacaagcgcttcatattttccaagcaaatgtgcaatcagtgactgatcatctgtcgtatgcacgtcatcatttccgacttgtaaataaaacgggattcccggataccgcttgtgcacagttttggcaaattccagatcttcatcattaaagatgacaaccttcaagctgacagcatgctgtctatcattctcttgaagtgaagttaaaatgtggtcaagcttttgaaagttcgttaccatttttgagcttggcggttttggagaaattgtcaggtcatcaatcagcgtaaaccaatcctgataaacggtcccttgagtttcaagcgctgcacggatgttattttccttcagcagttcaataaaagcatccagctgttttaacagagccgggttgccgcctgagatcgtcacatgagaaaacgcatctcccccaatgtccttaagctccgcaaaaatctcctccgccgtcatccagcgaatatcttttttagcagacccgtcccaagtgaaagcggagtcacaccagctgcaggaataatcgcagccggctgtccggacgaacatcgttttctgtccgatcaccatgccttctccttgaatcgtcgggccgaaaatttctaatacaggaattcctttagccattcaaaccaccctttttcggacggtagacacagtagcttgtcggtgtttcacggacaaacacctgtacacaggtcggcttattctccaaagtgtctaaataagcctgtacgttgtcataaatcgttttcgccacgacttcagttgtcggcagcgaataccggtcgtcctgagaaaaatcttcatgatcatttaatagcgtgtgatcatagtttccgtgcaccagttttttgagtacgctgaaattgacaagaaagcctgaatcgtcaagttcgtcgccggcaacggttatatttacggtatacgtatgcccgtgaaccctgctgcacgctcccgcactttcccgagggataaaatgagcggctgagatatgcatgtccttattcagttcaaacgaataaggatgctgggcctgcggataaatttgagataacaatttatgcacgctctcctttcatcaccatatattcttcataaccttttgaacgaaggtgacatgccggacattcgccgcagccgtctgcgatgatgccgttatagcatgtcagcgtgttgtttttcacaaaatccagcgcgccaagctcatctgcaagcttccacgtttccgccttattgagccacatgagaggcgtgtggatcacaaacggcttctccattgccagatttaccgtgacattgcaagatttcacgaattcgtcacggcagtcaggataaccactgaagtctgtctcgcaaactcctgtaataatgtggcgcgcgccaatttggtaagccaggatagacgcaaaggataagaataccaaattgcggcctggaacgaatgtggatggcagttcgccgtcttttacttctatctcaatatcatttctagtcagggcattcggtgcaagctgatttaaaagtgacatatcaagcaaatgatttttcacaccaagcttttccgcaatggattttgccacttcaacttcctgcgaatgtcgctgattataatgaaaagtcaccgtttcgacttcttcgaattcttttaaggcccacagtaagcatgttgtgctgtcttgaccgccgctaaatacgacaattgctttttcttttttcatgattcctctccttctccgcaataaaaacgccggcgagagacatcgctacagctaattcacgcaaaaaaacaccttttttcggaaggtgctctagaaaaacataaaaaaggccgtatccaaggatacagctcgtccttagttttttatagagggtgtagctagaacctctcccgcatatcgcacggattttcttcaattttttcacttctgctatcttaccataatgatgtttttcttgacaataaaaaagtcagtccccggttcctagatcaattatcgctctatagtgacggttcgtttcattatatatatttataaactgcgccgccgaggagcttttttgcaaagcaaagcgcctatgaaggccaggctcacatagccaaacaagggataaatcgttgaaataagcctgccgtaccctatttggctcgtaatataagccgtgatcataatggctgcaaagatatatttgcttttcactggaagaaagctttgcacttgtttttctaatccatatagattaccgataactgatgtgaacacttctccgaaaataatgagtaaataaatcaaatggacagatcgtgcaaagagataaaccacttgcgccatcggtatatcatacaaaaatacatccggaagagtcgacaaagacagaaaactcgcggacagcacaatcgtcagcatcgtgcctccgattaaagcgcctttttttatcactttctccgatgacatttcattcgccagcggaaccaaaacagcttgggcaagcgataaatttaaagccccgtaagaaactgctgataacagccaatcccagcgatgcggccagacccactgagctgcgtttcgtgattcgctgaatataaaagagtcggccaccacaatcattgaaaagatgattaaaagaggaacaacaaacacattgacaccgaaaatgccttttactcctctagtcatcacaattaaactcagaccgattgtaatgagcatcccaatctgagcggacatccccagctgttcctcaaaaagcgcccctgcccctgaaagcataacagatgtaactccaaggagaacaaacagcataaatacattgataatccgcccagccgtcgccccgaacaaaaatatgttcatttcttgatatgacttggcattgattcgctttgaaatgatcatcagcttggcccccagtaacgtaaacattccgccgctgacgagaatgccgaaaaaaccgaaccagccgaacttcagaaaaaactcaacaatttccctcccagtcgcaaatccagctccgactactgtgccgacatacacaaaagcaagctgacttgcagacccttttgattgttccatttcttccctccgaacgaaccgcagttttgtccatatatgcctttttataacctatgagacaagttccttgaaaagacgaagaaaacatgttttactttgtaacaaatcaaaaatttttgtgcataagacttgaaagtcaaagatagtcagagtatactattaatcaaagttggtcaaacaaaccggccttttttaaaaatcaattggtcaaagatagtcaaatattcagtctgctttgagcatattggtttgaatgccgttaagtttgccgtatactaatagtcaaagaaggtcaaacccaatagacctttttattcactttcattggtcaaagatgatcaaattattaaggaggttttggcaaatgcgttgtcaacattgtcatcaaaacgaggcgacgattcgccttaacatgcaaataaattccgttcataaacagatggttctttgtgaaacttgctataacgaactgacccgtaaaccttcaatgagtatgggtcctcaatctttcggatttccgtttgaacaggcattccagccgaaagaacagagcgcagcaaaacaaagcgaaaaaaaagggttgcttgatgagctggctcaaaatattacaaacggtgcaaaagccggtctcattgatcccgtcatcggccgtgatgatgaagtggcgcgagtgatcgaaattctaaaccgccgaaacaaaaacaatccggttcttattggtgagccgggtgtagggaaaactgccatcgctgaagggctcgctttaaaaattgctgaaggtgatgttccaaacaaactaaaaaacaaagagctatacttgcttgatgttgcatctcttgttgcaaacacagggatcagaggccaatttgaggagagaatgaaacagctgatcactgagctgaaggaacgaaaaaatgtcattctgttcattgatgaaattcaccttctcgtcggcgcaggctctgcagaaggatcaatggacgccggcaacattctcaaaccggccctagccagaggcgaactgcaagtcattggcgcgacaacactgaaagaatatcgtcaaatcgaaaaagatgccgcgctggaaagacgttttcagcctgtcatggtgcaggagccttcaattgaacaggctatcctcattctgcaagggattaaagacaaatacgaggcgtaccatggcgtaacattcagtgatgaagcaatcaaagcatgtgtcactttatcatcccgctacattcaggacagacacctgccggataaagcaattgatttattagatgaagcaggttcaaaagccaacctgttaattgatgaactgaatgatgaggatgccgctgaacgcttaactgcaattgaagccgaaaaaacaaaagccctggaagaagaaaattacgaactggcggcaaaactccgtgatgaagaactcgcattggagaaaaaactgaacagctcctccgctcataccgctgtcactgtggaagctgagcacattcaggaaattgttgaacaaaaaacaggcatccctgtcggcaaactgcaggcagacgaacaaacgaaaatgaaagaactcgaagcaaaacttcatgaacgcgtgatcggacaagaagccgctgttcaaaaagtggcaaaagcggtaagacgaagccgcgccggattaaaatccaaaaacagaccagtcggctccttcctcttcgtcggtcctaccggcgtagggaaaacagagctttctaaaacactggcagatgaattattcggcacaaaagacgctattatccgactcgatatgagcgaatacatggagaaacacgccgtatctaaaattatcggttcaccgcctggatatgtcggccatgaggaagctggacaattaactgagaaggtgcgccgcaatccttacagcattgtgttgctggatgagattgaaaaagcacacccagacgttcagcatatgttcctgcaaattatggaagatggccgtctgacagacagccaaggcagaactgtaagcttcaaagacactgtgatcatcatgacaagtaatgcgggtgctggtgagaaacaaacgaaagtcggtttccaatcagatgacagtgtcatcgaagaacaaacattaattgattcactgagcatgttctttaaacctgagttcctcaaccgttttgacagcattattgagttccgctcattggaaaaagaacatcttgtcaaaatcgtcagccttcttcttggagaacttgaagaaacattggcggaacggggcattagcttgaatgtgacagatgaagcgaaagaaaaaatcgctgagctgggctaccacccttcattcggtgcacgtccgcttagaagaaccatccaagaatgggttgaggatgaaatgaccgatctgctgcttgataatggcgagatcacaagttttcacgtgattttagaagatgataaaatcaaagtgcgagcaaaataacaatcagcggtttccttttaggaagccgcttttttttatactttcatactcttgacttagaaattaccgtcccttctcctgaagcgctacttcccttcatcctttacacttttttaaggagggatggaacatgtttatatacagtgaatatgtatttctactattatatgaataccatctgaaggacagcttgcaagcaagctgctaatttcagtagacccccgggcttttcaattttggagagcccgtttttgtttatttctcccttctatgcctcttccttgaatatttcatgaacaaattcacaatgtccctaaagttccgggcaccaaaaccgatattaaccatagacaagctagtaaaaaaggatttggtgaaaactatggataaaacttcgttaatcggtattattcttgcttttgtggcattgagcgtcgggatggttctgaaaggcgtcagtttcagcgcccttgcaaaccccgctgccattttaattattatcgccgggacaatctcagcagtcgttattgcgttcccaacaaaagaaattaaaaaagtgcctacgctgtttcgagtgttatttaaggaaaataaacagctcacaatagaggaactcattcctatgttctctgaatgggctcagcttgcacgccgcgaaggtctgcttgctttagaagcaagcattgaggatgtagatgatgctttcttgaaaaacgggctcagcatggctgttgacgggcaaagcgcggaatttataagagatattatgacagaggaagtcgaagcaatggaggacaggcaccaagcaggagccgctatttttacacaagcaggaacgtacgctccgacacttggagtactcggcgctgtaatcgggctgattgccgctctctctcatatggataacacagatgagcttggacacgccatcagtgctgcctttgttgccacacttctcggtatctttacagggtatgtgttatggcatcctttcgcaaataaattaaaacgaaaatcaaaacaggaagtaaaactgcgtgaggtcatgattgaaggtgttttatccgttttagaaggacaagcaccgaaagtcatcgaacaaaagcttttaatgtatcttcctgcgaaggaccgcttgaaatttgcagaacaaggagaggcgcaaaatggcgagaaaaaagaagaagaagcatgaggacgagcacgttgatgaatcatggctcgttccttacgccgacatccttactcttctcctggcattgtttattgtgctgtacgcgagcagctcgattgacgcagctaagtttcaaatgctctcaaaatcatttaatgaagtttttacaggcggaaccggtgtactggactactccagtgtcactcctcctgaaaacgagtcagacggcatcgatgaagtgaaaaaggaaaaagaagagaaagagaaaaacaagaaagaaaaagaaaaagcagctgatcaagaagaacttgaaaatgtgaagagccaggtggaaaagttcatcaaagataaaaagctggaacatcagctggagacgaagatgactagtgaaggccttctgattacgattaaagacagcatcttcttcgattctggaaaagcgaccatccgtaaggaagatgtgccgcttgcaaaagagatttcaaatcttcttgtgattaacccgccaagaaatatcattatcagcggacatactgataatatgccaattaaaaattctgaattccaatcaaactggcatttaagcgtcatgagagcggtaaactttatggggctcctgattgaaaaccccaagctcgatgcaaaagtgttcagcgccaagggttatggcgagtataaaccggtggcttccaataaaactgcggaaggccgaagcaaaaaccggcgggttgaagttctcattttgccgagaggcgcagcggaaacaaatgaaaaatagcaaaaaaggaagccttgtgacatatcaggcttcctttttttacttattatgaaactgttttgcgtttaatcctactctttttaacatttcggtgcacatctctacctcttcttcgcttaatacgctgatcatttcatcaatttcagcagcgtgatcagggaaaatatcgttcaaaagaccgatgcctttttcagtaatttgcgcaaatgtcactcgtctgtctgtaggagacgctttccgaatgagaagttctttttgctccagcttatctacaacgtatgtgatgctcccgctagccaagagaattttatctcctatctgctgcagcggctgatcgcctttatggtacaaaagctctagcacagcaaattcagtcggattcagcccatgcttatgaatatgcttattcatatgatcgttaatagaccgatacgcgcgcgacagcacgataaataacttcagtgatttttctgtcatgtctcaatcatccttttagaaaccgttacagagaaacattaataaacaaagaccaaaatgtcaataaaaatctttccaatatttctcttcttttttaaaatgtaagcttgccaacatctttttctaatttttttggttattttttcttattaaagaagaagaaacaatgatataatacctctaatcaggtgtatgttggagcgatgcaaattgaaaatactaaaaggcgcctgcgggagagtcaaactttatatcatactggtcgtgattccggcaatcgtcatcagctttttcgtatatgaaaaagaaaaagatacaatagctgcagaacataaacaagaagcaagtgtcctgctaaaccttcaccgcaacaaaatcaattatttaatcggagaaacaatggcgagaatgacctccttgtccatcgccatcgacagaccggttgatataaagaaaatgcaatcaattttggaaaagacctttgattcagagccgagattttccggtctctattttctcaatgccaaaggagacgtcaccgcaagcacaaccgaattaaaaacgaaagtaaacctggccgacagatctttttttataaaagcaaaggaaactaaaaagacagtcatttcagatagttattcgagcagaattactggtcagccaattttcacaatttgtgtgcctgttttggactcaaaacgtaatgtgacagattatcttgtcgcagctattcaaattgattatttgaaaaatctcattaacttactaagccctgatgtttatattgaagttgtgaaccaagacgggaaaatgatttttgcgagcggacaagcctctcatgcagaggatcagaaacctgtcagcggatatctggatgatatcagctggaatatgaaagtctatccgaacccggtcacaatagaagaactgtcgaaaagccttgtgcttccgctttcatgtattattgttctgctgaatatcctttttattctcgtgctgtattatttgctgaagcggcagacccagctggagcgctcagaaaacgaggcgcaaaaattagagctgatcgggacgcttgctgccagcacagcccatgaaatccgtaaccccctcaccgggataagcggctttattcagctgttgcaaaagaaatataaaggtgaggaagatcagctttacttctccattatcgaacaggagataaagcgcatcaatcaaatagtgagtgagtttctcgttctcggcaagccgacagctgaaaaatgggagctgaactcacttcaggacattatcggagaaattatgccgatcatttattctgagggcaatctatacaatgttgaagtcgaattacagtatctaaccgagcagcccttactcgtaaaatgtacaaaagatcatattaaacaagtgattttaaatgtagcaaaaaatggcctcgagtcaatgcctgaaggaggcaaactgacgatctccctaggagctttagataaaaaagccataatcaaagttgtggataacggtgaagggatttctcaggaaatgctggatcacatcttccttccctttgttacttctaaagaaaaaggaaccggtctcggccttgttgtttgtaaacggatcgtgctgatgtacggaggctctattcatattgaaagtgaagtgcgaagaggcacagaggtgacgatcaccctccccgtatccgcatcatagcccccctgaccatgtcaggagggttttttatcttcgtgatcgggcattgccattcgatttgcttgctggtcttccagaaaaaaggattttgatgaaacgcaacagcattttcaaaagcaaaaaaaacataaaaaatactaaaaaaccctttataccttccgtggcatctaaaaactccatattccctctccccgtcaccttttgctgaatctcaatcgcaaatacgatgacaatgatgactgtaacggtatagataaaggacaaggctgtcatactccatttagaaagccatgtaaacacagcgtgagtgacgccgaaaaagaatatgccaaaaatgccgatcacccaaaaatgcatttctttgtcagttaaatgaatgccaaatattccgcataaggaaataaaagcatcatgaaattgattgaccatttcggtaatgagaatcgccagttccttcattagttccctctttcatatgaattttttccagaaaaaaagagcgcttccgaaaagctctctctttatatatgcatctgataggccgctatttatttgcatcatatgctggcataacatctctgcggggccacaagcctaatttctttacaaggccttgaatcccttgggaatgttcgttttcttgcataagctgatgatattcatttattaaacaatccagctcctgactgtgcctgatcgtgtcatgccctgtaaatccctgctttctagcggcatctatcattaactttcttttttcatcaatagacaccaacaatctttcttgttcagaagaaccgcccattcacttcacccctcgccgctaagaaataggaaacaagtttgattgggttattgtgcattattacagattatactttatttgtaaacatattttcattaaataagttaatttttcaggtataatagatatattgataggattagaagaacaatacccaggtgaagaatatcttaaacacgccgccaggcaggaggtatgcccaatgaagaaaaagaaagcaataatgctcggagcggcaggcggaaaagcgattttaaagaggaaaaaccgaaaaaaatgtatccagcacatcactactttttttcagatgcttcgcgattggcgaaatggcgactaccctcgttcacaggttaaaacacttttgctgttaactgccgcaatcctgtatatcgtcatgccgctcgatatcattccagacgtaatcctcggtcttggattcattgacgatgcagctgttttaggtttgatttggacactgattaaaaaagaactgtcacaatatgaaaagtggcgtttgcaataaatataaaaagccccgttcgatgaacggggctatctcacgcttattgattcacgctgtctttttcataaataggaacccagccttcagttgtgacaaaaattctcaccgcgacaactttgcggtcctcctgaagcgtgaagtaatggcggatattctcaggcacggagattaaatctccagggtttaaacggacatcaaaaaacgtgccgtcctggccttgaatgacaaaaataccgtgtccgcttacaataaaacgaacctcatcgtctgtatggtgatgctctcttttaaagttttcaagcagttcatcaagtttcggattgctgtctgacaatgaaataacatcctgtgctttatagccgcggcgggttgagatatctttaatttcagtttcgaaggtatcaagaatttgctgtttttcttcttctgtcaggtcatatttctctgagagatgttccggaagcctcgtgatatcccattgctcataaataacctcttgactgtccagaaagcttgccacttcctcttgattttcaatcgttgtatttgcctcatcatgaattcgaattgtagccatttcaattcctccttttatttaaccagctgatgctcgagtgttttcaatttcaaatggtagctgaacaaaaattcatacgcttcaagcactctttttgcctcaaatgctgttttcccccaagccgtaataccatgatttcggatcagaacagctcctgaatcttctgaaatctcttccgcaaacagtgccgctagcgtcgggatatgtgccggattttctataatcggaacggtcacttctgcgttctcttcccacaagccgagtgcttttataatttcctggcctttgaatgtgattttcttttggtctccgtataactctgaaatcacattattgtttaccgtatggacatgcaggcagcatccggcattggttttattgtacaaatgtgtatgcaaaagcgtttctgctgacggtttcagagaatgcccgctttcagcaggctctccgttttgatcgaccagcagaaaatcttcaaccgtctctttgcgtttatcttttccgcttgcagtgacgagaaatgttaaaggctcatctgtaaccttaattgacagattgccgctagtcgccggaaaccaatctctctctgccaattcccgttttacttcagcgagctctcgccagcgttcttgttttgcagccattcctgtacctcctttacattctcaatttcctttctgatctcataaaaatcttgatacggaagatgattgaggttttgctcccggcattcgtttaataaataatcccttgcaaagcataggtcagacagctttgctgcctccacatctgtaaccgaatcaccgatcatgatgatatattggttcggttcagaaagttcatggatgaccgacggcttacagcacccgcattgattgctgcatgtgcccttgcaggaatgaggccagtcaatatggatatagtcattgtcaaatgaagcatggttgcaataaatgcggtctttctccacaatgccttcaagcaaaggatatacaaaaaagtccattccaccgcttatgacataaaacggaatctcgtgctcattgataaatgctacaaattcccgaaagccttccctgatttttgcatcttccaatacaaaacttgtaatctcttcttttaaactgctgggcagaaggccgaacatccgcccgacaccttccttgattgacagcgttttggaaagtacgccgtcttttaatgccatccactctgggggagcaaatgttttcatgatatttataatgttgtcgttcatcgtgattgttccgtcaaaatcacaaataataaaaggttttcgagtcgtcatacggcttcagcctttccccatttatctagcgcaagcttaagatccttgcattgttcggctttttcatcaatcggctgggcctctaggaccgcatcaataatagctctgaacgctcgccccccgccttgggcaccgttcggatgtccatgtacgcctcctccggcgttaataatgtggtctatgccgaaatcacgcattaatagcggaaccatgccgggatgaatgcctgctgacggaacagcaaatgtttggttaaaagcatcctctctcacacattcttcatgaatcgccagtgcatctgctcttggaagcgcaaccgaaccatatggagacggaaagaggctgaagtcagcaccgcaatatcggtttaattttccgagtaaaagagcgtgagaaaaaccgtaaaacggagaagacgtaaacgctccgctcactgctggatgcgccataatcggaactgggatttcaggatcttctgcaaggccttgcataacgtccaagccgtaagcgaagacattaaacaaaagcgcatccgctcccaattcggcggcgcgtctcgctttgtctttcagatcagccgtacgtccggtcaaattcaccgcatacagcgttttatgtccggtttgttcatacgtttctttcaatatttgctttccttctgcaattcttgtttcaaaaggcgctagaccagtctcaaagaaaatttcatcgtctttaatcaagtcaactccgccaagcgcctgctgccggagctgttctttaatatcactcaggtcccttccgattacgcctttaaatatgctcattaacagcggtctctcaaactctcccagcagcttccggatgccgtatacgccaaacttcggtcccggcagtgcacgcttaaatgcttcagagaagtgaagatcgattaatttgatttttccgtccagggacagcttgccaaacactgttgtcagcaaagccggaatatcctgagagaaattgatttcaggataggcaattgtgatgaccgcttgtttttctgatgcagcagttccctctctctcctcaacttttatcacccgccccttgtgcttttgcatttgctcctgttttacaaggggcagatcagtccaggagcctactgtcaatcctgttgcgatttgttctgctttcttctctgtatcggctcccggttcggtcaggagatatgtcgctaataactcactcatgccagagctcctttcattttcatccatatcaaaaaacctcttcaaactgcaatcgcgtctaaagaggtttcgtttctcgtccgaatcttatctctcagccgctagctgcaagaattagcaccgtgctttataagtcggttgccgggcttcatcgggctcgtccctctgcctgctcttgataagaaaatatagattttataaattattttgaattatcccatcgttataaggtcttgtcaatgcttttttgggtaaacaggttcagtttgccaattcgataagcggcttccttaagtctttcttcacttgttaaaagtccgactctgacgtagccctcgccatattcaccgaagccgtttccagccgcaactgccacattcgctttttccagcaaaagatctgagaactgctcagaagtatagccttcaggcacaggcagccatgcaaaaaaagaacctgcgggagctgttacatcccagccgatttcccggcatgccgtgatccaagcgtttctcctgctctcatacctggcattttgctctgccacacacgtctgatcggctaacagtgcctctgctgcagcctcctgagtcgctctgaaaagactgacaaacatatggtcttgataaagattgatcgcttcaatgaccgaagcgtttccgacggcaaagccaacccgccatcctgccatattatacgtttttgacagcgtgtaaatttcaattccgatatccttcgcaccttcagtctgcaaaaagcttaaaggcttgcagccgtcaaatcctacagcgccgtaagcaaaatcgtgaacgacgcagattccgttttcagccgcaaaacgcacggtatcttcaaagaactcggaagtagcaacagctccagtcggattattcggataattcaaatacatcaatttcgcctgttcccttatttcagcggttatgctgctgtaatcagggagaaacgctctgtcctttacgagcggcatcatttccatctttgcttttgcaagtgtgacacccgaccagtaatcaggataacccggatcgggaactaaaatcgtatcaccgggattcaacaagcattgcgggagctcgactagaccggcttttccgccgaataatacagcgacttcggtttccggatccagatcaatgccgtattctcttttgtaaaatgcagcagccgctgacttcagacggtatgagccgcgaaaagacgaatatttatgattctcaggatcagcgacagctcgtttcatctcctcaacaatatgctcaggagtcggctgatctggatttccctgtcccagattgataacgtcatgtccttctgcaagctttcggttcactttctgcaccagagaagcgaagaattgtttaggcaattccttcaatacatgagactgttcaaatttcatctattctcaccttctaaaaaaatcttgaaatgatagtccatcatcatatatggttaaatgaaaaaagtaaagaaaaatttggggtgttaaaaagatgaaatggacgatatcttgtcttcaatttgatatttcatacggaaaaccttcggaaaatataaaaaaggctgaatttttcatcgaaaaagaaagcaaacatgctgatgttcttgttctgcctgaattatggacgaccggatatgatctggccaatcttgatgaactcgctgacgaagacggccgctccgctcagagctggctgaagaaaacggcaaaaaaacatggtgttcatattgtcgccggatcggtcgctgtcaggaagaattctgatgtttataatacaatgtacatcgcggataaggaagggcaaatcattaaagagtacagaaaagcccatctttttcagctgatggatgagcatctgtatttatcagccggttccgaagacggatactttgagcttgacggcgtcaaaagctctggattgatctgttacgatatccgttttccggaatggatcagaaaacatacgacaaaaggcgccaacgtgctgtttatttctgcggaatggcctcttccccgccttgatcattggaaaagcctgcttattgcgcgggccattgaaaaccaatgctttgtcgcagcctgcaattgtaccggttcaaatccggataatgaatttgcaggacatagcctgattattgatccatggggacgtgtacttgctgaaggcggccgggaagaaggcatagtccgagcggaaatcgaccttcaagaaagcgcagaagttcgggagagcattcctgttttcgatgatatcagaaaagatttatattaaaaaatatattgacaactaactaaattacctgttaccatgttcatcaactgataaattagaattgtcaaacaagtgaatatattctcttatcgagagttgggcgagggatttggccttttgaccccaacagcaaccgaccgtaattccattgtgaaatggggcgcatttttttcgcgccgagacgctggtctcttaaggcacggtgctaattccattcagatctgatctgagagataagagaggcggacatagatgttaagcctccttctctctgagaaggaggcttttttacggccacatattaattaattacataattggaggttatgatgatgggagtcacaaaaacacctttatacgaaacgttaaatgaaagctccgctgtggcgttggcggtgaagcttggcctatttccaagcaaaagcacgctgacatgccaggagatcggagacggcaacttaaattacgtttttcatatttatgatcaagaacatgacagagcattgatcattaaacaggcggttccgtatgcaaaagtggtgggagaaagctggccgctgacaatcgaccgtgcaagaatcgaaagcagcgctctcatccgtcagggcgagcatgtgcctcacctggttccaagagtgttttattctgatacggaaatggcggttaccgtcatggaggatctctctcacctcaagatcgcaagaaaaggactcattgagggtgaaaactatcctcatctgtcgcagcacatcggtgaatttttaggaaaaacacttttctactcatcagattacgcgcttgaacctaaggtgaaaaaacagcttgttaaacagtttacaaatccagagctatgcgacattacggaaagacttgtttttacagatcctttcttcgaccatgacacaaatgattttgaagaagagcttcgtccttttgtcgaaaagctttggaataatgacagcgttaaaatcgaagccgctaagctgaaaaagtcatttttaacgtctgcagaaacgttgattcatggtgatttgcatacaggaagcattttcgcaagtgagcacgaaacaaaggtgattgatcctgagtttgctttttacggaccgatcggctttgatgtagggcaatttatcgccaacttatttttgaacgcactcagccgtgacggggctgacagagagccgttatatgaacatgtcaaccaggtctgggaaacgtttgaagagacgtttagtgaagcctggcagaaggacagtctggatgtttacgccaacatcgacggttacctcactgatacgctcagccatatttttgaagaagcaatcggatttgcgggctgtgagctgatacgacgcacgatcggccttgcccatgtagctgacctggatacgatcgtgccgtttgataaacgaatcggcagaaaacgcttggcgctcgaaaccggcacagcctttatcgaaaaacgttcggaattcaaaacgataacagatgttattgaattatttaagttacttgtaaaggaatgatctattcatgacccattcatttgctgttccacgttctgttgaatggaaagaaacagctattaccattttaaatcagcaaaagcttcctgatgagacggaatatttggagctgacgacgaaagaggatgtatttgatgcgattgtcacgctcaaagtaaggggcgctccggcgatcggcattacagctgccttcggactggcgcttgctgccaaagacattgaaacagacaatgtcacggaattccgccgcagactggaagacatcaaacaatatttaaacagctcacggcctaccgccattaatttgtcatgggcgcttgagagactgagtcattcggtcgaaaacgcgatttccgtaaatgaagcaaaaacaaaccttgtccatgaagccattcagattcaggtcgaggatgaggaaacgtgccggttgatcggccaaaacgccctgcagcttttcaaaaaaggcgacaggatcatgacgatctgcaatgccggctcaatcgcgacaagccgctatggaacggcgctagctccgttttacttggccaaacaaaaagatttgggattacacatttatgcctgtgaaacaaggcctgtcctgcaaggttcacgccttactgcttgggagctgatgcaggggggcattgatgtcactctgatcacagacagcatggccgcccatacgatgaaggaaaaacaaatttccgctgttatcgtcggagccgaccgaattgcaaagaacggtgatacggcaaataaaatcggcacatacggtcttgctattttagcaaacgcctttgatattccgttttttgtcgccgcacctttatctacatttgatacaaaggtcaaatgcggcgctgatatcccgatagaggaacgagatcccgaggaagtcaggcagatttccggagttcggaccgctccatccaatgtgcctgtctttaatcccgctttcgacattacacctcatgatctcatttcaggaatcatcacagaaaaagggattatgaccggaaactatgaagaagagattgaacagctgtttaaaggagaaaaggtgcattaaaaaaccgctggactttgctcatttggagccgagtcagcggtttttttgtttctttttgttaacattgatgatttcatctttttgagcgcttgataagatatgcagtttcacaaacagttcggcaaaaacggcaagtttctcagagcggctcggcttcaattgctttgtcctcctttttcatcagaccaacttttttaacttaataaaatgatatgtcggccgtgaaaaaagggaacgtgccatatgttttatttttctttataggagattcgctcgatgtttagcaaaaatgctttgatctccgttttgcttccggcgtatcctgttaacgcactgtttttgccgatcactctgtggcacgggacaaaaatcggcaggtcgttacgtttattagcctgcccgacagcgcgcaccgctttcggactgccgacagcagcggcaatatccgcatagcttcgggattcgccatatggaatcctctccagcgcttgccacactttttgctgaaaaggagtgcccttttggctgagcggcagggagaatgtcttcctttcgcctgcgaaatattcttgaagctgttgtttcgcttctgcaagattaggtgtttccttatgctcagtattctgaaccgtttctttccaatccacccaatcttcctgactgagaaatagacgagtgatccggtcctcctcttcggcaatgataagttcaccgagcggcgtttcggctgtcgtatagtagttcattcatcattccttctttcttcagcattctgtctgacaggaagcgtaatatggaaaacggtgcccttcccttcttcactttctaccataatctcgccttgatgttcttcaataattttatagcttaccataagcccaagtccagttccccgttcctttgtcgtataaaacggttcaccaagtcgctttaatttatcttctgtcattccgattccctcgtcttttaaggagattagaacatgatcttgatccaatgcctttatcgttacaaaaatatttccgccgtcaggcatcacttcgatggcgttttttaatatattgataaaaacctgtttcagctgattcggttcacagtaaatcgggggaatgtcgtcaattaaatcaagttgcatttgtacattgctgagattggcttgcgcatttagaaggtctatcgtgtccctcataatttgggtaacatgtttttcctcatacataatggcctggggcttggctaaaatcaagaattcggtgatgatggattcgatgcgctttagttctgaggtgatcacgttgaagtaaagggcgtagtctccctcgacactccctttcagaagctgaatgaagcctttaagagcagtcatcggatttctgatttcatgagcaataccggctgcgagttcgccgacaacatgaagggtatctgatttgcgcaggcgctcctccaattcttttcgctctgttacgtctttaaagatagccaagttcatattttgaataatattccgtttaaatgagaattcgagttttctgttatcaccgctgctcagcaaaaatggaatttcgttgtccatttcatcaaaattaatctgccttgccggtgatgccaaattttctatttcataagcagaaataatatctaacaggctgtgctgtttgatctcttcatgtgacaggcccaaaatatggcttgctaacgggttggcgtcgatgatcctgtattgattgtcgaacaatacattgccgtccattgatccgttgaacacttttctgaatttcagctcgctttcccgaagctccttttccatccgctttctgtcgcttacatttcttaagatcgtcaaatgctgattttcaaggattgtccgttttgaagtaaattcaagctctttgaattggccgttccccatttgaaacagcagctcttctctgatctctccgtattttgcgtatttcctcttcgttatgctgtatttctgctgcgagtcaacgagaaaatcacacagctttcttttcaacagcaaattcatcggcagctcaaaaattttacaggctgattgattcgcttttacgattcttccgtcattcgaccagatgatgatggcgtccattgcattttcaaagatttctctgaagcgctcctcacttttaaagagctgcagctccatagaccgcttctctgtgatatccctcataatggacatataaaaaccgctgatgatgtttgatgtaatcgtgaattcaaatagtttttgaactcctgaacgaagcttgacaggcagctcccccttcgcttttcccttgcggttgagcgccttccagatattgtcgaaatcttttcgtgagccgctgtctatgaactcatacaaagataaatgagacagctcattatgattgatttcaaagcttttacaaaaggacaaatttgcatcaataaaaccgccatctttatcaaacaggacgattccgtcaactgctctgtcaaacaagtccttaaaaagctgttcattcatagagaattcccgctccagaatcttcttagaagatatgtccctcatgacaacaaaaaagaaatcctcaccaatacctcttttggccagaaactctatgtattttgttgccccgcaatcaagcctgatcggaacctccttccacagaaagccttttttaaaaaacttctttacggaaagattcagttcatcctttgggattgaaaacaaaaaatccaaaacagaacgctttttcaaatcttccgagtcaacttgaagcatcctttctgttgcttcatttgcctgaacaatccgcatttcgttatcacaaataaaaatagcatcgagcgtattgttgacaatcacttgatgctgattcaattcctttttcagtcgcgcgttttcttctttgaggcgattcagttcctctcgcagctccgagtttgtctggacaccaagagtttccatgcatgtacactccttcttcaaaacctatccctcaatatttctacaaaatgcgggaacttccttcatttgccctataaatttcagaaaatttcagcgtcattacattacgaagacattttctacgatccttaccgtcactttacatcgacctaacaatcagcatttttttagattcctttttcatcttttattttaaaatatgtaccagcagggaataatctcttagtgactgatgaaagagaaggtgatgctatgagtaaatcgcgggacagttatttcgataacgcaaaatttttattgatattccttgttgtattcggtcatatccttcgttcctttattaatgataatcattttatgctctacctctacaagttcatttacacattccatatgcctgcatttattcttgtatccggttatttcgcgaaaggctttaaacgggcgggatatgtaaaaaagctggcggtcaagctgattattccgtatttgattttccaaattatttattccgtcttttattacattatgcaagatgaaagcatggcaaatgtgaacccgattgatccgcaatggtcgttatggtttcttgtaagcttattcttttggaacctgctcctatatcctttttcaaagctttcaaagcagtgggcgctgtttgtcagctgcggaatcgccgtgctgatcggttatctggactttgtcagcagcacgctgagcttgtcacggacattcgtattcttaccgatgttccttgtcggtttttatttaaataaacatcattttgatttattgagatcaaaacgcggcaaacaaattgcgctcggagtgcttgccgcagtattcgtcatctgctggggcatcgattttgactattcttttctgtttggttcaaaaccgtattcttcatttggagacgttaccctggtaagcggactatcccgaatcggctggtatgtactcgcctttggggcaaccttcagctttttagcgctcgttccgcaaaaacggtatttctttaccaaatggggaacccggacattttacgtgtatctgcttcacgggtttattattaagacattacggcaggtcgggcttgaggattggcttactgactatcaaagcttagtgatcctcttgcttttaacagcagccctgacatcagtcctctccagcaactttgttaagacagtcgctcagccattcattgagctgaggatgacaagcttattgcaatttgtcagaggaacgggcaaaaatgcttatttaaaatagaaaaagcacctcttaagcgggacgccgcctaagaggtcttttttattgttgttttttgttttttcttttttcttttcaggcttggtgacttccagcgtttcgatgatctttccggcattgtaatccccgagttcacttgagaattcttcctccagcacctttttattcataggctttttatgattttgcatgtctctgctatgacggtttttcttcacaattacatgcctccctgctggccctgtttggaattgcggtttgcccctctaaaattggggtcgtcatgatattgtgtcttatatgaattggggtccatgctctcggtaggtgtattgttatttttaatggcttcattcacttcagctttacgcttcatacgaatcctcctcgccaattttcagacattttaagatgcaggagcgtaaattgcacctgtcggagttaggttctccaactgaacaggaggcacacatctttttttggtaatcaaaaaacaccgcaaaatatgcggtgttttgcctatccgataatcactctttccttcggatagtgataattcgcttcaatttcctttcttccgatcagatacaggaaggtcaagatgccgattcgcccgataaacatgacaatcataatgacgcattttccaacactgctcaaatctgccgtaattccaagcgataggccggttgtaccgaatgccgagcacacttcaaacaaaagctccagcagggaatgtttttctgtaatggtcagaatgagtgtcgcgccaaaaacgagcaggatcgccatcatcgtgacaacaagcgacttcatcaagtcagcagggtgaagctcccgtttgaatacctttacggccttattgccgcgggcaaaatgaaacagcgcaagaaggttcaaagcaaaagtcgttgtccttatgcctcccccgactgagcttggcgacgctccaataaacatcagcgcacaaataaaaaagagtgtggaatctgataattggctgatatcgattgttgccagccccccgcttcgggttgccgttgattgaaacagggacaaaaacaaaatatcatgccatgattttcctgcgaacgcatggtttgcttccagggcaaagatgccaatggctccaaacaagacaagtgagccgaacgtaatcgtcgtgatctttgtaaaaagcgtaaatggataacgccgatgctttgaaaacaggaaatcctttacttcaacaagcacgggaaatccaatcgctccaaatataattaaaagcattgtaataaactgcacaaagtaatcgtggcgaaatggaatcatcgaattaccggtaatatcaaatccgccgtttgtcgttgcactgatactggcaaaaaatccgtgtaaataggcttcctgataggagtcatagtaggttaagaaatatgtgccgagtatcagcccgccaaaaaattcaatccacaagatcagaaacagtacctgcttcatcagattgacaattcctgaaaactgggattggttttgatcaaccataatcagcttccgttctttcagcccgattcgttttcccatgatcagccaaatgaacgttccgagcgtcataattccgattccgccaaattgcagaacaaatgctaatataaaaatccctattgtgctgaatgtatcagctgtatcaacaactgtcagccccgttacactgactgaactgacagctgtaaaaagcgcatcaataaacgtccaatccgcccccggtttatgggccgccggcaaactcagcaatataacggccacagtaactgcaagaaaataatataatgcgatcagctgggccggtgacaaggcctgtatcaattttccaaactttaatctcatgtaaaatccttctgcctctctttttaagtacggtaattattctaaagatattaggtccatttttaaaggcttttacgaaacattttcttaacttgcttattttttatgattttagtcaatggataaaataaaaaacctctgagaattctctcagaggaacaatgtgtttgtattatttagcttccagccgtctgattcgctcatctaaatcaggatgagtagagaaaagtgaagagcgcttcttgccattaatctttaacgtttggacagctgtctgatcgtcttccaaaatccgggaagaatagcttttaagcgtccgcagcgcatgaatcatcttgtccttgccggcaagatccgctcctcccctgtcagcatggaattcacgatggcgtgaatacgcaaacacaaccaggctgccaagtatcgaaaagacaatctgaaaaataatcattgcaataaaatgaacgatcggcgctagatcttctttgacaaaacggcttgctatccaagcggcgatacgcgataaaaagacgacaaaggtattaacgataccttgtaaaagcgtcattgttaccatatcaccatttgtgatatgcgcgacctcgtgggcaagcacaccttcaactgctgcgtcatccatctgctccagcagccctgacgatactgcgacaagtgaacggcgttttgacggtccagtcgcaaacgcgtttacttcaggtgaacggtaaatcccgacttccggcattttcgttaaaccggcagagcggcttaatctgtgaacacgatcaaccaattgctgttcctcatagctgagcgagtgttttttcggattcagcactctgacgcccatcatcgtctttgccatccatctggatatcgcaagagacgtaaaggaaccgacaaatccaacgactaaactgaacacaagaagcgccattggatcgataccgccatcagctgtaaagtacgtcccgactcctgtaacagagcttaaaacagacaaaacgatcccgattgttgtaagcaccaaaatattcgttagaataaacagaaaaattcttttcgccataacaacctccgttattttaagttcaaaagaacccgtatatttaaattataaaacatccatttgaaaatgcaaggaattcgacgtatgatgttaatgtaatttgctgacgcttgaattttgaacttatacatagacctatatccgcgtcaaattgtttaaagaggtgaacaatgaacatttttaaactctctcgaaccgatatggtgcggctgctctattccctaaaaggacaaggagaacatagcccgctcgacattctcgtccaatcagcgaacatgtcagcagaaaaagcagccaatcatctagaaattcctgaatttcttacaagatacgaacgaaaaaaacagaaaaaagaatacggtctgtctacaaatgaaatcgtagagcttggcaacttatgcgagctgacttcgttaaagtcaaccgcgattcaaaactgggtaaagcgtgatatcaaagatctgatcggacaccctgagctgggcaaaaaatactcaattgaacaggcagttattcttttaattgtacgtgatttaaaatccatttatgactttgaacacatacgggctattttaaaagtggcctttaacacaatctcagacagatctgatgatgtcatcagcccgattgcttattatgaaagctgcgcatatgtgcttgatgccatccatcaccaagatactccttctatgaaagaatcaaatctgcaggagatcgccgaacaggagacagagcgtctccgtcaccgttttgaagaactgaatgacagccaatggcttaaaatcagacagattatcgccattacagtcctctccattttgacattccatattcaggcaaccgcacataaaatgacagcagacattctatagtctgcgccaccccggctcagaggccggggttttatttttctccacaacaattgccagcataaataaaccccgtatatttcaaactaaatacgcgttaagaatttctttatcgaaaaaggagatgaaaaagatggcgagcagaaataaactcgttgttccaggggtggagcaggcactagaccaatttaaactcgaagtggctcaagaattcggtgtgaaccttggttctgatacagtcgcacgcgctaacggctctgtaggcggagaaatgacaaagcggctggtacagcaagcacaatcacaattaaatggcacaactaaataaattcaggtctttattcgccgggggcactcggcgaatcttcatttttagctgaatgattatcactgctgtagccgtttggattacgtcggtctgaagcgttatcccttctggacgaagaacggttcttgccttgttcaccattgttccagtccctgtgatattggctttggcccttgtcagcgccgttattttcatttcctttatcttgaggatcttgtattggggtttgctcatggtccccatctttttcggtatttgtgttttcatctgattcctttatttttttatctttgtcactatcatcaatctggtcatccgctttctcttctttctggtctccggaatccgcatcattcagctgttcattatctccttgcttgctgtcctgggtgtcagtttgatcggtgttttcatcctcattttcatcactcttttgatcctcttccccggatggtttgctggagtcatcttttatatctttattgtcattcttttcatttgatttgatgtagctgcctgttgagacgccttctttcttcgctttttccctcgtttgcatatctgactcgagagattccatgcggtatgtcgttttatatttttcagtcacatcattcagctgttttttcacagcctttttatatgtattgtcttctgtgttttcataaacagtggaaatcaatatttctttcgatttttttacatacccgtgttcactgcagtcggttataatatcgtcaatcacctttttaaaatcagtcttctcccaatcatctatatcattcacgactttctgtccctcatcgtttagaggcgtcagttcaatcacttcataatcgctgtttaacgccatttcgacgcttggattgatatcgattgtcatatacgcataggccttattattagaaaaaacggggagaactataaaaataaagagcataatagcagtcatcgtaaaaatccccattttgaaagggcgcagtttaaaaaaatcaaaaaagctggcccttctgcccatgcgtgtttcactcggaagcatgatttcttctccgatttcatagctgtgtcgatcatttttggcttttaaaaattgtccgtcaggggtcagcaacgtgacgaattttttatttttctctactataatccctcttctcatgagtgcagcacccctttaagataatcttttaaataaatataatcacccgtaatgataatacacatcgcaataatatattttctgtttctctcaatcgtttttcggcttacagagacaagctgttcaagctgtttgaccggaagctgcttctttgtatacaggatagcggccaattcttcatgttcaacaagcgtcattgccacctttatggcgttttgccttgcatccgtgtgttttggagaattttcaagcagttctttaaacgataaaccataatccttgagctgcttttgaaaatagaggatttcctcccgcctctgctcctgttcaatctgacggcggtattcatcaatggaaagctcggcttcaatcaggctttgtgatgactcctgatcgtctccttcctgtaaatcgatatttatattttgtgcgcttctggcttcttttctaatgtaatcaatgacttttctttttataataagctcagcaaatgcgagcagagaatttcctttttcaggtgaatatttttctatagcttcattaaacgcgatcagtccaatactgaactcatcgtctttttcatctatatatcgtttacaaacggatgaaaccgtctttgcgataaatggcttatattgctgtattaattcattttgcagatctttattgcctttttgtatactctcaacagctttttcaagtgtttgcttcttttttcccaatttaaacaaaaggctaagcactggtttcacctcagttcctccctataactactcattaatgatagctaatttgatagggattcgcaaaggagaaaaagaaatattgatttccaatgtctcaattatgacaaaccattctgacgttctatacatgatttcgtgcctttctaaagaattaagggggttttatgcgtgttttttgtaacaaagatgttataaaaatgttattttatttcgcttatgaaaacgcttcaaacacaaaaagactctgcttttaagcagagtctttcagattacgcccgttcacgggtgctgtttttttgttcgttttgtgcaccctccggctgttttttcccacctgacataaaccagccgcaaaccgcgattgctgctaagacaccccagaatatcagcttccatgttccagaatggataaagtgctcagaaacaaccgctatgtcgcgatgggcaagcgtatataaagcaagcttcactccgacccagccgacaatcacaaaggctgctgtttctaggcttggacgttcctttaataacttcacaaacatggaagccgcaaaccgcatgatcaccagtccgatgataccgccggccaaaatgacgagaaattgtcctccgtcaagtccgccgatcttcgggagtgatgtcccaggaagtgtaaccgccagcgctactgctgctaagatggaatcaacagcaaacgcgatatctgccagttcaacttttaaaacagtcggccaaaaaccgctttgcttcgtctctttatgtgtgtcttctttcttaaatacatatcttttcaataagtggcttgctgagatatacagcaaatagatcgcgccaatcgcttgaacctgccatacgttgaccaagaaagaaattgcaaataaagagccaaatcgcagaacaaaagcccctgccaatccataaaataacgcttttttcttttttcctccggcaaatgttttaccattaccgccataaccagcgcgttatcggcggctaaaatcccttccagcccgatcaagacgagaagaacccaaccatactctaataataatgctgcatccataaatgataccctcccaaaaaagttgttttctttctcttcatccgatcttatgccggccggaccatgcaaaaaagacctttgccgacataaggcaaaggtcttgctagacatgaattcaggcatgccaacaaagccgatggatacaatccatgaaatgacgactttgtttccggaatacattccggacgctactcccctttgggatttcaagaaatatgattttatacgtcaataatatgcgcagcgcagtgatttgtcaacgtttatttttcaaaaatacagataattgttcggagtgcgtgcgtttcttcctctttttcatcagtaagtagagcaggaacagcgccaaaatcgctatcccgatcggaagcatatattgatcaagaatagagccgactgccttccaattttcaccgagcttcacaccgagataaacatatacaaatgtaatcggaagcatagcaatgaatgtataaagcgaaaacacccaaacattcatttttgcaattccgcacggtatggaaatcaatgtcctgataccaggcaagaaacggccgctgaaggcgacaaagcccccatgttttttgaaaaaattatctgacttatcaagcgcttcaggtttaataaagagatacttcccaaaacgttcaagaaacggccttcctccgtaccggcctatccaatacagcgtaagcggaccggccactcctccaagcgatcctgccaaaacaacgccagcaagtgtcatatcgcctttagatacccaatagcccgcaagcggcaagacgacttcggccggaataaactcaatgctgagcgctagaaatattccaaaataagataagcttttaaatgcttcaatccatgacataaccagctcttcgatagccaccaactcccttgtttcatgtttatgtatcatacatttttctcttttcggaaaacatcaagatgattttaacacatttttcacggtcagttgaactaaaaatagatctccctcgtatttctatcgttttgaaggctgaaactctgcggttaagcagccgataataaagagagtcaacaagactggaacacacgatacggggggaatctccatttggaaatacacgttacatataatacgactctcatatgtttatctattctaattgcctgtaccgcctcgtatatttcccttgaactttcaaggaaagtcaccatcaatacaggcttaaaaagtaaaatttggctgatcggcggctcacttattatgggattcggtatttggtcaatgcattttgtagggatgatggccgtccatatggaaatgccgatggaatatgaattcatgcctttaatggcagccattggcgcatctgtttcgggatcatttgtgtcattatattttgtcagccggcacattcttacatattacagactgcttaccggatcagttgtgcttggcgcatctattgcttctatgcactatatcggaatgtctgccatttcccgggtaatgattatttacgaacctattttatttacagtttcaattatcattgcgattgcagcctctttcgtctcgttaaaaatattctttgacttggccgtaaaaaaacattctgagcatcttatattctataaaggcgtcagttcaattgtaatgggcattgggatttcgggcatgcactacacagggatgcttgcggcaactttccataaggacatggctccgcccggaagccatatggaggtgcaaacgtttcattggtcaatttttgttactttaattattttttgtatccaaacgttattgttattcagttcccatgcagatcgaaagtttattaaacagagcgaacgcataaaggataacgaacagcgatttcagtctttaatcgtccacaatattgatgcaatttttattttatcattagaaggagacataatatcttccaatcacgctggtgaggaaatgatcagcaaatttggcttcagcatgcatgactggaggaattacacatcactgaaggttaagcgcctttttgagcaagttaaaaaagataaacaagcgatgaacagcgatagcgatcttatcactgaaaaaggccagtttcacttaaatattacgcttatacctgttgaggtcaatcaggaactagacagcatttatgtcatttgtaaagacatgacgaagcagtacaaagcagaaaaagaaatccatagaatggctcattatgattcgcttacagacttacctaacagaaggcatgccatctctcatctaacaaaggtgctgaatcgcgagcattccttgcattataacactgttgtattctttcttgacttaaaccggtttaaagtgattaacgatgcattagggcataatgtcggtgatcaattgcttcagtttgcagctaaacgcctgtcatctgtagtccctgataacggatttatcgcccgtcttggcggtgatgaatttattattatattaacagacgccaatacaggaacaggcgaagcagatgttttagcaagaaaaattatccaaaaattcaaaaaacctttcaaaattcaagatcacacccttgtcacatctgtcagtatcgggattgcgatatctccaaaagacgggacggatggccttgaattgatgaaaaaggctgatatggcgatgtatgcggctaaagaacgaaacaaaagcaaatacagatactattctttttcaatcggcaacaaagaaaccgttaagcttaaccaagagatggtactcagagaagcaatcgaaaacgatagatttgtcttgcattatcagccgcaattcagtgtgaaaaaacaaaaaatgacaggagcagaagcactgatacgccttgtgacaccagacgggcaactgcgtccgcccggagaattcatcggtgttgcagaagaaacgggacttattattgatatcggaaagtggattatagatgaagcatgcaagcaggcaaggatttggcatgacaaaggctatgatctttctgtcgccattaatatttccgccagacagtttcaatctaaagatctgattcccctcatcaaggatacgcttaataagtaccagcttcctccgcagcttcttgaagtggaggtgacggaaagcatgacaatggacaatctcaatcactccaaaaaggttttgtcatccctaacagaattaggaatcagaatcagtattgacgatttcggtactggtcacagctctcttagctatttgaaggacttcccgattcacaggctgaagattgacaaatcatttattgacgatattcagacccatcctaaatcagagcaaattaccggagctattattgccatggggcatcagctgtctttgcaggtgattgccgaaggtgtggaaaatgcagctcaaaagcagcttctttttgaaaaaggctgcgaccatttgcagggcttctttttcagcaggccaatacctccggaacaattcgaacaattcattattgaacagccgtcgcaataacagcgccggctttttttcacccataagttactacacatgaatcgtactccttctcttcacactaaagaaaaaaaggggtttatcgatatgcatacaatgtggaagggatcgatcagcttcggattagtaaacatccccatcaagctatatgcggccacagaagataaagatattaaactgcgcagcctccataaagaggatcacgcaccaatcaaatacgagaaagtttgcacaaattgcgaaaaaactcttagtcctgatgaaattgtgaagggatatgaatatgtaaaaggaaaatatgtagtgctgacagacgaagatttaaaaagcttaaaacaggagcatgaggagaaagcagttgagattgttgactttgttcagcttcaggaaattgatccgatttattttaaccgctcctactttgtcggccccggggataatgggacgaaggcctataccctgctgcgtgaggcgctgcgctcaaccggaaagatcggtatcgccaatatgacaatcaggtcaaagcagcagctggcgattctccgcgtttatgaaaattgtatcgtcatggagtctatccattatcccgatgaggtcagaagcgccgctcaagtcccaggtgtacctgatcaatcgaatgtaaacgataaggaactgcaaactgctatcacattaatagatgaactgactgctaagtttgagcctgagaaatatgaagacacgtaccgacaggcgctgctgcaaagagtcaacgacaagctagaaaataaagaaacggctgtcactcctgataaagcgccacctcgtgaagatgtcattgacctggtaagcgctctgcaagccagcatcgacagaaccagaaggccgaaccgggagacaccggctgccgcacctgcacaagccgctgaaccgaaaggagccggagataaaaaacaaaaaacaactagaaaaaaagcctccggcacatcatagcgcatggcgtttaccatgcagccggtcttaacttcgtcaccgccaatcggagcagaatggcgttacgaagtaaaatatgatgggtaccgctgtattctccgcatccattcttcaggtgtgaccttaaccagcagaaatggtgtggagctcagcagcaccttccctgaaatcacacaattcgccaaaactgcctttcagcacctagaaaaagagcttccgctgacacttgacggtgaaatcgtatgtttggtgaatccctgtcgtgcagattttgaacaccttcaagtgcgggggcgtttgaaaaggccagacaagattcaggaatcggcaaacgcgcggccgtgctgctttctcgcctttgatttgttagagcgaagcggagaagatgtaacgcttctttcgtatttggaccgcaaaaaatcgctgcgtgaactcatatccgcagcaaagcttcctgcatctccagatccttacgcaaaagaaaccattcaatccattccctgttatgatcattttgatcaactctgggagatggtaataaaatatgacggagaaggaattgtagcgaagaaaacaaacagcaaatggcttgaaaagaagcggtcgtccgattggctcaaatataaaaactttaaacaagcttatgtttgcataacagggttcaaccctaacaacgggtttctgacggtatcggtgttaaaaaacggaataatgacaccgattgcctctgtctcgcacggaatgcgtgatgaggaaaaaagcgctatacgcgagattatggaacagcacggacatcaaacaccctcaggcgaatttacgcttgaaccttcgatttgtgcagctgttcaatacttaacaattctccaaggcacattaagagaggtatcgtttatcggtttcgaattccaaatggactggaccgaatgcacgtatgcgcaagtcatacgacactccaaaccggttcacccaaagctccagttcacaagcctggataaaatcatatttgaaaagaataaaaaacaaagaagattttattcagtatatgattgaagtcagtgactacctgctcccatttctgaaaaaccgggctgtcaccgtcatccgctatccgcatggatctaggagcgaatcatttttccaaaaaaacaagccggactatgcgccggattttgttcagtctttctatgatggaagccatgaacatattgtctgtgaggatatgtctacattgctatggctttgcaaccagcttgctttggagtttcacgttccttttcaaaccattaaaagcaggcgtccggctgagattgtcattgatttagacccgccttcgcgagatgactttcttatggccgtgcaggccgcaaatgaactgaagcggctgttggattcctttggcatcacatcgtacccgaagctgtccggcaacaaaggcatccagctttatattcccttgtctcccgaggcatttacgtatgaagaaacacgccaatttacgcagctgatcgcagagtactgcaccaatgcatttcccgagctctttaccactgaacgcttgattaaaaacagacactgcaaattgtatcttgattatttgcagcatgcagaaggaaaaacgattatctgtccctattcaacgagaggaaatgagcttgggactgttgcagccccgctctactggcatgaggtgcaatcatctttaacacccgctctgtttacaattgatacggtcatcgatcgaattaagaagcagggctgcccattttttgatttttaccgcaacccgcaagacgaaccgcttagcgctatattgcatcagttgaagaaaaagagctgactaatgaagtcagctctttccgtgtttaactgtactttttttctaaccgctctttttcctggcgctgaagcgggctcagctgttcattatacaaatcaatatcaatcgcgtatttcggccgtcttttcacttcagaaaaaatcgttccaatatactctccgatgattccaattcccatcaattgcagcccgcccaaaaaccaaatggatatgataagagacgcccagcctgcattcgtatggccgagcagcttttgaataaacgcgccaatccctgccacagcgctgaggaaaaacaaaacaaaccctaaaagcgtaaagaatcgaattggtgcgacactgaatgaagtaatcccgttaaaagcgaaggatagcatctttttcagcggatatttcgttttgccggcaaagcgttccttgcggtcatacaaaacttcggccgatttaaagccgatcatggggacaatacctcttaaaaacagattcgcttccggataacgctcaagctcttcaagggaccttttattcattaaacgaaaatcagcatgattataaattaatttaatcccaagtttattcatgagacgataaaaccctaacgcggtcgtgcgcttgaaaaaggtatcggtttttctgctccggcgtacaccgtaaacgatctcgcagccctcatgatatttcagcataaaatcccggatcacagagatgtcgtcctgaagatcagcatcgatcgaaatgacgcagtctgacctattcttcgctttatgcaatccggctaaaagcgctttttggtggccgacattgcaggctaattttaagccggtaaccttcttgtttcttatgctctccatagcaatcaaagcccaagtgcggtctttgctgccatcatcgacaaacagaattttactgtcttcagcaattaatttttcttcaattaaatcatctacaacctctgtcagctgatggcttgtttcttgaaacacttcctcttcattgaaacacgggacgacgatggttaatactggctgtgactgtttcaatcgatatcctccttatcttgtttcatataaataaatgcgccaggcggaatctttatggtcaaacgtctttacgagcgcgagatggttttgttcagcattcatgatcggaactgaagaaaaaatgtaccgtccacccatttttttaaatacatctgtatttaattgaaggttgttgatcgttttcttcgagttctttttgaaatcatatcgtttaccgagttcatcgacaaaaaggtagcagcggctgccccattcatcaaagtattgtttcagccgagaatttttttccagctctttttcgatgatttttctaaattcatatttatatgagagcggatacagattgttatacgtatctaacgtataaaacccgttatattgggcgatagacggatgcagtccgatgctcgccaccctatacgaatcttgcggacgtccgatatattccttaatctctttgaattgctctgatgcataaaactccctgaatgtcggcgcgttgtaatgaacaccatacgtatattcttcattaaaaggcgccaacaccatcagctgtgcagcgactgcggcgtacacaagccatttccatcctttccccatccgccaaatgagatataaagcaagcgcaaagctcacgtatataacaagcggccgaagaaaatgaaaacgggcaaaattaaattctgctaaaaaagcaaatttctgctttggaacagcccaaattttgttgaaccaaaacgcataccataatgacaacccgtaattaagcacacataaaaacagataaacattttctggctttgtccgatttcgtttgaacagcagagcagcaaatacgaccatcaggatcggaaggatgacaacggtatgaacggtcatcacatgattatggccatagacaaagttttttatggatagtcgaagagaatgccaaacgtcatgcctagatgagataaattcgatacgatgcatcggtgcgtgctcaaacagcatcgaatagacaagccgatattcaacgaaaagatagatactcgtcataaatgcaatactgcctaagaacatcaaattccatcttctttttgtaatggcatcatacagccaaaaacacgccatccctgccaggaaaaagaagaagcctagaacaaagcttgagtatagagggagcaagcccagcgtcagccactctctccatgagatatccccttttcggatatttaaaaaagcccacagtgccaaagggtacccaagcgtactcagcattcccgaaggccagaacggtgttaaggcaaatgcaagcgatacgccaattcggatgaaagccgcttttggttccgggattatatgtttcttcagcagcacatacattccaaaaaaagcgacaactcttgtaaccgtctggcttattgcataggcggtcatggaagaaaagaaagcatggagccaaacaattccgctccactcggtgccaaaggcatcccggggcagcccgttaatgatttgcggaatggcagcgtcaaccttgccgacgatttctccgctatcggccagaaccttgtaccaagcgatgttggaatctaaattatcgtggacccggatatgggcatcttcctttaaaataaaaagcggggatacatacaataaaagaagaaataatgcgatccagagataatatgtttctttttttgttgtctcatcaatcgtaacattgcttacacatccatttgttattctgactccgtcggcatgttctgcctcatgtgtcaaaatttattatcccttttcccttccaaatcattcatcatatgacaatccgtttttcaacctgtctctacccattaattcccgctatccatagggcttgatcacttactatactgatagaagggaggggatatattttgtttacaatcttactttcattggccatactcgtatttgtgccatttctatataaagcgaaccgcaatacaaaagatgtgaaagtcaacaccatttcaatcgaccaaaaagacggccttccagccagaaaaaaattaaatatccttcatttatctgatcttcacttggaaaacatttcagtctcacctgaggagctgtatcatttaacaaaagatcagcctgtggacatcattgctcttaccggggattttcttgatcggaaacgtaatattccgaaactggcaggttacttgaacgccttgcaaaagctaaagcctgcatatggaatgtacgcggtgttcggtaaccacgattatgtattgaaagaagaggactttcagagattgaagcgagttttagaggaaaacggctgtatcacgctgcaaaatgaacatgttcgaatcgagacggctgcaggaccagtcaatattatcggcattgatgattacagtacgaatcggagtaatatcaccggctcttatcaaagtctggaaaatggctatcatcttgtcttaacacatgacccaaatattattctggatatgaaagatgttcattatgattacctgctgtcagggcattttcacggcgggcaaattcactggccaaaaccgtatcatttggtgaaaatgggaaagctcgtgcgaatgaacatgattaaaggccttcattatcatcacgataaaccattttatatcagcgagggcttgggacaaaccggcgtaaatatccgtgtcggaagccgccctgaagtgacatttcatcagatttaatcaaaaaagactgtgctgaccgaggcatcagtcttttttttgataggttttctgcagcttttcttttgagataaacaaataggatgaattcggtaaatgccgcaagctcacaggctttgaagtcaaatataaaatcggcacatgagacacttttttaaagcatctgtaaaaagggttcaccggggtgatcacatcaaagccgagcctttccacacctttgtcaagcattgtaatcccaatgattcctttgattttctcgctttttttatgattgttgatatagtcaagaagaagcggcatcgattgatatactttctgataaataatgattccctttctgactgcgctctcaatgctttgcagctccctgatcagctttatgttatgcaggtggattttaacgagcacatcattttttcttatatgcgttccgtcgctaagcacgacatgatgtcctttgtacttcgtcagcctgactcgaaaaacgcttttttgatcgttgtcaatcaagcttagccttgaaaaaaagaaataaatcggatcaaccactctccatatggaaaggaaacaagttttcatcttttcaccttccttatgatcaaaaacacccttatattttgtgaacgttctcctcaaaatatagttgccatatttttttaggaggactgtcatgaaaaacattctcatttttccttttttaagcatttccaccggccatcatcatgtggctgatgcattgcaggctgaattagagtctcaagggctggcagctgaaaagattgatatcttttcacattcgtataggcggttagaaaaattgtcctccgtggcttatttaaaatggattcaatatttcccgaaaacgtacagcggcatttacaggctcctcgcctgcggagaatttcagcatgacaaacgctatttcatgtacgaatggctgttcacacagcaaatgaggcacatcctccaagaaaaaccagcctgatatcgccttctgcacacatgcgctgccttcttatctgctgaaccgactaaagcctgaatatccgaatctgacggttgtgaatgtatacactgattttttcgtgaatcaattatggggacggaagaacattgattaccattttgttccgagcacggaagtaaagaagcagctaatatcagagggtatcgatcagaacaacatatacttgaccggcattccagttcaccaaaattttgaaatggaatcagcagataccttgcagcaccacccgccatataccatcatcatcacagggggcagtatgggggtcggtgggattttaaaatgggtgcaggaactgtcgccaggcggaaagatcttatacaaaatattatgcggcagaaacgaaaagctctactcctatgtcaaaagtttacaccaccccttgattgaggcgattccttaccttcacagcaaagcagagatgaaccgtttgtacgaacaggcgacaggcatcatgactaaacccggaggcgtgaccatcagtgaatgcttacagaaacggcttccggtatttatttatcatgcactgccgggacaggaggaaatgaatttaaaccttctacatgaaaggaaactcgtcacagatatgagaaactgggacatgcagaaagcagaagagtatatcgcggcattttttcaatcgaacgaacagatgaaggagtataaaaaacacgtcaatggataccttggcgaaatgtctgataggaagattaaagatgttttaaaaagaatcatatggaaacaaaaaaacactctcctgaaatagagagtgtagaatagttaacgaaacagcaaatgctggctgtgtatgcctgctttcttgagcaggacgatcagctggtcctgttcatcaggcgaaagacctgaaaacgctctcgcaatacgcagtgcatgaatcggataaattttatccaaatactcatttcccttgtcagttaaatgtgcgtaaacagagcgtttatctttcgggtcctgctcccttactaaaaacccgtttctttctagtttgtcaataacatatgtgacgtttccgcttacaagcagaagtctcgacccaatttgctgtaatttttgcgggcctcttgtgtacaggagttccagtacagcaaattcagtgggattaaaaccgtgctctttgctatcacggatactatgttcggacacacttttgaaagcccttgcaaaaactctgtacaaattcatcgcacgctcaacttcttcttcgttaaacgataatctcatcatatctacctcgtatataggatttttataaaaaaataatgaaaacccttacatataataagagttcagtcccttactatacgtattcgctataattcgagaaattccttctaaaagcaaaaaaatccttatacattatcttgtataaggataatttttatgatttgtaatgcttcgaaagaaataagcgtattctttccgaagctcagaaatcgtcattttgttcatgacctctttattataaacccctatctgatagagtttttcagaataatggcgtcgttctttttctaaagcggatttcaataaattactcatagcgtcctccttcattttgaggtatcctatacaaaagatactctttttaaatgaacgtggtatgaatctaatgtaaagaatttatgtttacgaagattttcggtattgtccgttttgaaccgatcttaataattgaaaagcctgttctccggcaagctgcataaacgtctccagcatttcatcacgcttgatatccaactctataatttcttttgccagtgagactgctttttcttcctccatgattatccttcctcctcgtttgattcgttacataaaggataaaacgcgcttgggtgttacgcattattcttgttaatttttcttccgtattttttcaaaaatcttctatttgatgttagaaaatatgacaagcgtcaggttttttctctttgttttttatatactattatcaaaagacatccaggggtggaaaaatgaccacagaagatcattcttataaagacaaaaaagtgatttcaatcggaattgtgagtgaattgacaggattgtccgtaagacagatcaggtattatgaggaacgaaagctcatttacccgcagcgttcttcaagggggacaagaaaatactcctttgccgatgtggagcggctgatggatatcgccaataagcgtgaagacggcgtacagacggcagagattttaaaggatatgcgcaaaaaagaacagatgttaaaaaacgatccgcaagtgcggaaaaaaatgctggaggggcagcttaatgctcactttcggtacaaaaaccgttaaataataaaagtccggctcgcagttgagacggactttttacgtttataatgagtgaatgaatgcagtggcaatgccaaagtagattaataaagataaaatatcgtttaacgttgtaatcagcggtccagaagcaatcgccgggtctactttcagtttgtgcaaaataatagggataatcgttcctgacatcgtgccgatgattaaggttaagaacagtgaagaggcgacaacaaatcccaaaagcgcattcccctgccatatgatagaaacaatcgcaatcagcacagaacaaaccgctccgataaaaatgcttgttctgaactcccggaagatcaggcgcacaatcgtttttttgttcatttcttctttagacaaacctctgatgacaaccgcaagagattgtgttcccgtatttcctgtcatccctgacaccatcggcatgaaaaacgcaagcgcgacaacctgcttcagcgcgtcttcaaaatagctgataatgcttcctgaaatcagtccgataaataagagtaaaatcagccatggcagacgccggtatgccgccacgtaagcttttgtgtcaaaggtgatgtctttaccggaagcggcaaatttttcgtaatcctcatcagcttcccgaataacaacgtcgataatatcatcaaccgtcacaatgccgacaagcacgttgttttcttctacaaccggtattgccaaaaaatcgtaacgttctatcaggcgggcaacttcttcctggtcctgaagagcatctgctgatatgacgcgggtaaacattaaatcctgcaccttttcttcaggttcacccagaatcaaatcgcggtaggaaagaaccccaaccagctgtttgctttcattaataacatataagtagttgatcgattcagctatttcagcgaagcttttcagtttgacgaccgcgtcttttaccgtgtaatgctgagggatccacacataccggtttgtcatcatgcgtcccgctgaatcagccgggtaattcatcaagagctgtacagcttttgattctgacgcttccatgctggataaaagctgttccttcagttcttcgtccatttcttcaagcaattgagcgaggtcatcgttgtccattttgttcatcgccagtgttgcttttgtttttccgactttatttaagacgacaagctgaaattcgcgttccagctccccgatcatatcagtgatatcgtctacagttaaataagataaatagcgggcgcgatgtttttccggcatttctttaaaaataaatgccatgtcatagggctgaagctcatcaataacacttctaaaatccctgattttcccgtctcgcagtaaaataatgatgcgtaaaatgagttcgtcataggtcatgttttgaaccatcgggactcgtacctcctctacggagacgtgccggcctcgccagaaggtgcggcagttcgtctcctcatcgtgtaatcaattgtcttgctgtcatagtatatgggtacttcttcagattgactcgaatggggagaatccatactccgcacctcctttgattggtttcgttttaaaggcataaaaaaagccttcgggattgaaggtgaaagaagcacggcaaaaaaagcgtgcgggcgccttcaatcgtagagctttagcactgtatggcataggacaagcatccagctgcattaaaaatcaccttatgtcgatgatttctgttgacccattggcgtctttggacatttttgggcagcagcgtatctccatacaggagcctcacctaacgaagttcctaattgaattgacacactgagattacagaaaaaaacaagctatgtcaactcaaaaaagtaataaatgcgcttacatcacaattacggaacaaaacaagggcctaagcccttattctgttgtttgtgtctcgtcatcttcagaaagcaaatgatacgtttcatgaagaaataaggcatactctccttccttcgtcggatgagggacatattcagcctgattgatgtattgctcctctttcttttccatgcgtttcgcctccttttctacttagattgtccaaaagaaggtttcttatcatgaaaaacccccgctgcagcgggggttttgattagtcatctatctcctgtttgataatgcgtccatcttttgcggaaatttcaaattctgtctcagttccttgcttcgtttggatttccatttcatagatgtaagcaccgtcatcttcgtcaagcttactttctgttacggttccacctgtttgctttaaagcaatttcttcagcttcttctttggttatggcgacttgttctgctttctcctttaacgggtcattaagcgcttgttttgtatgaatatctacataaacgtcgtagtcttcaccttctttttcaatctccacttcatagacttctttgccgttgtaaaggtctctgtcaatgtcttctactgtgccgtcaacaactgttttagcaattgcttctgcttcttgttcagtgagtgcatccgtcttagaagaagcctgtctgttttcattgttttctgtggcaaacgcgttgtagctgaatcctccggccgctaggcaccctgctaaaagaccgaccatccattttttcttgagcatttgtgagccctcctttgttttgtatgagtacagtttacatactcaacatgaaaggaaaacgagagcaagatgagaatttgatgagaaaccgtcagtcttcatacacaatgttagctacctttcctgtgtaggcattgattttcactgtcgcttccttattatcaggaagatcaacgtctacttcaaagatgagagtgccctcactttcttcgagatctgcgtcatccgctgttccgcccgtttttcgctctgcaattgttttggcttcttttttcgtaatcggcgttttttgttgatctttgctgctgatttgatcggcagacaagactgtttttgcctgcatgtctaccttcacttcgtatgttttcccgtcttctttttgtatggtataagtggcaacttgactttgccgtgtttgttttttgaccgttcccggcacccgctcaagcgcgagatgctcggcttctttttctgtcatggcagatggattcactgcttttactctattcattgaaagaatgtcagccgatattgcgtctgcttttacaaagtaagttccctttggattttcaagggttatatcatatgtttttttatcctttgattgtgttgctttcgtgaccttgccttcataagaggcttcgactttttttacgacagtctcctttgacaatacgttctcatgggtttgccgaatgatgagaaacgtacagatgatgacaactaaaatggctgctgcagcaaaagatactgtttttattgttttagtcatcggcctcccccattctgttcgctgaattgcatggtgacagctgttccttgtcccggcttgcttttgacagacagctcaatgccatgctcatcagcgatttgcttggcaatggaaaggcctaaacctgttccgcctgtttttctgtttcgtgcctcatctgcccggtagaaccgttcgaacaaatgcgggatatgctcctcaggtattccgatgccttcatccctcactgatagaaatggccgtccattcctcgttccggctgacatctcaataggcttttcactatactttattgcattatcaagcaaaatggtcaacagctgcttgatgcgttcttcatctgcctttacaagcaggctctctttatctgtttcaagcaatatgtcacgctgataaacggactggagcgtttgcataaccgcgcgcgccgctttaatcagatcgattgttttcagatcaacctcgagtccttgatggcttttggccagcgccaaaagctgattggtcagttttttcatatgcaccgcttctgagtgaatggcttctatcgactcctcaagcacctccggcttttttgcaccccaccgcttcatcaggctgctgtagctttctataatagtgagcggggttttcaattcgtgtgaagcatcttgaacaaattgctgctgtttatcatagtgctccttcagcatcattgccatttcattaaatgtcagccccatttgatacaattcatcgttggactgtccttctaaagaaatcgttttaaattctttgtctcgctgtatgtctttcattgtgatcattaatcgtctgatcggattgatgattcggcgggctagcaagctgcctgcaaaaaaagaagcaatgcagacagcagcacttgcagcgattaagatgattttcagcagaaacagactctcttctgtgttctccagtctttcaaccagctgaagagacacgacttgtccatcggtccaaatcaccggaacagcagcctcggcaaacagcttgccgtcaggtttcctcacatctgccgtttcgccgctatgaaaagagagaggaaaatctttataggctttttcttttgtgatcgtcataacggctttttgatcaccattcactacacgcaccatgccatttgccggaagataggcctgcagcatatcctgcaaagccactccttctgtttcagcggcacgcagcgcttcggcaatgttatccgtctcatcagcaagccgggccgcatcctttgatgtcagcgcagacgaaaaaatgagatatactgcggtatgaaccaaaattaataaaatcaacagtgatatcgaagtgtatagatgaatcttggtcttcagcttcatcgtttaccccttaatggcatagccgaccccgcgaatcgtatggatcagctgtttttcgtaaggatagtccagtttttttctgatgtatcttatgtagacgtccacgacatttgtatcaccgatataatcaaatccccatactgagcttagaatttgctcccgtgtcagcacttgctgcggatgctttagcatatagacgagcagatcaaattcccgcggcgttaattccacctctttgtctccgcgtctcacttcacgggttttttcgttcacccgcaaatcgtcatatgtaagaaaggtgccgatatcttcagtttttgttccattttgccgcagcgccgccctgattctcgcaagcaattcctcgatttcaaacggcttggtgacatagtcatttgcaccgatgtccagacctgttaccttatcaggaatactgtctcgcgccgttaataatatgaccggtgtctgcgaatccgtttttctcaagcggcgcagcacttccagtccgctaagccccggaagcatgacatcaagaagcaccaaggaatacccgccttccgctgccgcatcaagaccttctgtgccattgtgtttgatcgtgacgctgtatccttcatattccaattcaagctgaagaaccctggcgattttttcttcatcttccacaattaatatgtgtcctttttccaaatttgaccatcctctcccgtccctatatgaaaaaaatgatttcgttgtttacaaaatgattcttatcatctattatgatgtcaaaataaaaaattgtatacggaaagcactaggggtgctgttttggctgagataaagcgcggaagaaacgcgctttgatcccttatgacccgatctggataataccagcgtggggaagtgcaggttgaccgaatggtgtatttttttgtgcgcttaatcgatctatgactgcatattcccttaggatatgcagttttttattttaccaaaaaaacaggaggtcggagaaatggagcatatttgcggtacaagcagaatcgccggttttcgcttctctttatatccgatgacggatgattttatcagtgtgatcaagtctgcgctgaaaaaaacagatacatccaaggtttggacgaaaaccgaccatatcagcacggtgttacgcggatcgattgatcatgtattcgatgctgcaaaagccatttaccttcatgcagcaaacagcgaacaacacatcgtcatgaacggcacgttttccattggatgcccgggtgacacacagggggatacatatctttccaaaggtgataagcgtgtcaatgaagatgctgtccgaggcttgaaggcggaagcgccgtgccaatttgccctttatccaatgaatgagccggattatatgggattgattatggaggctgtcgacattgcaaaagcccaaggcactttcgtacagggtgtccattacgcgagcgagcttgacggggatgcgcatgacgtattcagcacattggaggccgttttccgcatggctgagcagcaaacaaaccacatcaccatgactgtgaatctttcggctaacagtccatcaagaaaaaacagaaagcagggataacatgaaaagctggaaagtaaaagaaattgtcatcatgtccgttatcagtatcgtatttgccgttgtttatttattatttacacatttcggaaacgtacttgcaggtatgtttgggccaatcgcctatgaaccaatttacggcatttggtttatcgtttctgtgatcgccgcgtacatgattcgaaaaccgggtgcggcgctcgtttctgaaatcattgccgctctcgttgagtgcctgctgggaaatccgtctggcccgatggtcatcgtcattggcattgttcaagggctcggggctgaggctgtatttcttgcaacacgctggaaagcatactctctccctgtccttatgctggccggtatggggtcttcagtagccagctttatctatgatctctttgtttctggctatgcagcctattcaccaggttatctgctcattatgcttgtgatccgcctcatttccggcgcgcttttggcggggcttctcggaaaagctgtcagcgactctctcgcttatacaggtgtgttaaacggaatggcactcggaaaggaactgaaaaagaaacggaagcgggcgtcagaacatgcaagcctttgatgagcttctgacggttgagcagctcagcttctcttatgaagaagacgagaaaccggtttttcaagacatttcgtttgagcttcaaaaaggagaatgtgttttattattaggaccgagcggatgcggtaaaagctcgctcgccctttgtttaaacggtctatatccggaggcttgcgacggcattcagtccggacatgtatttctatttcaaaagccggtcacagatgctgaaacctccgaaacgattactcagcatgccggggtcgtttttcaggatcctgatcagcagttctgcatgctgacggtggaggacgaaatagcgttcgggctggaaaatctgcaaattccaaaagaagaaatgacagagaaaatcaacgccgtattagaaaaattacgcattacccatttaaaagaaaaaatgatctcaaccctttcaggaggacaaaagcagaaagtggctctcgcctgtattttggcgatggagcctgagcttattattttagatgagccgacctctcttttagaccctttctcagctcgggagttcgttcatctgatgaaggatcttcagcgggaaaaaggtttcagcctcctcgtcattgagcaccagcttgatgaatgggcgccttggattgagagaacgatcgtactcgacaaatcaggcaaaaaggcactggatggcctgacgaaaaatctatttcagcatgaagcggagacactaaagaaattgggcatcgccattccaaaggtctgtcatctgcaggaaaagctgagtatgccgtttactttatcaaaagagatgctgttcaaagagcctattcctgccgggcatgtcaaaaagaagaaagccccttctggggagagtgtgcttgaagtcagcagcctttcgttcgcgagaggacagcaggcgattttcaaagacatcagcttttcgttgcgcgaaggctctttaacggcgcttgtcggtccgaacggaactggaaaatcgacgctcctatcagttctggccagtctcatgaaaccgcaaagcggcaaaatccttctctatgatcagccgctgcagaaatataaagaaaaagaattgcgtaaacggatgggatttgtttttcaaaaccctgagcatcaattcgtcaccgatacggtgtatgacgagcttctgttcggccagaaagcaaatgctgaaactgagaaaaaagcgcaacacctgctgcagcgttttggtcttgcgcatttggctgatcatcatccgtttgcgatcagccaagggcaaaaacggcgactgagcgtagctactatgctcatgcatgacgtaaaggttttattattagacgaaccaacctttggccaggatgcccgcacggcggctgaatgcatggaaatgattcaacgtatcaaggcagagggaactgctgtccttatgattacacacgatatggagctagtctcttcgtatgctgacagcgtgcttgtgcttcacgatacaggcctggcctttgacggatctccagcgcagttgttttctcaagaaacagggcttgttcaaaaagcaaagctcacccttccccttctatatgaatggatggcatttcaagaggaggtgcgtgatgaagcaaccgttacatctcattaatccgactgtgaaagcggcggcggttttttgttgtgtcgtcatgctgtcgtttatttacaacccttacactccggcatgtttttatatcatcatcgttgcgggcgttttactggcggccggaatcccattgaaaaaatggttgttgtttacgattccgtttttgattttagcattcggatgcgtgtggacagccgcagtttttggaaaagtgccgacaacaccggataattttttgtttcaagcaggccctatctccattaacagcgataatgtgtctgtcggcatctctctcgggtttcgtattttatgcttttccgccttatcgatgatgtttgtttttacaaccgatccgattctatttatgctgagccttgtccagcagtgcaggctctcaccaaagctcgcgtacggtgtcattgcaggctttcgctttcttccgctgttaaaggatgaggtccagctgattcagcaggctcataaaatcagaggaggagcggcggagagcggcatcattaataaaatcagtgcgttaaaacgatataccataccgctattggcaagcgccatcagaaaagcggaacggacagcgcttgcgatggaatcgaaaggatttacaggaagcagaaaccggacatactacaggacattgagcgtgaaccggcgcgactgggtgttcttttgcctcgtcctcttattattcgcgggatcctttctcgtatctttatgtttcgcatcataaaaaatccgctatcacagatagcggatttttttattgatgatagtttaatgcttgggcaaggttggttttaatagtaatattcgaaaagtcaatccccagctgtacagcagtttgcgcaatttcaggcctgattcctgacagggttgaccggacaccgatcagattaagcgcctcaatcaatttaaagatctggtgcgccaccatcgtatccaccacaacaacacctgacagatcgattaacagatgctccacacgtcttttcgcacaagcttgaagcgtgttttccagaataaacttcgcccgttcggtatcaatgtcaccgacaagcggcagcagagctgttgatttgctcagggtaatgacaggtgagcttaattccaatatcatttctctttgggcgtttaattgctgcttggcattcatttcagcgtgatcaacgaatgtataaatggtgaaatcaaatacttttacaatcaaatctgcccatttttgcttctctcccggttcaaacgctgattcattttcttctgcgaacttctcaaaatacttcgtatataatctcctgtttctcataaactcccgaatgacatactgaaccggtgtgtcgagatgtttttgatcgttggtcagctcaatgacccactcttgaaactcttcgagaaattgtttttccggtaaaacatacatgtaattcagatgccggtaaaattctctgtcctgctctttcaattcttccgttactgttgcattatgtagggcgtaaagcgaattcggatcactttcctccatcgtttcaatccattcctcggccatttgttccacatgctctgaaaaaaatgcatataatttttcattcagtttcatgacactgctcctttccccaacactattataacttgacttacagttgaatcccagtcatacatgttgaagccatccaatattttgaagattactaattctttggtgtgtatcctattttttcaaaatgcttcaaatggctctgtccgagcgcttgcttttttcatataatatgaggcaacacccttgaatccacttgcaagcataaaaaaggagggcttttttatgaatggtgaaatccgcttgatcccgtatgtgacgaatgagcagatcatggatgtaaacgagcttcctgagggcattaaagtgattaaggcgccagaaatgtgggcaaaaggggtaaaaggcaaaaatattaaagttgctgtattagacacaggctgcgacacaagccaccctgatttaaaaaatcaaatcatcggcggaaagaacttcacggatgacgacggcggcaaggaagatgcgatttccgactacaacggacacggcacacacgtcgccggaacaattgcagctaatgattcaaacggaggcattgccggagtcgcgcctgaggcaagcctattgattgtgaaggttcttggcggcgagaacggcagcggacaatacgaatggataattaacggcatcaactacgcggtggaacagaaagtcgacatcatctcaatgtcccttggagggccaagcgatgtgccagagctaaaagaagcagtgaaaaacgcagtgaaaaacggagtgcttgtcgtttgtgcagcgggaaatgaaggtgacggcgacgaacgcacagaagagctttcctaccccgcagcttataatgaagtgattgcagttggatctgtttctgtagcgcgagaattatcagaattttctaacgcgaataaagagattgaccttgtggcaccaggagaaaacatcttatccacccttcccaacaagaagtacggtaagctgaccggcacttcaatggctgcccctcatgtcagcggtgcgcttgctttaatcaaaagctatgaagaagaatcatttcaaagaaagctttctgaatctgaggttttcgcacagctaatccgcaggacacttcctcttgatattgcaaaaacgctggcaggcaatggattcctgtatttaacagctcctgatgagctcgcagaaaaagcagagcaatcacatttgttgaccctataagattatttttcttatataatatacaccacatcatgtaaataaaaatttcaaattctatgttgacaatgaatttgaattactgttaagattaccaacaaatgattcaacttttcaaaaaattaataacattttctcttatcgagagttgggcgagggattggccttttgaccccaacagcaaccgaccgtaataccattgtgaaatggggcgcactgcttttcgcgccgagactgatgtctcataaggcacggtgctaattccatcagattgtgtctgagagatgagagaggcagtgttttacgtagaaaagcctctttctctcatgggaaagaggctttttgttgtgagaaaacctcttagcagcctgtatccgcgggtgaaagagagtgttttacatataaaggaggagaaacaatgacaaccatcaaaacatcgaatttaggatttccgagaatcggactgaaccgggaatggaaaaaagcacttgaagcgtattggaaaggcagtactgataaagatacgtttttgaagcaaatcgacgaactatttttatccgcagtaaaaacacaaattgaccagcagattgatgttgtgcctgtttctgatttcacacagtatgaccatgtactcgacacagcagtcagcttcaactggatcccgaaacggttcagacatttgactgacgctaccgatacatacttcgctatcgcccgcggaatcaaagacgctgtatctagtgaaatgacaaaatggtttaatacaaattaccattacatcgttccggaatatgacgagagcattgagttccgtctgacaagaaacaaacaactcgaagattatcgccggatcaaacaggaatacggtgtggaaacaaagcctgtgattgtcggcccttatacgttcgttacgcttgctaaaggctatgaaccgtctgaagcaaaagcgatccaaaaacgccttgtgccattatatgtacagcttttgaaagagcttgaagaagaaggcgtaaaatgggttcaaatcgatgagccggcgctcgttaccgcctctagtgaagatgtacgcggcgcaaaagaattatttgaaagcattacaagtgagctttcatccttgaatgtgcttttgcagacgtattttgattctgttgatgcttatgaagagctgatctcttacccggttcagggaattggccttgatttcgttcacgacaaaggcagaaacctggaacagcttaaaacacatggcttcccgacagataaagtgctggcagccggcgttatcgacggacgcaacatttggaaagcggaccttgaagagcgtctcgatgccgttcttgatattctcagcattgcaaaagttgatgaactgtggattcagccttccagcagcctgctgcatgttccagtagcgaaacaccctgatgagcatttggaaaaagacctattgaacggattatcctacgcaaaagaaaagctggccgagctgacagctttgaaagaaggcttagtatcaggaaaagcggcgatcagcgaagagattcagcaggctaaggctgatatccaggcgcttaaacagtttgcaacaggcgccaattctgaacaaaagaaagagcttgagcaattaactgataaagacttcaagcgcccgattccgtttgaagaacgtttagccctacaaaatgaatctctcggccttccgcttttgccgacgacaacgatcggcagcttcccgcagtctgctgaagtgcggagcgcacgccaaaaatggcggaaagctgagtggtccgatgaacagtatcaaaactttatcaatgcggaaacaaaaagatggattgatattcaggaagaattggagcttgatgtccttgttcacggcgaatttgaacggacagacatggtcgaatacttcggtgaaaagctggccggtttcgccttcactaaatatgcctgggttcaatcatacggctcacgctgtgtccgcccgccagtcatttacggagatgttgaatttattgaaccgatgacagtgaaagacacagtctacgcacagtcattgacttccaagcatgtgaaaggaatgctgacgggcccggttacaatcttaaactggtctttccctcgaaacgacatctcgaggaaagaaatcgccttccaaatcgggcttgcccttcgcaaagaagttaaagcgcttgaagacgcaggcattcaaatcattcaagtcgatgaaccagcgctgcgtgaaggccttccattgaaaacccgcgattgggatgagtatttgacttgggcggcagaagctttcagattaaccacttcttccgtgaaaaacgagacacaaattcatacacatatgtgctacagcaacttcgaagatatcgttgatacaatcaatgatcttgatgccgatgtgattacaatcgaacatagcagaagccacggaggatttttagattacttaaaaaaccacccgtatttgaaagggcttggccttggtgtatatgacattcacagccctcgtgtgccgtcaactgaagaaatgtacaatattatcgttgatgcgcttgccgtctgtccgactgaccgcttctgggtaaatccagactgcggattgaaaacaagacagcaggaagaaacggttgcagcattgaaaaatatggttgaagccgcaaaacaggcaagagcacagcagacacagctagtataatttgaaaaaaaccatctgcatttggcagatggtttttttctataatacagccacaatcggtttcttatttagcaaatcccccaaatactttgtttattttgcacttttttaagaatgttctttgcattcttttcggctatactaataacactctattgacaggagggattgggatgaatcatgaaacgttcttaaaacgggctgtcactctcgcatgtgaaggagtgaatgcaggaatcggcgggccttttggagccgttatcgtgaaagacggagccattattgcagagggacagaacaacgtcacaacaagcaatgatccgactgcccacgcggaagtcacagctattcggaaagcctgtaaggtgctaggagcctaccagcttgatgactgcattttgtatacgagctgtgaaccatgcccaatgtgcttgggcgccatctactgggcccggcctaaagccgttttctatgcagctgagcacacagacgctgccgaagccgggtttgatgattcattcatttataaagaaattgataaacctgctgaagaaagaacgatccccttttatcaagtgacactaacagagcatttatccccgtttcaagcatggcggaacttcgccaataagaaagaatattaaaaggatcaggcatgcgcggcctggtccttgttatttctccaagtagccgctatgccctgtgcaaatacaaaacagcatatacgcgcaattcagcacggcagacaccgtgccagccacccgcttcatctgtaacttttggtttaaaggcatgcttcaaacgcttctctgaagttttatcataaatctgtgcccgccccgcatgtccgacaccaaaaaacatcctgagaatcctcaggatgccggtcattattttaattctagttttacatcaacatttcctctggttgcctttgagtaaggacagaattcatgagcggcgttgacaagctcttgtgccttttcccgatctaaatctttcgtgttcacaacaagtgtgacaccgattttaaacccgccgtcgctctcatccttcatgaggctgacctgcccttcaatctccgaatcaatttcgatattctgctctttggctacgtgttcgagcgcgccgccgaagcatgcagcataccctgccgcaaagagctgttccggatttgtgccggtttgtccttcttttttggcatttggcatgacaatatcaaaatcaagaacaccgtcatctgatgtaatatgtcctgctcgtccgcctcgcgcggttacttttgctgtaaatagtgccatatttcccaacctccttatttgtatctagttgttatatttccctttctgatctttttaaacatgctatgtttgccgagaataggaaaagtgaggtttttcagatacaatagaatcgaatgacaaaaaagagttggtgaacaaaatggaaaataaatttgatcatatgaaattggagaatcagctttgttttttgctatatgcgagttcgcgggagatgacaaagcaatacaagccgctgcttgataagctgaatataacataccctcaatatttggctttgcttttgttatgggaacatgaaacgcttactgtcaaaaaaatgggcgaacagctgtatttagattcaggaacgctcactccgatgcttaaacgaatggaacaacagggtttgattacgagaaaaagatctgaagaggatgagcggtccgtgttgatcagcctgacagaggacggagcgttattaaaagaaaaagcggttgacattccagggacaattctggggctctcaaagcagtctggggaggatctcaaacagttaaagtccgctctatatacattactggaaacacttcatcaaaaaaattgaggatgccttgtacaggcatcctctttttatttattcagcaacttcaagtgtcacatcaatatttccggaggttgcttttgagtacgggcagacgccgtgcgcttttttcacaagcgcctccaattctgatgcactgactccttctccttttacttgcagcgtcacacccagcttatagccctggtccgcttcatcctttaacaggctaacatttgctgtaacctctgtctctacttttacccgttctgttcttgcgacaagctgcagggcgctgtcaaagcaagctgcataacctgctgcaaacagctgctctggatttgtcgctttttctaatttcttggctctcggtgtccccggcattgcgacatcaagctcaagaacgcggtctgatgaaatgacctttccttctcttcctcctaccgctgaaacagttgcggtaaataatggctgactcatttttcattcccccaatatattttatacaattaaattgtacacaattaaatttgaaatgtcaatttttcgcgtataaaaaagcttatctcgtaatgagataagctttttcattgaacattaccccgctattcacggatttgcccagttcctttaatgatgtattttgtagaagtcagtgcaggaagccccatcggtcctcttgcatgaagcttttgcgtgctgatgccgatttcggctccgtagccgaattcaaagccgtcggtaaagcgggttgacgcgttatgatagacagcggcagcatcgacagccgtttgaaaatataccgcatttttgtcattttcagttaaaatcgcttcagaatgattggtgccgtattgttggatatgctttacagcttcttggacgttttcaaccgtctttacgctgaggacaggcgctaaaaattcggtttcccaatcttcttttgatgcttgtttgcttgaaggatgaagttcacataccaattcatcaccgcgaatttcaactcccgcgttttccagctggtccagcaattcttttccgtgctgtcttgcccaagccttgtgaatcagcaatgattcaatcgcgttgcatacagaagggcgctgcgttttggcatttacaacaaccttttctgccatttgcggtttggctgtttcgtcaatgaatatgtggcagtttcctgctcccgtttctaatacaggaactgttgattctctcacaacgagatcaatcagtttcttgcctccgcgcggaatcaatacgtctaagccatcatttaacgtaaagagctcttttgctgtctctctgctcgtatcctcaatcagctgcacagcgtgaatcggaagcgctgattgctcaagtgctctgtaaatgacactgacgagcgctttgttgctgtggatggctgaggagcttccccgcagcacaaccgcgttccctgtcttcaggcaaagggtagccgcatcaactgtgacgtttggcctcgcctcataaatcattcctacgacaccgagcggcacacggattttttcaataaacaggccgttttctttttcaatcgtttcaagagagtcgccgattgggtccgctaagtcgattaagagctccaccgcgtccgcgatatcgcgtatccgtttctcatccaatgagagacggtcaatgatgtccggtgttaaaccattctcttttccgttcacaatgtcttttgcattctccgccaagagaaaatccagttctttgcggagtccgtttgcaatgaggctgagcgcctcatccttctcggctgttgttttcatgatcatttcggctgctgcttctttcgccagcttcgcttttacagaaacttcactcatttttccgcctcctagtcttttacattgacccagtcattcctatgaataacctcaaacgttttctcaaaatcaagttcgtcactgcgtttgcctttagcctccataatctcctcggaggagtaatgagtttggcctttgccgatcacgccgcccggtcccctgacttccacaaccgcccctttcggaaagcttccgttcacgcccacaactccagcgggcaaaaggctgcttccattatggatcatcgcctcttcggcacccgcatcaatgataatttctcccgatatcggcgagtggaactgaatccactgccttgtgttgttaaccgaagatagttctttgtctccgatataagtgccgtctcccctgccgtccaaaatgtccgcaagtttttgctctccgctgccagttccaatgaatactttcactcccagagacagcgcggtttgtgtggctaacagctttgatttcattccgccggtgccgacctttgatccagctgaacctgcatatccaagcaattcaggcgtgatctctggcaaataatcaaatcgtttcgcctcaggattttcatttggattggcatcatacagtccgttaatgtcagtgagaatcatgagctggtccgcgtgaatcaatccgctgactaacgcagaaagcatatcattatctccgaatgtcaattcttcaacagatgtagaatcgttctcgttgataatcggaatgacgccccgctctaataattccattatcgtagcatacgcgtttcgataccgttctcttttcgaaaaatcatttctcgttaaaaggatttgtcccggagtcagtgagtattgtttaaattgattcatatattgctgcattaacagtgtttgtccgaccgcggccgccgcctgttttcctttgatggtaacgggacgggatggataaccgaggctggaaaaccccgccgctacggcacccgaggtaatcagaatcatttcatgccccgctttttttaacacggaaatcgcctgaacatgctctctgatttttgcctcatcaatgcttcctttgctattcgtgagcgaactgcttcctattttcactactattctttgttttttcatttattctcctccgcggctcttctacaataaaaaaacccatttcatcctgattcataaggacgaaatgggtttccgtggtaccaccttgattgaacgcgcttgtgcacgctccgctctcctgtaacgccaggttatgcgcctaggttttccccctaggactccaaggcaggttcggcaggtttcatgcggcaaaatgtttcagcgattcattttgctctctgtcacagaaaggtctgcttactaatcctcttcaacgctcaatgatttttttatattatgcaaagaaaaaagacacttgtcaaggttttttgtcatcaaaaatagcccgcattgcgcgggcctcttgcagtctagttaaagacgattgttttattttcatgaacgatgacacggtcttccaaatgccatttcacagcacgggcaagcacgctgcgctcaattgttcttccgatgtttttcagcgcttccgcattatcgcggtggtccacacgctcaatatcctgttcaatgatcggcccttcatcaagatcgtttgtcacataatgagatgtcgcaccgatcagtttcacgccgcgctcgtaggcccgtttgtacggattcgcaccgataaaagctggcaggaatgaatggtggatattgatgatgcgattcggatgagccgaaacaaaatcaggagttagaatctgcatatagcgtgcgagcacgatcacatcaacatcgtactgctccagcagttcaagctgcttcttttcgacttccgctctgatgtctttgttcgctttcatatagtggaatggaatgttcaggcgctcaaccagctctctcgcttcctcatggttactgatgacaacagcgatctccgccatcaggttgccggtttgccattcccaaatcagctcatgcaggcagtggagctcctttgaaacgaaaatggcgacacgcttcagttcgctcgccaaagttaagctccatgtcatgtcgaatttttccgcaacagaggcaaacgctgcctgaagtgatgattttttttcacgaatgcctgcgcagtcgaattcgattctcaggaagaaccggccgccttcagggtctgtcgtatattgatttgattctataatattggcaccgtgttcaaataaaaacgcggaaactgcagagacgatacccggctgatcggggcagctgaccaagagccgacctttatcctcatttccgtcacggtattcgtccaaccgctgagtcatatatgatttcatgaataatccctcttatctttgtaagtctaaactatttatccattatactgaagatttgataaaaatcaatttatgacagaatttttaaaccaactgctgagcataaaatcaacgcgataaagaagatccgtttggcgtctttctgctccttgtaaaagaggatgccgataagcgccccgccggcggtgccaattcctgtccagaccgcgtaagccgttcccatcggagtggtttccattgcgtacgacagcaaggaaaatgaagcggcaaaaccaacaatgatcaacagcacccatttcacgcttttttctttcgcatattgattcataagggccacgccggccatttctaaacagcccgcgcacaataaactgatccagtgcagcattatgcctcgcctcctttttcctctgtctcatcctgtgtcacaagcttcaacccgattacaccgattaagagcacgccaattaacaatagcttcggccatccaaccggttcatgaaaaagaacgatttcactaagtactgttcccgctgtgccgagcccggtaaagacggcatacacggtaccaacaggcagactgtgagtcgccttcattagaaggtaaaagctgaatatgatgccgatggcagtgccgctccatgttaaggctgagtcagcgtgctttaagcctatcacccaaacaacctcgaaaacagcggcaagcacgaccaatccccatttcattttgagtcattcctttctatctattaagattctccgaaaacaaaaaaaccccggacagtcgtctcacatgagattgactctcccgggcttttttccctccgtgtgcatacgcgcttctatttacgcgtatgtgttttctctcggaccagtccatgtcaattgacatgcggaaccctagaaaactttacatgatatcatgatactaaactcagctctatctttcaattgtaagattttctttcatataccgcgatcggtttattccattttctgatcgttttgctgtaatgcatgccgattttctccgctacccgtatggacgctttgttacccggatcaatcaaagccgccattttgccgaactgccgctcgttaaagccatagtccagacaggcccgagccgcttcttgcgcatagccgttcccccagtggcggcgggcaaacatatagccaatttccattacggtttgattttcgatctgctggggaacgatgccgcattgccccaaaaactcccctgtccgcttatcttcggcgatccacagactaacgccgtaccctttttcatttcgttggttccaattgacccactcgcgggtttgcctcttatcttttaaaccggaataatatgtcatgacgtcaggatcattaaaaagcagcccaaacaaagtggcttgatcccgatcttccatacagcgcaaacgaattcgatcagtcacaagcttcgttttagcgttcatacttcgccacatcctgcttccattcttttttgagagcttcaatatgtgcctgatgatagcggttatgatctgccatatgccaaattccccatcgtatcgtcgcggtgtcaccttcgaaggaaagcggctggttcaaagcattttcagttaaagtgaagcataccgatttcagcttctctactacatgctgatgtcttttcaggagttcatctaagtctggctgattcaccggttcaggcagccgtccgctttcatctgtcatcgggccgtatgcctgttcaatatggtccgggatccgattttccttgatacgccagacccatctgatatcaacatttgtgatatggtgcaaaagctgagccgtgctgttttttgtttggcagcgccccttatagtaaagttcactgtgtgtcatatggcttacgatggaagccagacggagactgttttcttccactgcggaatacagcaaactgaccgttggcgccatgtcgtttcttatggataagtccttcatgttcagttcccctcctaactaggtacatttgacaccaaacaaaaattccctttaaaaaagaaaaaagctctcattacaagagagagccatcttaattgttatttcccggtttatataagtaaggatcatgctgcggttcattagcggtatttaaatcaagggatatatcaccgcgtgcattcatcgtgccaaggataatcgaagacagcagtttggggctgtaccctttttcctcaagcttctcaaacagccaggatcggtttttttggagatatttcaaattatgatcaaggatttcgccatccagtatgagcggaatcgggataaaattccgttcagcttccatattcaaatcccgcacctgcaccgctctcgcttcctctttcgggatgacgcttacttctcccgtttcttcaatgatagcaagatcaatgtcagccgggtcggcatagcccttttccctcagctttccgagcagctcattaacagtcagcctttctttacgaaggccgcgttcatcaatatccccgtttcggattaggacagtcgggctcacgactaggagccatcgccatttattagataaagagagcttgctcatgataagataaagcaccaaaaaagcacccgcataataaattgacatcggcagcttggatgtaaggatcggctcactgataatggttccgattgcgaaggtcaaaagcaggtcaaaattgttcatttgtgacacagcttttttaccggcaagccgaaacaaaatatatgcaatcgaaaatacgataactggcttcagtaaaaatacccataccatccataacaccgatctttacctccatccgctggtcatattgagcctattgtgccccgtggcaggccctctatgcatcagtgtctaggcgaacgtgcatatcgcctgaacataacataatagaaagtgacaccgattggaggcgcaatacgcaatatgaaaaatcagaagtcgaataccctttggccctttgatctgccattggctccccaacccgagggctaccagcagcaaacaatcgacaggctggccggtttggagctaagaatgaagcaactaattagagcgattgaggtaaacaatgaattgctgagaacaatgcaagaacagcaaaaccgtgtatgcacaaatggcagcgggtctgtgattgtccggatgtagaaaccggcgcttgtctgccttcttatatctcaataaaaaactcttctctgaaaggagaagagtttcatgtatgtgttcaaacggactgcgccaaacttaattgcgggccgaatagctcgtaatggatagactccggcgctgatccgagctctgatacaagcttatgcattgccgtaataaacgacggtgaaccgcaaatatagtaatccgcatctgtgttggcaatcagttctttgaggaattgctgatcaatctgtccttcatgaaaatgcagatcacctgcacggtcttcctctgtcggctcgcgatacacaaatgctgttttaacagcagaatgttttgctgcttcttctacttcatggcgcaatgcatgatattcactgtttttcgccgcatgaatgaacagaatttgccgttcaggctgtttggaaacagatgttttcagcatgctgatcattggtgtaatgccaactccggcactgatcaaaacgagatctttttgtgatgcatgatctaaaacaaagtcccctgccggtgcgctgatctctattgaatctccctcctgcagcccatcgtgtaagtaggaagacacgacaccatctttcttcactgaaattcgataatagtcttttcccggcatatcagacaggctgtactggcggatatgcgtatattcagaatcaggaatccgcactttgatgctgatatattgccctgcttggaattcaggtaacggcttgctgtcttccggtttcaaatagaaggatgtaatttctttgctttcccgctctttttttgcgataacgaatggcttatactccttccagccgccggcttgctcttcagcctgttcatacatgtctttttcaattccgatgaacgcgtcagcaatgactccgtacgctttttcccatgcctgcataatgtcaggagttgcagcgtctcccaatacatctttaatcgcaatcagcaaatatttaccgacgattgggtagtgctcaggcttaattccgatactgcggtgcttgtggccgatttgtttgacaaccggaatgatgtttcctaattggtcaatgtttgccgcagctgcaataacggcatttgccagtgcagttcgctgtgtttttttcttttggtttgtttgattaaaaatgttcaaaagctctggatggtcttgaaacatccgatcgtaaaaacggccagtgattgtttctccatgctgttgcaatacgggtacagtgcttttaataatttcgattgttttgttatctaacattttataaacaatcctttcgaaaagatgtatttaaaatatatctttaaaatacatgatcttacgaataaaagatatatctaaaatgaatctttaataaagttgtcacaaaattatcaatttaacatgacatttgttgcttttttatagaatcccctagcaaaaacggactaaccattgtaataatcaccattgaaaagtacaaaaaaacccaaaacaacttatgttttgggtttaacgttcaccaaggcttatcagttccgagcgcatttgcaagcgcctggctgtgtctcttgcggttcttacgttcattagcacgctgtacagctgtattatgcagcatgatttcttcttctgtttccggtacaaccctcggtacaggcaccggcttgccatttgaatctaatgcgacaaatgtcaaaaaggatgtggcagcgagttcccgttcgccagtcatcaaatgctccttaataactttcacaaatacttccatggaagatgtgccgacccatgtcacatatgactctaggcagacagaatccttttgcccgatcggctttaaaaaatctacagaatccattgaagctgttaccgtttcacgtctgcaatggcgcgccgctgaaatagaggcaatgtcgtctatgtagctcattaattttccgccaaacagcgtattatggttgttcgtgtcaagcgggaacaccctgctggttttcacaacctttgactctttacaaaatcttgtttccggtgtttccatacctttctcccctttgatgtctgatcttttagctaaatgcacttatattctcctattaaacaatattctcttccatttgtctaaaatttaaaatggtttaatgattttcatgatgagggaataataaatgtattcttcacactttaggaggaaaaacaaatggacgtatccatcccgaaatctcagcacaaaacggtatgccgaacggaatacggcacacttcaaaaagtgatcttatgcaaacctgagcacatgaccataaaagatgttataaacgaaacacaaaaacattttgaagatgacaatattcatgtaaaaaccgctaacgaccagcacagccgcttagtggaggcacttaggtcacacaacgttgaggtcgtccttttgcccgttcgcgacggactcccagaacaggtttttactagggacataggatttgtcatcggagaaaaagcctttctgtcaagcatgactgaaccgattcgccaaggagaagaagccgttataaaagatttttttcacagccaaggtatctcttacacccgcatgcttgatacgagtattgaaggcggagacgtcattatcgatgatgacattgtctatgtcggaatcagccagcgcaccgacatttcagctatcggccagctagaagaggcacttcctgaatatacgatcgttccagtgaagcttcatgaaaaatttttgcatttggactgcgtatttaacattatatctgaaagcgaagcgttaatttattcacaggccattgagccagatgcagccgatatgctggcaaaacgttatgatcttattgaggtgcccgaggacgaacaatttacgcttggcaccaacgtcctttcaatcggaaaaaaaacgatcatcagtctccctggcaaccgccatgtcaatcaacagctatcgaaaagaggctatcacattatcgaaattgacctgtcagaaattattaaatcaggcggctccttcaggtgctgcacaatgccgctgattcgaggcgaatgaagaatcttcccctttttcatgttttgaacagcttattttatcaagatacgttaatatagaggtgacatcatttttaagggggaaatcgcatgacaaaatacataggatatgtgggaacatatacaaaaggcggaagcgaaggaatttattcatttgagcttgatactgagaaaaaagcactcagcgagccaaagctggccgctaagctgggcaacccgacatatgtggcgacgaataaaaacaacaccatcctttattccatcgaaaaagcagacggccaaggcggagttgctgcctatcaaatcgataaaaacagcggcgaattgacatttctgaatcatcagttaattgatggcccttcgccatgccacgtaagcgttgatgatcaaaatcaattcgtactgactgccaattatcacagcgggaaggtacacgtttttccggttcaggaagacggcagcttgcaatcacctgtttcagaggccgctcacacaggaaaagggccgcacgaaagacaagaaaaaccgcatacacactacgcggggttcacacctgaacacaattatgtggtagcggttgatttaggtatagataagctctacacctataagcttaaagacggtgtgttgactgaatccggaagccattccttcgctcccggtgcaggacctcgccatatcgcttttcatccgaaagaaaaatacgcttatgtcatgacagaattaagcaatgaagtgattgcgcttgaatacaacccgacagccggcgaatttagagaaatccaagtcgtttctgccatccctgatgattttacagataacagccagggaagcgcaatacatgtcacgcaggacggacgttttgtttatgtcgcaaaccgcggccatgacagtatcgccgtatttgaagtgaatcaatattcaggagagctggctttcgtagaaagagtgtcgacagaaggaaactggcctcgtgactttgtatttgacccaacggaagggttcctcgttgcttcaaatgaagaaacaggcaaccttgtcttgtttgaaagagacaaagaaaccggccgattgacactcctcccatcaacggtttctgtcccttacccggtttgtgtaaagtttttacatcaagtataaacaaatggagtggctctagtaaaaaggagccactctttttatttatcttactttttccttcgtttcagcatttcgatacaaatggcaagcgacaaaacggccgggttcgatttcttgaagctggggacgagattctccacattcaggcatcgcctccggacagcgggtacgaaacacgcagccgcttggcggattgaccgggctcggcagctcccctttcaagagaatacgctcacgcttgtcctccaattcaggatctggaatcggaatcgaggacaaaagcgcctttgtatagggatggagcggttcacgatacaaggtgccgctctctgtaatttccatcatgtgtcctaagtacataacaccgatcctgtcactgatatgcttcaccatcgaaagatcatgggcaatgaataaaaacgtaagccctttctctttttgaagccgcttcagcaggttgaccacctgcgcttgaacagagacatcaagtgcagaaatcggttcgtccgccacgataaattcaggattcagcgacagtgctctcgcaatcccgattctctgcctttgcccgccgctgaattcatgcggataacggctgccaaaatcggggtgaagcccaactgcctcaagcagctcgtccacgacgagaagccgtgctttatgggtattgtagagattatgaatctccatcggctccaaaataatttctcgaacggtcatgcgcgggttaagtgaagcataagggtcctgaaaaatcatctgcagtttgcggttgaaggcaaactgctctttttcacttagtgcatgaagatttgtgccgcggtatgtcacgcttccttctgtcggctgataaaggcgcatcagcactctccccaaggttgatttcccgcaccctgattccccgactagcccgaacgtttctccttcacgaatctgaaaggtgaccccgtcgacagctttgactgtccgctttttccctgcgtcaaaatgcattttcagctggctgacctctaacaaaggcagtcgcctcatttgtctccctccttattctgaaaaacagcggcgcaccgcacataattctttttcatagattgtctctgttaatgtgaggatttcgattgacttccctgtctttggagaatgaagcattttcccgccgcctacatacagaccgacgtgatgaatcgctccttttccttcctcataagcaaaaaacagcagatcaccggctttcatatcatcaagcgggacacccttccctgccttagcctgatctcccgcatcacgggggatgctgtatccattcgccttaaatatactgtacataaatccggagcaatcaaacccaaacccgctgatccctccccacaggtagggaaggccaagaaaaaacgcacccgtttgaatgatgtcttcagcagtccctttctgttggctgacaggcactgcatcactttgcctcacaaacctttccccaaaaacggtcgaaaccttaaaatatccgttttcttttgcaataaggggcagaactgtcaaaaagcttaattcgatctccttttccccattgcttctgtacaaaaaggcagcaggtttgctgatcatcacatcgtgttgtgtatggatgggctttgttttttccagctggtactttttcatccagcccgggtatccgcgcggatcctttcgggatggctggctaggcacgatcacagaaacccattccccctgttccgccgtcacaagtaccttttcgccaaagagaacctgagtttggattacattgtctgtacataatccaagccgttcatcatacgtcatgcgctccagccagtctctgatcattacagtcggttgaagcatgaattgatcagacggacgaggtgaatcaggcgctgtccagatgttggccactgctgatatgacagtgtgcatcattgctctttttcccctttcaaaagcgcagccccgatgattccgaggcccggtttgccaggcatcgaaatcgtgctgccgctatatgttatgccgccattgaatacatctgttttcagcatcagcggcgcgtcaaaatcaaagcgtgtgatgtttctcttgcttgccgcaaaatgcgccgcggccgtaatgcccagcttcgtttcgatcatgctgccgaccatacactccaccccgcaggcctccgccatggcattaattttctctgctccgctgatgccgcccgctttcatcaatttaatattgatcaagtctgcgctccgggtttgcagaacttcgaacgcctggcgcggtgtaaaaacactttcatcagccataatcggcgtatctgttgcatctgtcacctttttaagcccagcgagatcatctttatggacaggctgctcgacaagctcaatgcctaggcccgcatcctccattttccgaatggcagttaccgcttccttcggcctccacccctgattagcgtctaaacgcagtttcacagctgatccgacacgttttctgatttcctggatacgggcgatatctgttgcaatatcatcttttccgacctttattttcagcgtttgaaagccttgtttgagataattctcggcatcagctgccatctcttcaggtgagttgacactgacagtataatctgtttccagcgtatctcgatatccgccaagcatttgataaagcggcagcccgcacatctgcgcccagccgtcgtatagagccatttctacagcagccttcgcgctcatatttcctgtaagaagatgctggatgtcgtgcagaatggcctcatagcccgccaggctttttccaagcaatgccggcttcaacacatggtggatggcactttcaatgctatccatgctgtctcctgtaatcactaacgtcgggggtgcttctccccatccgactgcaccgctgtcataagtaatccttactatgactgattcagccgtatacacagtgcgaagtgcggttttaaacggctttgtcagcgggacagcgattcggcttgtttcgattcgaatgattttcatgtcttcagcgccccttctgaaacgcccgcctctattacggctgttttttctgctgtattcatagcagctttcgcaccgatcggaacggcaatacttggcgagcagtggccgattttaaatcctctcagagcaggcctgcccgcagaaataatatagtcttccagcacctgctcaagcgagagagacttctctcgcttcaccgggacacaattgtgaaaatcacaaactagaattcccgccgcgtccgtcagcttcccccccattttcagctgattcagcatccggtcgatttgataaggctcctcgtcaatatcttcaataaacagaagctttcctctcgtatcaatttcaaatggcgtgcccagtgtagacgtcagcaaagacagatttcccccgacaagctcgccttccgcttttccaggaacaagctcggtcagcggagaaagctcttctgtataggtgaattccgtctcctggaagagctgcttatatgacgcttttgtcagcgggtgaacgtcgtcaaggccaatatccgtgctgagcatcgggccatggaaagtgacaagacctgtgttttgatgaatggcagtatgtaaaaacgtaatatcgctgtatccccaaaagattttagggtgtttgcggatcaagctgaaatcaatgcccgcggcgatacgtcctgtcccaaaacccccgcatgcgcacaacactgcttttacctcatcgtctctgaacatctcatggagatccgccagccgctcatcatcctgtcccgctaaatagccgtgctggtttttcagcgccttgcccaacttcacctgaagaccgagctcttctaaaaataaaagcgcggtgtcaagcttttttggatccggcggacttgcgggcgcgatcactccgactgtatcacccttgttcaacgctttcggcttgtaattcaacgaaaacactcctttcatttgctctgcaccctacgtatacgtgcaagaaagagaaaaaataccgctccttcgcataaagaagcagtatttcctcaatcgcctccatcagtttttatctgcccattttaaatcgatatagccgacagggtgacggacaattccttttacttgttcattttgcaggtgaacctgattataaaaataaaccggaatgatcggcgcttcattgatgagcagctcttcagcttgatgcataagagagaaccgtgttttttcatcggcttcgtttttcgcctgtttgatcagctgatcgtattctttattggcccagcctgtgcggttcatcgaatttcccgtttgaaaggcttccagaaaactgatagggtctgcataatcaggcaaaaatgagctttgagagaattggaatttcagcgctttttgatcctctaaaaatacgttccattccatattggccagcttcacatcgactccaaggctatttttcaatttttgctgaatagcttcggcaatctttttatgctccggctttgtgctgtaagtaagcgtgatcgcaggaagcttattatagttttcttccttcatgcccttttcgagcagctgcttcgctttgctttcgttaggcttgatcaggtctccgcctgcttcacggaaatctttgccgtcaggctgcgtaaacccaggcgatacaaaggcgtgcgccggtttttcattatttttcgtgacgtactttacaatttcctcttgatccacagccatcgcaaaggcttttctgatgttttcattttggaacggctccatgttgacattaaatcgatagaaatagagacccgcctggtcaacaatattgacgttatcctgatcaagcagctgatcactcagctcagcagggacataagcggtatcaagttcccctgattgaaacatctggtaatctgtatttctgtcactgaccatcgcccatttcaccttatcaagcttcactgtatccttatcccaatacgtgtcgcttttctccattgtgatgctgtcatcatgcttccattccgtcagcttaaacgggccgtttccgacaaatgtatccgactcagcaaaccactttggattgtctttatcgaccttttcatttaccgggaaatacgcgggattggacacaacgctcaggaaatatttttgcggtgcttccagtgtaacttcaagggttcgatcatcctttgccgtcaccttcacatcgtcttttttccctttcccgctgttatatgcttcgccgccttcaataaaataacctaggaatgccgatgaagcgccttttttcggatcaagcatccgcttccacgcgtattcgaagtctccggctgttacaggatctccgtttgtccatttcgaattttcccgaatcgtaaatgtgtaagttttattatctttcgaaacagaccatttctccgccattgccggctcgggctcatgatctttgccaagacgcgtcagcccctccatgatgttatttaacggctgccatgacacattattaaagccgatcggcggatcgaatgaagtcggttcattttcattatttacatacagcaccttttctccgctggtttttgccttatcatgactgccttcttttccggcctgttcatttgctgtgcaccccatcagcgcaaacgaaagtcctaatgcaagacccatgccccatagctttttcactcgtttcatcctcttcccccttttcatgttcaatccttcgcatctcctgacagcaccgcatgctctgctcgttgatcctgcagccagcagttgacggtgtgcgagtcagatctgatcgtctggcccgggtacaccctgtcacacacaaccatcctgttcggacagcgggcggcaaacgggcagcccggcggaggcgaaaataaatccggcggcgttccgtcaatcggggtcagctcagcgccatttaaatccagccgcgggacagagcccagcaggccttttgtatatgggtgctgcggctgataaaaaatatcttttcttgtgccgatttccgccattttcccggcatacatgactgcgactctgtcagctacctgggcaacaacccctaaatcgtgcgtaatcagaatgacagacacatccgtttttctctgaatctctttaaacagctctaaaatctgtgcctgaatggttacatccagggcggtggtcggttcatccgcaattaagatatcaggctcgcaaatcagcgccatcgcaatgacaatccgctgtctcataccgccgctgaattggtggggatattgctttaggcgctctccgggatctggaataccaaccaatgacagcatggaaagcacctctttccgtgccgcttttttgctcatttttttgtggcgcaatagcgcttcccccagctggtcgccgacagtcagcgtagggtttaacgccgtcatcgggtcttgaaaaatcatagaaatgtcggctccccttatacctctcatttctttgtcagagagacggcaaaggtctttgtttttaaatagaatcctgccgtctgtcaccttcgccgaataaggcggaagcaggcccatgatgctttgggaggtaacgcttttgccgcagccggattcgccgacgatcgcaaaggtttctcctttatacaaatcaaagctcacccctctgaccgcctgaaccgtcccgccgtaagtcgtaaaagacacgtgcagattttggactgacagaactttttccatacagctacctcctcagcttagggtcaagcgcatcctgcaatccgtcccccagcacattaaacgcgtacatcgtcagagatatgaaaaaggccggaaaaaacaggcgccaccaatgcccagataaaatcgtaggcaggccgtcattcgccatcacgccccaacttgcaaacggagcctgtatgcccaggccgagaaagcttaaaaatgattctgcgaatatggcggcaggtacggttaatgtcatttgtacgatgatcgctcccatagtattcggcagcaaattcttccggatgatgcgaaaggttttcgcgccaaaggttttcgaggcgagtacatattcataatttttaatctgaagcacctggcctcttacaattctcgccatgccgacccacccggtcacagtcagcgccacaataatcgtgcccagtcccggtcccatgagcaccatcagcaaaatgacaacaagcagatacggcagtccgtacagcacttcgataatccgcatcataatgctgtcaatcctgccgcctttatagccggcaacgcctccgtaaatgacaccgatcaaaaaatcaatcagtgctgccatcacgccgacaaacaacgagattctcgcgccataccatgttcgggtaaacacatcccggccgagttcatcggtgccgaaccaatgatcggctgagggcggaagattttgttctgtcagcgattggcgtacgacactatggggcgataaaaagggcccgataactgccatgacaaaaagaaataaaagaataaagagtccggccatcgctaatttattttttttcagcctcctccaggcatcctgcgtgtatgacaaactcggccgcttgaccgaatcggcttcccgatttttttcctgattcaagacaaaccactcatcaggcacctgattgtgctgttctggctggcgttcatccgtttgtacagggagattcacacgcttcaccctttcttatgcagtttaatgcgcgggtctaagagaccgtaggccaaatcgaccaaaaacagcatgataatcagaatgacgctgtaaaaaacggtcgttcccataatcacggggtagtcccgctgattaatgctttcaacaaaatattttcccattcccggaatggcaaagattttttcaatgacaaagcttcctgttaagatgctggcgacgagtgtgcccaggacggtaatgacgggcatgagtgcatttctgagtgcgtgttttacgataattttgaacggagaaagcccttttgcttttgctgtgcggatataatcctgtgtcagaacttcgaccatgctcgaccgtgtcagcctggcaatgatcgccattggccctacagcaagcgctgcggtcggaagcaccatatgaatcgggctcgtccatgtcgcagcgggaaatagtttgagattgacagcaaattgctgaatgagcaatgttgccagaataaaattcgggatggagatgccgagtactgcaagactcatcgcggcgtagtccaaaaagccattgcggcggagtgcagcgattacgcccagcaccagcccagaaatcacagcaatgacaatcgctgtcatcccaagctcaaaggaaacgggaaatccgcgttccagcatatcatttacgctgtccgacggttttttaattgaaggtccgaaatcgaatgtaatgatggattttaagtagaaaatgtattggaaaatgagaggatcgtctaagtgatagtaggcttcgagatttttttgaacggcttcatttgtgcctctctcctcgttaaaaggagatccgggaatgaccttcatgagaacaaaagtcagggtggtaatcaccaaaatcgtagctgccattgcccaaaaacgctttatcatgtatcgcgccaaagcctaaaacacccctttagcagaatgatgtccgcatcgcaagctcagtcatgacaagcatcgcctgataggcttcaagcatgtccttcgcctgaaattgaacggttgtagttcccgtcttgatttccgttcccggcatcagattcgcccattctgcttggccataattggcgaattcaatgctcagaactggcctgtcaggcggtgtgagcggcttgactttgtccttgttttgcagggcaaatgcggttttttctgtcaacagccgtccggctttcgcaggcgacaagcacttcactgcggatcttgaaatggtttgtttgactgcggctgtcgtcacgttcgggataagctcttctgcttccttcgccgcccggtcatccccggctaccattaataccgggacatcataataaccggcaacgtatgcatttaatccaagctcaccgacaggccgatcgtttatgtaaaaatgacggacgccgaaaatcatgctgtgtgacatgacaccaggagtcgaggctctcgcatgataaccgagaaacaaagcgcctctaaacgtatcatccagtccctccaccattgaaaatggtttgacgtcaccagaaatcaagtctgcttcagggtgaagcttttcaaccatcagattattcatcttcgaatgactgtcattgaccagcacctcggtacacccgctgttaaacgcttcagcaatacagtagtttgcttcttcagtcatgataagccgtccgcgttcataattccgcttgccggaatccacaaaggtatcgtccggaagacccgaaataccttccatatctactgacatgtacaatttcataacgctcctccttttttactaaattatgaatattctaacaaattatattaaaaaaagaggaaaaatgcaatataactgggaaaaatctcaatcattcagtgataaaaaaagaatcctctttcaaggattcatgtttgtttaccaacctgttctgtaagcagttcatattttctcagggttctttcaaatacctcatcaaaaacgtccggcacagaggcgtgtatcacctcagctccctctcccgttattccgcctttggttgcaacacgttccagcgtctcctcgaaagacatatttttttcgatcagcatcttgccagttccgtatagcgaatgaatcagaaaatcaaaggcttcttctttggacaggctgctgtttctgacggcagacagtgccagttcttcaaagattgcagctatgaatcccggtgccgagctcgttaaattgctggccacatctaaattcgattctttgatttcccgtacacggctgaaaaccgataacaattcattcagacgttcttttttctctgcagccagtgcttcactgtgaacgacaagtgagatgccggcttctgcttcggacgtaatggcaggaataacacgtgagataccggcttctgtttctgcctccaaaagacgcagcggcacaccggcagctatggatacgatgtgagtatttctgttcacatacgggtacagacggcgcattgtttcgatgacatggagtggcgggacgcatatcaaaatcaattggcacgtatttgcccaattctccaacggatcagccgatacgtttggataatctgacatgagtgcccgcagccgctcccccttcgttctcgtctcaataaatagctcattctcttttatttgttcatgtttcaacagctgtctagcgatcatatccgccatgctgccatatccaatcaatccaatctgttccatcgactcagtcctttcatatacaatatgaagtgtaccgttttccgcactttttcacaatttcccataatcttttcatttttatcccacagtttttgtttatgataaactcaagtcataaacctatcaatataaatagacatgtgaaaatagagaaacggagtgaacatgatggataactatcgtgatgaaaacagaacgaaaggtaatgagaatgaggtctttttaacgaaagagaacgatcagagcgcctcctactcggcccgcaatgtcattcatgatcaggagaagaaaaaacgaggattcggatggttcagaccgttgcttggcggagtgatcggcggcagtcttgctcttggcatttacacgtttacaccgcttggtgaccatgattctcaggacactgcaaaacaatcatccagccagcagcaaacgcaatctgttacagcaacaagcacctcctctgaatctaaaaaaagctcaagcagctcatctgcattcaagagcgaggactcttctaaaatctcagatatggtagaagacctttcaccagcgattgtcggtattacaaatcttcaggcacaatcaaacagctctttgttcggctctagttcttctgattccagcgaagatacagaaagcggttcagggtcaggtgtcattttcaaaaaagagaatggcaaggcttatatcattacaaataaccacgtcgtagaaggggcatcatcactgaaggtatctttatatgacggcactgaggttactgcaaagctggtaggcagtgactcgttaactgatttagccgtcctccaaatcagtgatgaccacgtcacaaaagtggcaaacttcggtgattcatctgatcttagaacaggcgagaccgttattgcgattggggatccgcttggaaaagacctgtcccgcacagtaacacaaggaattgtaagcggcgtggacagaacggtttcaatgtctacatcagccggcgaaacgagcattaacgtcattcagacagacgcagcaattaatccaggtaacagcggcggtcctttgttaaatacagacggcaaaattgtcggcattaacagtatgaaaatcagtgaggatgatgttgagggtatcggattcgccattccaagcaatgacgtaaaaccgattgctgaagaattgctgtctaaaggacaaattgaacgtccatatatcggtgtcagcatgcttgatctagagcaagtgccgcaaaattaccaagaaggcacactcggcctgttcggcagccagctgaataaaggcgtttacatccgtgaggtcgcttcaggctctcctgctgaaaaggccggattaaaagcggaggatattatcatcggcctaaaaggtaaagaaattgatacaggcagtgaattgcgcaatatcttatataaagacgcaaagatcggtgataccgttgaagtgaaaattctccgaaacggcaaagaaatgacgaaaaaaattaaactggatcaaaaagaagagaaaacttcgtaagacataatgcctcaggccgtaaaagcggtctgaggctttttattagataaaagacctaattgttctatgaaactttctgacgagatatccgtatatcatacagattgacatcattcacatcagatgctagaaacatcgtttgctaggaggcatgaacatgaaaaccgtgggactgggtatgatctgcgcaggattggcttttcttttgctgagctttcttctctctgaatcgacgttgacgtggggaattgtattgggtacgagtattctattaaacataactggtacggctctaatcatgcgtttcttaaaagccccccaatataacagctgacatgcagcaaagccgaggacgaaatctttaagttttgctgtttttatttcagcatgactgaaccgcagtacaagctcacaatctcttctttacccaatttccatatatctatcagcatcttttgctttagatcgtgctcagagcataaaaaccccctgtccattacggacagggggtttgaggttatgacatatgctggtctctatagagtcttttattttcaattccatacgatttttggacgatgtaaagcggcctgtctttggcttcatcgtagattctgccgatatattcgccaatcacgcccaaaatcagaaggacaatgccgctgaacaggagctggatcacaataagtgatgaccagccggtaatcgtgctgtctgtgaatagcttcagatacagcacgataaacatatacagaaatccagtacctgacattaaaatccccgcatagcttgccagcttcagcggtttatgtgaaaatgtcgtgatgccgtccattgacagcttcagcattttcttgagcgggtactttgtttctccggcgagcctttcatcacgtacatactcgaccgctgtctgtttgaaacccacccagctgactagccctcttacaaatggatttttttcttttaatctcttcatttcatcacagacttttctgtccatgaggcgaaaatcccccgtatcaatcgggatatcaatatctgtcataccgctgagaagccggtaaaacatagccgcggtttgttttttgaaaaaggtttccccttttcgtttagtccgtacggcgtacacgacttcatagccttccttccacttttcaatcatttctaaaatcagttcaggagggtcctgcaaatcggcgtcaatgacgacgattgcattcccctgtgcataatccatacctgccgtaatggcgatctgatgtccaaaattccttgaaaaatcaataattttcactctcggatcgatcaggctgtgctctcttaaaatctcaatactgcggtctttgctgccatcgttgacaaaaagcagctcgtagttttccttcgtttgatccatgacctcttttaagcgctgataggtttcatgaatgacaagctcttcattatacacaggtacaacaattgaatattgaatatgtctgctcatgtttttgcctcctattcatcagcatgtagttcgtataatgttgctgactgattcattccgccaggtccgcccattttgccgttttcacctgaagccttgctgcttgatgtatcagctgaatcagtattttctgttttttgatcagaacttgattgccatttttctgatgctacttcttttccatttttctcaacccattcaacaatgtcattgtttccgcctcttcccattccagaagccaagaagtatttcacttttccttcttttacaagttttttgaattgagtcagtgtgattgccgggtcagaaccgctgtatccaccaatagccatgacagcttttttcgttttaatgatatatggtgccgctgtgttcgaatcggttgtggcgaataggtattcagctccggagttattctcctctagatatttgatcagtttttcatttacagtcgcatcagacattcccatgccttttccgctcattgatgcgagttgagggcctgtttcaggcagtgagctgttgcctccgtacagaagcggtgtacttgcccaatacatcggcatcaccagcaatgcgaggagagctgcaagtgaaacataataactgaacggtttttggcgctgtttaaacagcagcaaagcaatcgctgacaacacgccgataacacctaccccgatactccatccaacaccgatttgatcgttgtagtttctgagaataaacaattcaaatccagttgtcgcaataattgctcccggcaaaagccatgctttccagcctgtctgattgcggtacagatgaacaagagcgacccaccccgcaccgacaagagccgcaatcggcggtgccagcatgatgagataataatgatggaaaaattctgcgacactgaagaatccggcaatcggtacaagccacgcaacccagaacaccgtttccttctgctctacagataatcttcttctttctcttgcgccagcgatcagtaagcctgcgattccaaatatcgcaaatggcagaagccagctgatttgatcagataactcttgttggaaaagccgcagtggaccaggtgttcccgttccaaacatccctgaacctgattgcattttcgaaccggttcctgtaccgcctttccctccgtctccgccgggtccgccttggccgccatctccgccgcttggagggcctccttgaccgccgcttggcatttggccattggatggaggcgccgccatattgccatttgaggatttaccatcgcttgatgagctgttgcttgatgactgattaggcggtgcttgagtgttatcagaagaagacatttcttttgaagcgtctttgtttggcgcaccctggccgccgcctgaattttggcctgtcagccgctggattccgttatagccgaaagccaattccaaaacagagttggtttggctgcttccgatataaggccgcttgcttgcagggatattgtcaacaatgagcggccacgataacgaaacggctgctaatacggctaacgcacttaccaatgaaacgatttttttcttgattgtggcgtttgccgcaatcagatagaacaataagaaagccggtaaaatcatgtaagcctgcagcatttttgtattaaaacctactccaacaacgaaaaatgctgctaacagccagatcagctttccttttctgatcgctttaaagagaagccatgtagcaagcaataagaaaaataccagtaatgcatcaacattgtttgtacgtgctacagctacagctatcggcgtacatgccataacaaatgaggcaatacgcgccgccgtttttccaaatgtcggctttatcagcaagtacataagaaggacagaacctacaccagcaagtgcctgaggcaggatgacgctccagccgtgcataccgaatatcagtgcgctgatcgtttggatttggtatgtaacaggcggtttatctactgttataaagccggcagcatcgaacgaagcataaaagaaattatgaaagctttgcatcatacttgtaactgccgcggtgtaataaggattcaccgtgtcgtccttccaaatgttatagatatttaagaatgcagatgcgagcaaaatgaggaggaggacgatatccagctcgcgttttttcttttccacttatttttcactcctttttgtctaactttgaaatagtgtaacaagcaaatatgaataaactattaataaacaaagacaatatttttgccgaggccattccataccaatcacccatatttgcaaagggttttaagccatttctcccaatcagcatctgatatttcctccctaataaggcatgctgtttaggtcaaaattaattatggtaataaaaaaagccctccggcggcgccggaaggcaaaagaatcacaatttattggatcggtttcaattttgcttcaatttctgctcttcgatgctctagatatggcggaagagcaatcgtttggccaagctcatcaagattttcatctaccataaagcccggtccgtctgttgataactcgaacaaaatgccgttcggttctctgaaatacagcgccttgaaatagtagcgctcaactatgcctgaattgctaaagccttcgcggctgatgatccggtgccacccggcaagttcttcttcatctcttacccgaaatgcgacgtggtgaacactccctttgccttgacgctctcgcggaagatcgtttctttctattaaatggatttccgttgcagcaccgccttctcctgattccagaataacggcggttccttgcccttcgactggttcacggctgatttctgtaaatccaagaatattcgtcaatacgtgtaaagttggttcagcatatggcacagtcagttcaaccggccctaacccgcgaaacgaaaattcttccggaatgccgctctgtttaacaggcaggccatatccttttccttcctcatcagcagtcagcacaagtcgctgcccctcatgatcttgaaatgccaatatgtcacgtccggctcttttggagatgccgctgtgcgttacttgctgctcttcaaaacgttctttccagtaatgcagggcttctgtgcctggaacgcgcaatccaatagaagaaatactgtttgttcccgcatgaaacggtgcaatgcggggaatctcgaaaaacgtcagctcagttcccgggtttgccacttcatctccgtagaacagatggtacattgtcggttcatcctgattgacggattttttgacgagctttaatcctaatactttcttatagaaatccaagtttttttgtgcgtcggccgttaatgccgatacgtggtgaatgccgttaactttcatatgctgtccctccaggttattttatctcgatttcgagatatcatatcataattgtatatttattgttctaataacaaagtattttattcgcatgagaaagtcaacatatcagcttcaccgaaggttcgttcattttctgaattctcatctcccctctgtaccggctaaaatcctaatacataaaacacgaactttgtaaataaaaattatgaattttattcgtttatagaccattaaaacaggtatttctacagttttatctgctgtacacaaagcaaatttcgaaaatcagaaaatttattttatttcacttttctaaaatagggtttacaatatgaaaaaatagattcttcaacatgaagcttcaacatcataggaggttaaggacatgcatactgaagacaacggtttgaaaaaagagataggcctcttgtttgcccttactcttgtcatcggaaccattatcggttctggtgtttttatgaagcccggcgctgtgcttgcttattcaggtgattcaaaaatggcgcttttcgcctggctgttaggcggtattttaacactggcgggcggtttgacaatcgcggaaatcggaacgcagattccaaaaaccggcgggctttatacgtaccttgaagaagtgtacggcgagttttggggatttttgtgcggctgggtgcagattatcatttacggcccggcgattattggcgcgctgggtttatattttggatctttaatggcgaatcttttcggctggggatctggactatcaaaagtcattggaattatagcagttctctttttatgcgtcattaatattatcggtacaaaatacggcggttttgtccaaacgctgacaacgatcggaaaactgattccgattgcctgcatcatcgtctttggcctttggaaaggcgatcagcacatcttcacagcagtaaacgaaagcatttctgatatgaacttcggggcggctattttagctacgttgtttgcttatgacggatggattctccttgccgctctcggcggagaaatgaaaaatcccgaaaagctgctgccacgcgctatgacgggcggattattaattgtaacggcgatctttattttcattaattttgcattgcttcacatcctgtcagcgaacgaaattgtcacgcttggtgaaaatgcgacaagcaccgctgcaaccatgctgttcggttcaattggcggaaagctgatcagtgtagggattatcgtcagcatctttgggtgcttaaatggaaaggtgctttctttcccgcgtgtttcatttgcaatggcggaacgcaaacagcttccatttgctgaaaaactgtcacatgtacacccgtcgttccgcacaccatggattgcgatttcttttcaaattgctttggctttgattatgatgctgatcagcaaccctgataagctctcagaaatctccattttcatgatctacattttttatgtgatggccttttttgcagtgtttattctccgcaagcgagcaaagggagaaaagcgcgcctacagtgttccgctttatccatttatgccaattctggcaatcgcgggctccttctttgtgttaggcagcacactcattacagatacaatgagctgcggattatccatcctcatcggccttgccggactgcctgtttattacgggatgaaaaaacgaaaagcaagctgataaaacggttcccttgtttagggaaccgttttttggtgaaacagaagataaaagttgacaggaaaaacacaacttttgatatactttttacgttaagcagaaagtttttgcaaacttgggtcgtttttttaaagcgaagtaggtcaaaataaggagacacgatttatcaaaaaagtcaagatacgtttttttcgactttacctgttttttttcgacaaaaggctatataataatttgatgtgtgcattgttcattcaaactatggagggtttttaatgataagaagaaaaaaagataagttctcactccttttaacagaaattgcaaagaacatagacgaaactgcagaatattttgtgaattttaaggtcactaaccaaacgactcttaaagaatttgcagatacgttaaaggaatatgaaacaaaaggtgacaatcatgttcatgtcatgattaaagagcttaacaaagcgttcatcactcctattgagcgcgaagatatccttcagctgacaaacagcttggatgatgtgcttgacggaatcgaacatttctctgccatgatggagattttctcaattacttcatcagacgagcatattgataaattcagcggatatatcagagaatgtgcgaaagagattttgattacgatcgagctgctggcagaaaatcgcttaaaggatattcagcctcacgcaatcaaaattaaagagtatgagcacagttgtgacaacttgcacagaaaatcattaaagaatcttttcggaaatgaaacagatccaatcaaagtcattcaatatcgtgaaatatacgaaacgcttgaagaaatcgccgactcttgtcaaagtgttgccaataatcttgaaaccatcattatgaaaaacgcgtaacgaggggtaaaaatggatattctattaatattaacgatactaatagtcatttgtgctctggcgtttgatttcatcaacgggtttcatgatacggcaaacgcaattgcgacttcggtatcaacaaaagcgttaaaaccgcgccatgccattatattggctgctgtgatgaactttgtcggagcaatgacgtttacaggtgttgccaaaaccattacgaaagacatcgtagatccttatacgctggaaaatggctctgttgtcattttggctgcgctactcgctgcaattgcctggaaccttatcacatggtactacggtatcccaagcagctcatcccatgccatcatcggcgctattgccggtgcagccattgcggcagccggatttgcagcgttaaactataagggcttcattaaaatcattgaagcactgattctatcaccaattattgcctttgtccttggttttattctttatagcatcgttaagctgattttcaaagacagcaacttggcgaaaacgaataagcaattccgcagagtgcagattgtaacagctgccctgcaatcgtatacacacggaacaaacgatgcgcaaaaagcaatgggaattatcacaatggctctcatcacagcgaatttacatacttctgctaatgatattcctacctgggtgcaattcgcctgcgcgacagccatgggtctcggaacatcaatcggcggctggaaaatcatcaaaaccgttggcggaaagatcatgaaaatccgtccggtaaacggtgtttccgctgacttaaccggagcagccattattttcggcgccacgtttattcatttgccggtcagtacaacccacgtcatttcttcatcaattcttggcgtcggtgcgtcccaccgcgtaaaaggcgtaaactggggtacggccaagcgaatgctcattacatgggtcatcacgcttccgatttcagcgacacttggtgccatcgcctactttattttaaatatgatattttaatgtcacaccgcttctgtcaaaggagcggtttttttgatggaacaggaaaaccatccggatctctcgaatacaataagcagaacctatttcagatgtgagggattcgaatatggttttattctttcagatcatggtctggtgcatcgtggccggactggggttatacgtgtatgccacgtggcgtttcgaagcgaaggtcaaagaaaaaatgtccgccattcggaaaacttggtatttgctgtttgttctgggcgctatggtatactggacatatgagcccacttccctatttacccactgggaacggtatctcattgtcgcagtcagttttgctttgattgatgcttttatcttcttaagtgcatatgtcaaaaaactggccggcagcgagcttgaaacagacacaagagaaattcttgaagaaaacaacgaaatgctccacatgtatctcaatcggctgaaaacataccaatacctattgaaaaacgaaccgatccatgtttattatggaagtatagatgcttatgctgaaggtattgataagctgctgaaaacctatgctgataaaatgaacttaacggcttctctttgccactattcgacacaggctgataaagaccggttaaccgagcatatggatgatccggcagatgtacaaacacggctcgatcgaaaggatgtttattacgaccaatacggaaaagtggttctcatcccttttaccatcgagacacagaactatgtcatcaagctgacgtctgacagcattgtcacggaatttgattatttgctatttacgtcattaacgagcatatatgatttggtgctgccaattgaggaggaaggtgaaggataatggaacgtgcgtttcaaaacagatgcgagcccagagcggcgaagccgtttaaaatcctgaaaaaacgttcaaccaccagtgtcgcaagctatcaagtcagtccgcatacagcaagaatcttcaaagaaaacgaacggctgattgacgagtataaacgaaaaaaagcatgatcacactaaaaggacaagggaaaacagctcttgtccttattccttttcttaaagggtgacatataataaatacaaacagaggataatgtcaggtgatacagtgaaaaaattggtgaggcgtgtgaagtttgttgattacggaaggtttgggctttccgggtactcgcttcgggtgagggagcgcagtgctggaattataaaaaagttgaagaagaaaaaataaatcccggagcggctccgggatttttatggtctttgatcagcttaattgcgctgcgatcttctctttcgtcgcaggcccgtagataccgtcagcagttagaccgttaacagactgaaaacgggcaactgcgtcagctgttttcggtccgtaaacgccgtcaattccgttgttaacagcgcctttatcagggtaaaaatacagagccgcaagtgctcgttgcacctgaaagacgtgttctcctgatgtataaggtgttgtcaattgaatgataccatcagggagcggatagagctcgggtttttcagcagccgatggagcacttacaattaatacttgaccaacgcgaataagattcgggtcttcgatattgttccactcttgcagctgagcaaccgtaacaccaaatgctctcgctatagatgtaagtgtgtcgccctgtttcacgacgtaagtttggctgccgcctcccccaattcctgctttgaacgaatcccacgtatctaacaattttcgcggacattccttccctgaccaatacttatgagggacgacattggcgagactgatattatgttcagccattaatgttttgatgagccactgggcatttgctgttgcttttgcaaaatcgccatcggcattttcgcaaatttcaattccaatagaagcccggttgccgctgccatttccgtctcccgcatgccagccgttttcatttaaaggcagatgctgataaatttctgtatcatcaactgtaaaatgccagcttgtcgtcgtatcaggatttttcaaatagcgggcatgcgctgcagcatctgctcctactgcggtattcgctgtgttgtgcaccgtaatgtaaagcggcgtcattgcgtagcctggacggttatttgcgccaaccggaataaagtcttgaataatgttaaccattttcatctctccttatttcgtcagattattgtcccttaacaagtcgcgctgttttttccctttttctgttacatagttgtttttaaaccaagcggcaagtgtcgttccaattgtaaatgcgatggaaccggctgaataaagagcgtcagcgagctgattgacctgctcctcctgaatgtccaatggtgatttgccgagcatcagcatggtctggttgattaaagcaattaaaagaagcaccgtcctgatgaccgtgcccttgtcaaacgtgttcataaaaatccccctttaatgctgcagcaggctgtacataatggcgatggctccgccaatgatgcctgtagacactgctgtaatgatggcacctgtgatggtgcgtttaatccacgtggtgttttcttcaattttgtttaatttttcgttcagcgtcatgatttgctggtcttgccggtcagacacgcgttctaatgcggaaaccctctgctcaagtgctttgtgctcgcctttcatgtctgctaaatcctgctgaaacacattcacgtctgcctcttgctgcatctctcactcctccttcacatgcagatcacctcccttccgagggccgagactattatgaaaccgcggtcccttttaccgaaagagtaccgccggtgatactgataatctccatgatgatctccttaaaccctttaatatcaaaggcccatgcctcagcttttcctaatgtactggaggcagtggtagcatcatcagttttcacgcctctgatcggcagtttctgtcctgacaccgatttgccccaaaatttgacttcgctcatttctgctgtgccgtagacttcaacgagtaaatgcgcggcaccgtcaacaggtaaagcagccccctcgctggcggactctgcattttcatgaaagacaaagtcaaatgttttgcgagcctcgactttcagccgtccatcgtgtgtttgattctccgcaaagtcaatctgtaaaggcgttttttcattgacacgcacatccatctcacccgcaccgactgattggtataatacaaactcagattgctgaagattcccgttcacatagcggaaacggtaatagcgtttagaaagatatacccagtccgtcgctgtcaggacgcctgctgcgacattaactgctgctgtcgttgtccaaacattgttgttgtcgctttcttctataaagagcgtaccttcacgatctgcatacgcccagcccttcactttcgaaatcagaactgcgccaagcctgtcctgcccgagctgactgtatgcctcagtcgcctttaaagcagcatttgttaaaatctccgctacgcctgacaaattcgaaacaggtgtcacaaaatcattttttcctcctcgatagggctttacagcgccggcttttccagccttatcgagaggaaattcatattgatacttcaccatcttcatcctcctttgatctaaaaacaggcaaaataaaaaagccttacatggctttaccggtaatttctttatactggtcagctgtgatcagctttttgttcacaccctctgccagatcctgaattgaacagtcttcatatgctaaagcctgtttcaccatatccgttgtcgcccactcataatagagggcaagcacccaataattcattcagcataatctcctttcaaggaaagtaatgatagctttatatctgacaactcgttccctaatgttttgttcagctcttcaagctgcttgcgtgccagcttttcctgtgacaattcttgagcgagaagctccacctgatcaggcggctcgtacggcggatttttttgcagctcttcccaccaggtttcgagttctgcctgagtcggcaacggcgcccggagattccatttctcaatgtatgaaccgttcccgtcattacgcaattcaaaatcctttctcgatactgcgtttggatacttgtacataatggcatcatataagatcataaaggtacctcctaaactctcgggtaatttcttccgccaagctccagaacatcaaaataattgagagctccattcgaatctgtaacatatcgtgttacatccccggaataaccaacataaacataaatttcaacataatctcctgcatcaagcggaactgtaacagatccagtaacagttgcattaaactcattatcactgttattggaaggggtaggcattctaaattgattcattaatttatactttgtgccgtttacataaacatataattcaaaattggagtatcgctcagtattttctatatataaactagcactgactaaatgcattcctgcatgactggctacaaacctattgttttttgtatcaaacaatttatggctatcttttataatacggttatatttaattttgttattttctcctttaataagggcttgacgcccagtagtcccaatattagcgtgagcaaaccctgatatcttttgccacgcagtccagcctgaatctgcccaccaatggcggatccaagtccctacatgatcataacttccactagttgtgtctgcatttccatagaaatactgagtaaagcgataattactatgcttttcattttttacaaatccataagtgagcgggtatcctgtagtgttattggcccctatgtccataaaagtgattccgtatttgtaatcatttccgcttattctcgcatcttggattgcatttgatcctgttagaacagttaacttttgatttgtataatttgtttcaacatagtttttagcatcagctaaagctttatccgctttattttgtgaaccttccgaattctctaatatataccaccctgaataatcagtaccattaactgctacccttgtataaagtgttttcgtagagatgctaaaccaatcttgacgtgtagcccatttatttgcagaggggtagataattaataaacctgttctgttatcatttaatggaaattgattttgcaaaactggatttgcattcatgtaattagtgtctaaacgataagtgccaggcggaagatttaaatcatttgcatcggttattgaatttaatggtctagtaataaaggccgtgctgttagtataatcttttgattggtttaaagcagtatcagcttttttttgcgcaccatcaggtgtctcctgcttaacattctcaacatttccgagacccacttgttgtttagtaactgaatgaggattagttttatcattttcatgaagatctaattctgtttgaactctatctataaaatctgttgttgcaatttgtttccatcctctaaattctccatcagtgtgaaccattccaatccacatcatacttccccaactttggtaagctactattgttttccttcctgaaccgccttctacaatatcgtagttataccaagctgcatcgccttccaccgggttgtttacaactgactgaccaactgcacaataaaatccagaagataatgtaagaatatctgtaccgtcttggagttgtattcttttaccgtcgtctccagtaagtttaattagttgggcagcattccatttgtttctttccccttcagatacatgaactttagaattgcttaaatgagcatcaaaatctgctagtgaggcttgtttcacattttcgacattcccaagtccaacctgtgcttttgttacttggttaggattatctcttcgtgcagcaaaattgtctgtatatgctttggcgtttgcttcagcttgatctgccttatactgggctccggcaggtgtttccttcgcattccattcatcacgttctactgatgtaatatgccgggttgaatcatgattatgttcattaaattccgtctttgaagcctgctgcacattatccacattccccagcccgatttgcgcctttgttgtgttgtgggggttgttcatgtcgtttttgtgggcagccaggtcggtgtgggcgtcttttattcctttttcccagcggttgacgtcatcttcgttgattgggtcgtccggaagccagtctgttttttcttcgtatgccatgtttacaccacctcaaaagtaaatctgaaatcgagtgttctgttttcgctgacgtccaggtcagtctttctctctgtgatcacattgcccagctcgtcaaaaatttgtaccgtttcaatatgcttgatgtcttcctcacgttttgtcagaacggtgactgtcgcaccgtcaatggcgagctctactatttctgttttttggccgttgagcagcacgtgatcgattctgctttttagatcagccgctgtgcgttctctgtatatggttgaaatcaagttaaaaccacctcattgttgttaagagtgacagaataaccgaccttgagctcactggctgttcggtatctgcggtgattcaggatgactgtatctttgattcgcagcgtctcattcaatccgcctctgagcgtatacgccaaatgagcgggtttcatgttttctatcgcttcgatcagctcattcatgtgctggaggtcatcaacattgatatcgacgttaaatcggtattcgccgggaagcaggcggacctgtgcagacgggtttttcaagaaacggtttaccgcctgctcaatggccctgtatgtgattggcgggatgttcgacattttggaaatgagccgcaatcgtctgatctcatcagtgtcgcctgattcccgcgggacgtttaaaattttttcccagcggctgagcccccaagtcgccgtcggtacgaataactgatccgtcagatcaaatatgctgtcattttgtttatcaaactcaggcgcttccgctttcagcagctcggccatttctttaaggctggtgagaaacggcggcagataagctcgcatgtcatcttgtttgctcaatgatcttcacctgcccaagcttaggaatttccacgtcgctcagcaccagattttcagacgtgccgttgatttgaatattggagtagtcactgactgatggtgaattatagacgatattgttaatttgagaaaggcggataacgttgtcttcaaacgccatttttttaaagaggtttaaaacgccttcctcaatttccgacttcacttcatcaattgagtgattgatctcaggcagcacttcggcagaaatctcaacttccttccagaccgcgctttccaccgtgacaacggctccgattggcgcctgtccctctccctgtcctggttcagggtcgatataatctttcactttttgaattaaaataggagaagcgggctcaagattcgcattggtgacgacaattttgaccgtgccttcaccgttccaaagcgggaagatctttgcctttcccacaccgtccacttcctcagcccactctttataatgcattttattggcactgacggcctcacgccgaacccttgtaaaataccgttctcgcaagctgtcatctccctcttcctcgcgccccggaatcaggatttctttgacaatggccgtttctaaaccgggaatggtatccaatgacagtaaattgcgtccggtcagattggcgtttcccgcttcaccaggtgtttcacagatgagcgtcccgtctgccgtatattgaaaataaagattatccacgtaaaagcgggagccgacaggaatagtaactccagatgtaaactctcccgctctgaccgcctttgtcgcggctgtccgttcaattcccgcttccgctgcacgcctgtctaaaaattcgccttgtgcggtatcagaaaaaactagctcaagcacagtatccagccatatataagacttcgcaagctcggccgccgccggggctaacgcattataaatgacgctgccttctcttgtgtcaatatctgcggaaatgctgttcagcatacgctccataatcgcttcaaaagtctgatcttcaaacatcttcgccaatcacctcctcaatctcaagcgttccttcatccgtctccaccacgaaggacacatgaaacgcgtcgccttgtttttcaatctcaaaatctgttacagcagatatccggtcatcataaaccagcgcctcttctatcagtctcggaatctccatctttttatacgcatcagtcgtctcatgatctgtcagcacgtcctgaagctcgtttccgacattatggctgtatatggaatatgcatagcgttctgtctgtaaggcgatatacacgaactgcctgatcgcttcaagcccggtaatcagctcattcgtaattcttccgttttcaaaatctattttgtacgtttgcgaggtttcaatgacttcgctctcaacttcaatatcttcaaactccacttctggtgtcagggccatgttgcccactccttttacatgctaaataaaaaccccttcgtactgaagcggtttgtctataccttatctaaaataaaaaacgattgcccgccagtcagagccgcggtcatgaggcgatcccccggctcgagtgcatcgtctcctccggactgcattcgttttgggataatgatggcgtcttccggtatgatcagtttgctgttttcttttaatttgatttccacaggagaaaccgaaacgacttcagccgggagcagttctaccggagactcagcgtcaactgcgccgactgccaaatgttttatagcctcacttaatctcatcaggaaactccttccggcatcgtattcttttcgacaacatcgatcgtcatcgtatgtttcgttcctttaaattcatgccggtccgtatctacccaataggttttcttgatgccggcctccggaatcgaaatatagacaggcaagccgctctgcacttctgggatgcccactgcctgaatatttttcagttcttttttcacgccctttttttcagcaaggcgtacatctgcccgctgctgaagctgtgcctggttgatgtcatctgtgaccgtttccgtatattgaagcacaccgtatttatttaagcctgaactgtccttggcagaggctttatatgtcttattgtccttctgccggcgaagcaccacccgagtagcagtgtcgtttatagaagtgctgtattggtagcccgtgatattgacgcccgtttcaagcacccatacctctgacggatctggccaagcgcgcaggccgagctttcctttttccgaatacagctggtaatgtcgtcctgtctggcttttcgtctgtttcagcgcttttaatatgatgtcatacaatgtcgtatcatttttaatgacaagacttttgatcgtatggcctgtgtttgcgatcgaggttgtcggtatctggaagtcactcgcaatccttctgatgatctggtcggcccgctgattggaaaacacgtacatatcctggtttttgaccaggtactgcagcatgtcataagcgctgaaggcaagcgtatgctcgtccggggttcttgcaaaaacaatgccccgaaacagctcttttcccttccatttaaacaagaccgtatctccttctgagacactgtaatacgtctggtcgccctgcttggtgacgatggttgcttcaatggaacgcggcgcctgataacgatggccttcaagcgatacgctttctgcaaccagctcaagccactctgtgtctttaatgacgaacagttctatcatcatacatcacctgtttcattgcggtatctttaatttttggccgggaaaaatccagtggcccggctgcctgatgttccgtttgcttcgtttgatcattgctgttttattggcattccaaattttgcgccattgggtgctgttcccgtaaaatctgcctgcaatgtcccatagcgtgtctccctttttcactgtgtacgtcttcggcgcagccttcgacggacgttttgcctttgtttttttcttctgcttgattttccgcggggaagcggttttgtattcttttaattgaatatcaaaggaacgatcacctatatcctgctggccttcgctataggaaaaaccttcaatactgcatgttaaattcactttagttcccgtaatcaaaaactgaaccggttttttggccttcatccatttttcaatttttgttatcgcattttccggcgacgggaagttttgatattctgctatcggactgtatttcttcggaaaaaaagaagagaacgaaatttctttcgctccctgctcgtcaataaatgtaaggtcaccgaacttggctactttaaccgtctcattctgaactgtatttgaaatactcagctggtcgggaagaacggggagccgcagcttgtccttcccttgtgaaatccaaaattcatatacggatttagtcaaatgcaacgactcccttcgttccaatattgatatccttttgcagttcatctataagcgcctgcttgatcttcgccgctaggctttcggcgtcttgtccattatggaagtgctggtcaccgttaaattgaatataaatctcttttgatccagaaaccgctgcagtcggccggctagccgaggtaacagctgaaacttgtcctgaagaaagctcagactgctgggattgagacggatctgtcacttccataccaagagcctgtgccgctctctgaagaaggtagcgaccgcggatgccccgttcctctgggatgatccattcccgcttgtttccttcaccgacacgggcaatttgttctttcgtgatcagcccgccgtttgcataaccgacataaggaccgccacgtttcaggcttttaatgccaggtacattatcaattgagccgtatctgcttttgatatagccgatcgcggcagcagcgttgtgaatcggatttctaatgttacccatgcccggtgctttatgagcattaaatgtggttggaactgtctgcatgagtccttgtgatggatttcccgccttcgcgttgctatcccacaggttaatagagttcgggttgccccctgattcatactgtgcaatcgtcattaatcccgagagccagctcaatggtgtctttgtggccattattgctgccataagccactgtttcacatttccccctactgcacccattccggaataagcagctgccaatgaaccggcttgtttttctgcgtattttttcacatcgacagaatccagtccttttacaacaccgacagaggcaaaacgccccaagctcatcatgactcgagaaggtgaatggatatctaattcttcacggaaagcctgctccactctcttggccatatcctttgctgcttgttttacttcactggatttagaattcatgcctgtcacaaagtttccaatcaaaccggagccccagctgttcgatgtgtcttttgaacgcaggaacggtttgtcaacatgtgtactcacatactgtgcagtccctgtttgggttgaattttgtccttgcgcaaagcctttgaccgttcctgtgccccatgaagacgatttgctcacagtggcttggaacggcgttttaacttttgattgcaaaaagccgtctgttccggttgcagtgccgctttggcccttggcatacccacttaccatttgtttaccgtaatttggtgaagcagaaatcatttgtgtaaatggtgtattgatgtttttctttttccagtcttccattttgaccggctgatcgctgatgcctttaccaaagccttctgaaaattgctgtccgagtgtggacgcttggcctgtaagatttgcagtgttcattactggggaggctgtgcctgatagaggactgacagctgctcctcctgaaacagatgctggacttccgccagaagacgaagctgcgcccatgtcgtctacaacttgcatacccagcttagacgccgcttgtgaaagaagcatcttcccccggcctcggttgttatcaaccgggataacgaattccttgccggcttcaccgatccacgagatggttggtttggtgatgtagccgcctgtggcgttctgatctagtgcttgttgaaaaacagtcatattattatttgatggagattgagcaaaaatgttattagtagttggtttggaactagtttttttctctttcgaatcctttttgattggttttttcttgaggtgagtaacttcttcccccctgtgtattacttttgcaacgaaaccaccaactgaatcttttaaatcgaatagccattgaaatttctcagcaattttctctgatactttaaccaatggatctttcacatgttcattaaaccaagtttcaattccatcccatgcatcctcaaaaaatttccttgcatcatcgaatttttcttttattgaagttttaatatcttctacttttttgacgatcgggttccatacattatcataaaaccaattcgatactcctgtccaaatattggaaattattgtccatgcatcattgatcttactccaaatccatgttgccgcagtggttacggcttcacttacaggattccacacattgtccataaaccatgttgaaacagtagaccatatgcctgaaataaccgtccaggcgttgcacaatccagtccatatcgttgtagcaacattagtaactgctccgcttattggatcccacacgttatccttaaaccacgggtagacaatgttccatactgccaatatgccatcccaggcataggcaaacaatcctactataaaattaattacaggtacagcaacattatatataggtgtaaacacatactggtcaaaccaagttgaaactttactccatgtatcttcaatccaagtaatagccccattggcagtatcagaaatggagttccattttccactccaccactctttgttaaatagtgaattgcttatgctctcctttaacttagaagtatcaaacatcttaccaatgttcttacctgcttcttcgccgccgattccgcctactaacccgccgccaattccgccgattgcgccgccgattgctgtaccttccggaccaacgaaagatccaatcgttgcaccagcttccgctccggctgttgcaccagcttccgctccggcaatacgtcctccaattgaaccaaccttttcgccagcattatctttattgattccagctaaatcaaacactgctaaagcagatcctacgtatggaacagcctttcccattcctctgaacgctttacctagtttagatgaatccttccctagcgattttaagcctccaagccagttctttaacttggaacccgaggtcctaggtgcactttcagcaggtgtgccgctctggcgtcttcttatcacctctccaggaaccttgagtgttctgtttggagcctttgtgggacttttcttttttctataggttttttatttttagtgcccgggctgataccgccttcacagcagtcacagcaacaatttcctcctgtattacggttaaggacttttttatctgtgtcagaattttcaccagaatcgtcctttttttgtggtcctagaattttatcaatgatcttatcaaacacatcatttttcagcttttctatcaatctctctttgaaacgatccaaaaaagctttgcctatttcattgagcgtatctttgatccaaggccaagctgattttgtccaccaatccttcagccagccttttatttttccgacccatccaggtttttgatctgagtttttatcagagcctttatctgaggatttgtctgattctttcttagaagtttctttgttaatcaggctttcttttttattgattttgtctgatatttttgtcttaacaaccacttttacataataggttttttcaaatttccttagaagggctgttaatcgattaactgttttggtgatttcatcgatgacctttagttttactgtgtatccgtttttcaaatttttcttaatataaccgataatccttttaactgtagaagtaaccttgtcatctggaatcaaaaggaatgatagcttttgattagaaagcatcttctttatttttttatacgcagctgctgtccgatctaccaaagagacagtcagcttcgtttctttcggcagccgtttaagttttctttcaattgcatcaagctttgaagtgacttggtcatcaagtacaactttaatttcaagcgatttcgcgaatttcaaaatgatatagtcgtttatttttctcagccggtaaaatgcctgatcttccgctctgatactgattttgatttgccgattaatggttttgacttttttttcgacctcttggaatcctttatgtatccgttttagttttttagataccttgtcttcgagatcaaaacgggctgttaattttgcgatattagttccctcctctccttgattctttttctaatagatctagcttataacctatcaacccaaataaaagagctttaaaatgttttggtgcttcatataattcaagaagttgggatggcgagtaatgaagctcatgcattgcatagtacaaatacacagcttccttatcgccatcctttactagttttttgcttcttcttctagatcttcaagatcatcttcaaaaccattgatttcaattgctttattcagccagttcgcatactctcccccaacagataatacacgtttggcaacttctaccggatccgcagttttgtatgcttcccttaaatcttttgaacgaaaatcaggataaatagtagattcgatggcaattctcgcataaaagcgctgggagtctaaatctttgacacggccgcggcctttcacatttttaaatgtggtgttttctttctctaattcatcaatccgttcagtagtaattggttttaaaataaacggaatgacattcccttttttatcaacaaaacgctttgagatcggcactttgatttcctcagcttcaattgtttttcccggcataaaaaaggaaagatcatatacgttttcgttcttctcgctcatgtaaaaaaactcccttgtctattgtttggtttcatctttaaaaaacagacctttctgagaaaggtctgcgtatgggctgattcagctttgattaaaacgtgtcagatagcttttcagggacgtcgaagtcttcgaatgtaaatggaacttcttcctctaacgcttctgaatcgacatcaaggcttgcgattttggcagagtcaaagttgacgtcgtacagcgtgactcgctctgtgccccggccggaggattgatcatccagcacagcttggagcgtgaaataagggtcgctgccttttttgacatagtccatcatcaatagcacgaattttgatgtgactttgtagaacgtcgcggtccctgttccatttgcccctgttgttttatggcctgtcatgcggcggcccataatgttgacttcagacttgtttttctcgacgtttgcttcaaaagttttgatgtgtgccatttcctcaccatcgaggaataaacggccttcttttcctgagattgtgttttgtgcttttaatgccatattagtttacctccacattaaagtagaatttttctgctgcgtcgacaggctgtacagccaggtcaatcaagaagccgtcacgatcttcattcattgaaattgtgatatcttcatcggaatcaaagccagtgatgccgcctgcgtcctgaagcgttgtcatgtattgtgtgatcatcgtttttacatactgcagtccgtcttcagatgccgggatatcgcttccgctgccttttcttgatttaattaaggctttcagctcgcgtgttaaatcattattcacagcatccaggacacgaacgattttgttcttcgcaaatttcttgtttttctcagctgtgaacgtcacgagtgagttaatatccttttctacgctgacggatttatcacgggcgtcgaatgtgaataaaaattcacctttacccagacgttcaacaatcgtatcgtggtcaaggcggtgtaacacatcaactgcgccttcgtactctacaaatgtaagtgattggttaaaggttgctcctgcactcgctccagctacccaagctgttgctttgtccggtgtaacttccgtgccatcttcaagcagcacaccctcggttacgttgatgatgccttcataatcaccggcataattggctgtgacgccttgcactttttgtccttggccgtcgcgcaggcgtttaatgaaagcagcaaacgtcgctttcaactggtcaccttctgcaacaggcagcgcaatcacatcaaagctctccgtttcagccgcggctaagaaatctgtatagtcggagttgacaggggctttatccgtaccgccggataaacggatgcccgcggatgcattcagcgtctcagctgcagtgtctccttctgatccagtgagaggaatcgttgaagaaagatcgcctgttccggtaaaagtgacatagccgttagctgttaattcttcagcctttttgacagtctgtttatcaacctctgattcgtccatatatgttgtcacatcgaaagaattagcatccagcacattttgattgatgcggatgataatgtcatttccttttgttccgccatatactgcagttgctttgacgccttcagcaatatcagcagacgctcggacaccttcggttagacggtacatcaataccgttttcgcatttttcttcgcttcacgcagcagcaataaagacgggtcatcaatgctgaggcccacttttttgtttaggtcttcaacgctggaaatggagacgaacgttttcgcttcgccccagcttgaggcgaccggaagtgcgactgttccccgttcactgagtgatacccgctcctgtgccgtcgttttaaagttaaaataaatgcctgcacgttctttttctttgcctgttgtaaatgttccgccattcatgatgacatgacctccttggttagaaatgtttgaatcaattggttggcttctgatttcgtcatacgtggttgatccacgccaaataaagccccctgaagaatatccggcttaacgccgaacagttccttcgcgtgcttaatcaaatccgctgtatcaaatagagcttcccggctctttgtatgtacagccttcttctgttgtttgtcctttgacaccgtttatttcaccccgctgttcatgtcgatatcctgtaagacaggctgttctgttttgtgataataatatctgctgctccacctgatcaccatggccgcctcgcccctgtcccctacccttgtctcgatttgggagatgcgaaccatatcccccgtcttctcgccggattcactcagcagcggaatcatatttctcgcttctctgatggcatccgcgagcctgtccgcttcatccagcgcctgaacggagtccagatgaaacagtttcacattgagactgtaggtttttttaaatgtggagaccgtatctgtttcctcgaaaacagatggtggcgggacatataacgacggcacctgaaagtgatcaggaagctcgcgttcataaatgggaacagaccaccggctgtacaaaaacgccatgatcgatcctgtttcactgttcatcctgctcctcctttacagcttcttcagccactggcgcagtttgctttccagcgatttttcaaacagctgttcatataaaagcagtgcatgatcccagtagcccgtgcccggtatccattttctcttgagcgccattcccgttgaagccgctggatcataaataaaccgtgagccttgaaaacgccccggcacccatctcacatcttgttttgacgtccaatggccgtcattaagaaatgaggcgtaatcaagctgtgtccccacctcaagcgaaagcccgccgctttgcacaatccagagattgtcctctgcgcctttctcaaaggaactgagcagtttttctgtatcaatcgtttgtgtgctgatgagttcagattggacgatctctagaaaatcttgcccgcactcctcaagccaccgggacgcctgtctggaaaaaccgcctgaagccgcttcttttaatgccgtgttcagctgtttcaatcccgctattttcataggctttcatccctgactgcgacgacctcccaatgatgatgtctgatccttttcggcagctttagtatatatttatgattctcccaaatgattttatcgttcacgcggatgtccgctgacaacggaaaatggacgagaaagctatgatatacagtttgatccggctcctcctgaatcagctgctgtgttttttcggtaaaataacaagggacatcttgttcatcgggtgtatccggatatgaaatcaccggctgcagcctgtctgccggaatcccaaatcggcctgcagacggcgcttgcgctgcttcatgataaatatcgcagcggtgaatgagcatctgcctgtagctcataaagatctcaccttcagtctggaggattcagggacgtagcccggcttaataaactcttcgagcaaatgatacacctcaggccgctgaatcctgccttctccggaaaccgtgtaggaataatcccccattttctcatactgatagcttgatgaggcagattcatcgctgttgacaagcgcaaaatactgggcaagctttactaaagccaacttcaccttgccgggcagcggatcatacaagctgtcttcaaagcggtggcccgtgatgagagccgcttctgcttccgcctcgatgatatcctgcgccagcagctcttccggcctgtttttcacccgatcatagaccgaataggaagctacgtcagtcggttcaatgagcatgagctgaccacctcgtttctattattcttttacgttaattaatttcgcgcaggcatcctcttcctcgaacttgctgtccagcttggccgttaagacaataatgaatttacgggagcggatgtctttgtcgacttcaattcggatattgcgggagaagccgagaatgatatttttcggatgtgtgagaatgatatcagaagcgtcatattgcgcgtctccctcaccgactgtgtacggctgaatattggatacccctttgaccggtacgccgaatgctgttgacaagccgccctgaacagcttggtccccaaggtttgtctggcggtctgccacgcggtccttccattcaacttctaagccgtgagacgtatagaatctgaattcctgagggatgcgcaaatatttcggcggaactgcctttaagcccttcttgaatgtcgctctggacagttcttcaccgttcatgtcaacgatatgggaaaccgcctgtttacggatgccgtccagctgtgccagatacggatcagctgatgctgtatcgccgttaacgatcagctcttcaatatcaactgctgcgcgctctgctaaaatttgcatgattgtctgctgcaggccgtctttttcaatattgttttcaagtgtgtcatacgtaatgttgatttccgcaatgacttccttcgtgttcagctggacagtgcttgtcgttggaactgtcagctcgtcgtttgacagtgcttttccttcttgcgcagcccgcagaatacgctggccgaagccgattttttcaaatttttgcgaatcgttttccatttgaatcacgcgggattcactgaaaatggtcggcgtgttttgcaccatgcggataaaagccgatgcttgcgcagggttcataagcccgccgctttttaaagcagaaagcgacatttccgctttccgaatgatctcttgatttctcaattgatttcctcctccttgactggttttacagcagtccgctccagattgattttttgacttgctctgtattgccgcccgtatcgtccgctgtctgcttagacgcgcctcgcgctttttccaaagcctcgatgcgttcgatcagcggggcaagcatgtcttcaacgagctttttcagacgctcgtcatcacccgtctgctccggcttttcctccgtgtctgtgtttttttcaatccgctcaagccgtttgagcagagggtaaagcgcatgctcgaatgattctttcatgtcttcttttctcatttcttcagtctccttccctgttttgtcagcaagcatttgcttgaatacactaaagaaccctgctttttcgaccggttcttcttcatacacatctgcagtgccagccatgctgtagccggtgataattccagccttaatctgttcccacacctcgtcagacgctcttgtcacgagtacccatgagccctttgtaatccgctttgatccgatcataaaatcatcgggcgccacataggactcgaccacgacgccggttccgccctcaaagctgtgattgatatcaatctcccgtgcctccgcgagaaaaccgtgcgccgctttttcaatttcctcggcggtcataaaatcgccgtgggcatcaggaacatcaggctcatacacgattccgtacacgagcttttgttcatcctgctcactttttgtaaacagccgaacctttttttcaaatgacggaggttcggctgacttcgtaaagaaaaattctgtctggttagccgccttgtccacataactgacaaagctgattttggcatttcttaattctcgcgccacctgcttgattcacctcccttcaggacgttttgatatcttcgatgctttctttcagctcctgcatgagcgcagccaggtttgtcttttccgcatcctgtcctgcaggccgtttataaatgtcctccggccactcctcaagtgttttgccaagcacccgtccggcaaggtcgcgtaaatcattcggcgagactgctccggctgtaataaaaggaccgagcaccttcgcaatctcaagcggatcacgaaagtccggtccttttaatgtcagcctgacgtcatggatattcagctccggcaaaagcagcgtgttcagtttattcacgagagtttttcgctccggctgaaaaacctgctcctccgtaatttttctagcagtatccgctgtcgcccggttgtattcctgggcctcgcctgtatacagcggggggagacggaacgcggaacgcagcttatttctgcttttttcatcgtattcaagaaacaaggcgtcgttttggagaatttcagccaaagatttgatttccacggaaaccggcgtaatatcctcgcctccgtggagatccttttcttttgcgattccttccgcttcgatcaggagaaatttatgggcgttctccacgccttcaagatcattcatgtattcctgcagctcccggtaagaagcttcagacagcatcccgttttccactgtaatcgcagcggggacgtgacgcccctgcttaaaatacataaaattgagctcttctgcttttcgggccccgtataaattgacaatattgccgatccagcggggtacaccgtatacgccgcttccgattttgaggtgaatggcttcatttgcttgatacttctctgccaatgtgtttacatattcacctgtgcgaatatccatttttcgcggatcgccgtattctttaaaaaatactttctttccattgatcatctgcacatattttcggaagcgtttttgccttttgatccttttcattttcccgttttcttcatatacaaatgaaacctctacaggctcgcctgctccgcatacacgcatatatttcacatctaaatattcgatgccggcaggttttcccgccccgtcgcgaagcacttccataaatccgttgcctgttttttctctgtcttcgatggcatagcctaaaatcatttcagctgattcatcaaagtgaagacatttataaaaggcttcgagtctggcccagtctttttccgctcttttcttttttgcctgatcgacatcacttgcgttgacatcaaatgtgtactcaacatcgaatccaaagcctgtaatattcactctgtacgcatcaatgcattgctgaagaatggtcgagtattcggcaatggttttgagctcgatgatattatagggcggagcaataatgtcctctccgtacagctcagaaaagtcatcttcatagatttgctttgtctgaggagccgcggcattggctttaaatacagttgctctgactgtttggttgtgcatgatttatgacctcctcctttctcggttcggccgcattcgtttgtgtgctgtctctttcatatcagcaacctcataatcatcaagcgcataccaaatggcagaaagcgtatgcgggtcaatcgtgaattcatcctcaatcagagctccgtttttatctttggcatacgtaagtgtctcgagctcatagatgacattttcacagcggtccgaacagaagatttttttgaaccgttttacctttttggtatattgaagcctggagccgggaaactttctggctccaaccatccgaaagccctgctggcggaaatattgaatgcttttcggctcagccgagtcggctttgatcaattcctgtgtctcaataaactcacgcagctcctcagccgtcctatcatctgtcattttattttgataatactcccaataaatgtagaggtattttttttcaggatctacagcaagccggacgacggcattataggattcctcgaatccaaaatccatacctgtacgaaagattggtttgctgatggctgcgatacattttttcacttgatcatgcgggagtacctcgaactgcggcagcaccctgatcccgttgacgccgaatcgtccttttcgggcaatccggtacaggtcgggatcatactctttgagtccgtcaagctgtttcacatagctttccgggagaaaaagattgtcgttagcggtggaatgatggtaatacgtatctccctttacaatcgtccgcttttcgtaaagttcgctgtcatccagcacaaaccgtttcttgcgttcatcccgaaaaaaatgcctatacgtccaattggaggtgccgacgggattggtggtacagatcatatgaagctttagctcaggatggcgaagacgtccgattaactccttgaacccctcatacttcacctctgagcactcttcaatccatattaatgaaatgttatgaaccgattttaattttgccggattgtccattcctttgaacatgatccggctgccattgtgaaatcgcagctgcagcggggaagaaagagatgccacggcctttgtgagaccgagctcttcgatcacctcttgaaacaaggcgaaggtcgaatcccgatgggtatcgaacacctcccggatcacaagggccgtccgtttttccttcagcagctttagcacgattttcaatgcggtatgatagcttttggatgagccgtagccgccgacaagaaactggtacgtctgctcccaattgaacacgtaatcttcgaaatgagggttgatttcttttacaatcatgacttgcgctcttttcgtttgatcataatttcaatcggctcctggctgtcatctgttttctccgctttttgtttggcaagcttcaatttctcattttcaattttttgtttaaattgatctggaaacaaatcaaaatataaggatagcttctcaagcgccttcattttatctgcaagcttgatggcaatgccttctttcccaagctttgcttccgttacaatggtgccatcaacgagcccggagtctttgacatcgacaaagctgatttccttcataatcggattatcatcttcatcaaacagcggacccgatttcccgacagcctggacctctttttttccaaaggtcacatagtccgtaatatccgcaaacgcgatcttgatataaacctgcagcacatccatcgcttcaataaacatttcattgaccatttcttttttaatgcgtctaatttcagcagcgaccttttcgttttttaagagtcggctgcccgtcacatgagcgctgtccggagaatagcccgctttgattgctgactgtgtggcattgaagcttttgacgtaatacaggcaaaacagccgctggcgttcatttaattcatcgttgtttatagggcgctgtttttgttcgtttttggacgcagaaaacagcgcctctttccatttgtcttgttttttccagatgccgattgttttcgcggaaacaccgattgtgtccgcaatcgcccgatttgtgatctttccttgatgttgttgatagattgctaatgcttgttcgcgctgttgtgttttcatgctactgcatcaccgccacctccagcatggttgtttattcataaaagcggctgatcagccagccgcttagtgtcatgctctattcacttataggtggcaaacgtatgacaagctttcaggcaagtgatcgattcatttcttcctgctgtctttgcatctttaaactcgcccgtttaatcgtcgtttgcactgtcgatttttttacgccgagaagatcggcgatccgttcataagaaaaacattctaccttatgcagcaaaaacatttccttttctctgtccgttaacagggctaatgcttctcgaattctatctctgtcttcttctgatacctgtccgtccggctcaaacatcatagcgctggaaaatgattcgatgattctcgggtccttgatcatcagccgctggtaaacatcacgccggtcaatcgcccgtctgatgccgggctgccttcctttttcaagccattctgttacatattcaagatcagtaatcatatttctgatgatttttttatccttcagctcttcagctgagagcacggattcatctgcctcagcgagcggtttatattgtattcttgtttgtttgagcgtgcgtttatattcaaatagtaagtcttgcattctatgatcctcctcatttttggcaaataaaaaacggacaccaatcaacgcacaaatgctgtgcagttgatcagtgtccgcaggctttccgtcttggacgtattctgttttcgctttaatttaatttgtagccgatttcaaattccacacgagcaagatcgccctttcttgtttcgacgagcgtttttccatgctctggcgcttctgtgatccatgcttcttgcttgatgccgtccacaataatgacacggattttcccgtcctccagctggctcttaagcgtgacggaatcgatatgcagcagttttttcggatgaatcatgttttatttcctccccttttcggtgcagcgcttgcttcagctttttctaatagctgaatgatacgctcctttgaatgaatagaattccctttcagaaaatcaagtgctgctttagacgcttccagcaattcaggcgcagcggccatcaaagaggcattgcttttttgcgaataagagctgaggtcaaatacagctgcaatcagccgcccgtttgagtacggaaatctttctttttcttcttcactgtaagctgaataaatatagatcggtttcgtatccccgcacgggacagcacgccacggcgcagggcttttctctgcctgttttgtctttgccaacactttcacttcccgtcgtccttataccattgttcaatgtttttttctgttcgctttgcccgaaacagcaaagcgattagagcagtcagctgtttaatcatagatattcagcctcgcttttcccgctgtcagcatttgctccagcttttgaatgacaggcgttaagtcagtgccggaccggcagttcggacatggatgaaaaacaactccaataccggtatgttccacaatgactttctttgtttgacaaagcttacacattatctgacgccctccaatctatggttaagctcgtaggctgctcctttgataatcactaaatagtcactgcacatctcatagattctcgtgccgagcgcttcatcgacccgtacaagtccttcaattgtcagctcgctcgaaagcaaaatcggtttatgatttaagtagcgatagttgagtaccgaatacatttgctctaattgccaatctgtagcgcggggtttgccgttaaccggtttaaacagatcatcaatgaacagcacatccgcctgcttcatccggttcagcttcgcttctaatagggcaaaatcatttttcagatcagtaaagccttccacgaacggaaaataaatgacaggcacatagcatgttctcattaattcgttggctgcggcggtcaaaaggtgtgttttccctgatccgggctgtcctaaaagggcaatgctgttttttcggcaatccttgatttgttcataatcggcaacatactcttttgtacactcaaatgcgtcttttatggcctgcggctttccctccgtgcggaattccttgaagccgagctgtctgaaagcgtgggtaatctcacttgcacccagcagccgcttcacttttcgttctgccatgcagctgcacatcgtccagacttccaggccattctgcctgacgagataacctccctgatccttgcagcgcaggcaatcatacctgcttgcgtctgattcggccggtttgtccgccagtaatggacgtctccctcttctcagctcgtccaaaatctgttcgattgttcgttttgtcatgttttttcatcctctcatgctgaattgcggcattctttttggcttgctgcgcgaaaaatcgatcttcaatgaatttcgagcagtagcgaaaagccttgattgtttcagaagcggcggtccgccggttttcaaaagcctgaaagcattcttcaagccatttgattgtttgcgtgacaggaacgccgatggcaacaatgcgggcgatggcttgataatctcttgaggaaggatacacggtgcgtccttcttgagccgaccgtaattgtgtaaaccgcttcgcaatgtgatccactgcatcatcagcagcagtatatttgtttgttttatctatatctgtacggtcgtttgtgtccggtgtctgcggcgaaaatggccgttcttttagactcccgtgtacagtattgtccgatctgaagctgaatttttttgaatgcttgaccgaaatcatcagtccgtatggcgcacggacggcctttatgtaatcatggttttcgagaagctccagccatcttctgacggttttttcacttacgccgaagactgccgccatttctctcgcttttaacggcttatggccgagtacgatgccccagcttacgccgtctttttcgatttcttttgttgttgagctgataaaccagagaaacagccataacgccgggccaattttgtcataatgttctgaattcaacaaccctgaatacgtcggaaaaggatagcttttatcgtttttcattgtacgccgcttctccttttaacatcatgtatgcttgaaactgttcctgcgtttcaaagtgaaacaccggaaggccgcatgcggtaaacgaaatggtgccgccggattgtccgagatggcgctgatctatgggattttcactaaaaacgatttggatcggatacatgtgatcactctcctgatcttttttgatacattttgtatcggatgttaccaagtataaacgatacattctgtatcatcaagttatttttgatactttttttatcataactttattttgatacattttgtatctataatcataagtaacgtagggagtttaaaaaagagaggtcatagtatgataggcggcagattgaagagtctcagagggaaaaggacacaggaagaaatcgcatcacacatcggtgtgtcacgggcacgatattcccactatgaaaacgggcgaagcgaacccgattacgacacactccaaaagctggctgattactttcaagtaacgactgattacttattaacggggaaagacaaaaaatccgatgacgatatgttctcagatccggacctgcagcttgcataccgcgatatgcaggatttttccccagaaagcaaacagcaggccatcgaatttatcaactatttaaaagaaaaagagaaaaaaccgcaaaccgaaaaataaataaatcgttctctgttctctaaaacatataaaaagtagaccgatataaagaaaaaagtgtttattttttaaagaaaagggaaagatttctacactaccttccagtcctatacgggcttttctttctcgctaaaaacagaacaaacgttcgaaagggagtattcaattgggcgattacttatcacatctggaggaatacgttaaaaatttatacggccggctgggcatcacatcccctcatcacattgacatgctgaaaatcgcaaaggatctggatatttgggtgcattttgaggatatggggagcatgatggtgaaatacgacggcatgtacagtatcgtattgaaccaaaaaaagtcacgggaagagcaatgggaggattttggccatgagctgtgccacgtgttaaagcatgcaggcaatcattttcagatgaacaagctcttcagagagcttcaggaattccaggcaaatcaatttatgtaccacttctgtgtgccaacctttatgctgttgcagatggaactgccgcaatggagaagccaggcactcgccacaattgcggcggtattccgggtaacaaaggaatttgctgataaaaggcttgacatgtttgaacggcgtaaagcaggtattcaatttcagaagcggctcgcttatttattatctcacaagcggccaaatgcgtacgaggaaggcgatcagcagcacttgcaggtcgctgaggaaaaagcgttatatcatattggtaaaaacatctgatcaaatacgggctgaggatatattcctcagcccagaagagaacctaacatttcgacattgggggaactgtattatgcagccacatgggcgccggtttaagatgaggcgcagatgcgaacgcaatcggagccgggatatacctgaattcaccccggccgtcaaaggcttccccatgtgcccatcttccttgtgagctttcatctcccctggaaaagttaaacaggtcataggagacttcctgcttttcgagctcacgcggaaacgtcgtcgggacgacaatatcccgttctctttcctccagctctttaatggccgcgtaccacatattttgatgataggtatcccttgcaatcaaaaatgacagcatatctcttacccctggatcatcggtcatggcataaagccgtgtcacctgaaggcgtccttgggcctccgcatttaagttagcgcgaaaatcggccagcaggtttccgcttgagataatgtattttgcattccacggatagccctcactatctgatgccatcgcccccaatccggacacaatcgcgtgctgagggttcatccctgacatgactgctgcaatagcgggattgcttttataagcatcctcctgtacatccgcgggtgcattgtccagaagcctggaaatcatcgttgccagcatttctacgtgcccaatctcttcggtccccacatcatataacaaatctttatacttagcatccgccctgcagttaaacccttgaaacaaatactgcatcatgacgctaatttcaccgaattggccgccgagcacctcttgaagttttttcgcataaaccggatcgggatgagctggctttgcttgatattgaagctcttttatatgataaaacatgaatcattcctccccacactttcgcacaaccccagcgtatgaaggaataggccaaccgtgcaggtcccgtctagttttatgtataaaagccaagcttgacggcttccacatatcgatcaaacaaatcgttttgtatgtagcttttatcacggcacccaaaattgcggaatagcgcatttcgctgtgccgtgcttacctccaattgcagtcccatttctcttttcgtccgattgacaatattgtttgggtgtacacctgccaggcggtctttctcattagtgagctcggcgctaaaacccgcttcattcagacgctcacaaatgagcttggcttttttacgatccgccccgccgaccaatgtatgcgggattttcggatcataatacccgtgaaacgctaatgcgtaatggtggtcattcactttttctaaagccagcggctcatcaaaacgaatgctagtgagatgcaaggaacggttgtttcgctgctttagaccctcaaacaaatagatggaacatcgatccgaaaatgcccgcaccagttcactgacgccaggctcaattctgccgccgtgaggaccgaggacgataagctcacttccgtttttctcctcataaataatccggtactccgactcagaagcagaaagggccgcaaagctgtcatacatatcttccatcttgaacgcccccctttaccagtcagcaccagtttactctactcatctatgaatgaaaaccttttttatagtatgatttgatagaatacgcagaggaggtatatgatggggtttattgatggattactcggcaatgcatcaacactgtcaacggcagctgtgcaagaagagcttgcccatattttacttgagggtgagaaggttgaagccgcgtttaagctggttcgcgatttgattgtctttactgacaagcggcttatccttgtagataaacagggaattacaggcaagaaaacggaatttcaatcgattccgtacaaaagcatttccagattcagcgtggaaactgccggccgctttgaccttgattcagagctgaaaatttggatctccggcgcggaacttcccgctgtctcaaagcagtttaaaaaagatgaaagcatttatgatattcaaaaggtgcttgccgcagtttgtatgtaaggcgaaaagacggaagcttcacagcttccgtcttttcatttacagcttttcctccatcttcgctttcgttttcggaccgtaaatcccatcagccgttaaaccgctgacagactgaaaacgtttcactgcattagctgttttcgggccataaacgccgtcaacgccgtgatttttcgctcctttatcaggataaaaataaagagcggctaaagcagtctgcacctgctttacttttgtcccttgcgtcagcgggcttgtcactttgatcacgccggatgggagcggatatgaggatgcggcatggcttttagaagcagatgccgtctgaggcagtttgatcacctgtccgattttgatgtggttcgggtcagtgatatgatttatgctttgcagcgttttcacactggccccgtgtgatgcggcaatccctgacagtgtgtcacctttttttacatgatattcagacgccgaagaagagactgcagcttttttcgctgatacgcccccgtttaattccttttcaatcgccgccttcacttgatcccagcgcccctctgataaaatgcggtgcgggcaatactttccgctccagtcctgatgctttctcacccgatcgatgccccagccgcgctccttcaacagctgtgcaacaaatgaaatcgccaaggcttcagctgcctcatacttcgggcctcccgatttgctgtagcaaatctcaacaccgattgatttgcggtttcccggaccgtttgtgccgtcaccagtgtgccaagcgtttcggttaagcggcagaccttgaatcacctcttgatcatcgaccgcaaaatgaaagcttgtcgagcttgtgttcccgatcatatagctgatttcattggccgctgatgcatcgtttgccgtgttgtgaatggtaatgtattcagcggacattgcattaggacacttcaacgcgtatttcgcctcagaaaccaaatttttctttactggaatgctcacctatcatctctccttttcttttttcataaataggtggcattcgtaggacgaaaagctcatatcatctatcaccgtaatatggataaatgtgttaaactgaagttcacggagggtctgaatatgtatacatatttaatgctgacaatgagaacggagaaatttaatcaggagcatgtggctgggcactatgaatttctggatcgtttacaggcagaaaaacgtttaaaaatgtttgggccattcagcgacgccacaggcggagcgtatgtcatcgaagcagattcactggaagaggcagcggaaatcggccatgcggatccgctggtggcaagtggatcttctgagctgacgataaaagaatggaagctgaagaaataaaaaagacccctaagggtctttttttatgcatcatgtttgattgcgtgccgcaatatgaaatgttttcccttctgtgtttgctgtttcacctgcatgaaccatcacctgagtaaagctgaacccgaccgcaacgagcaacaaacctgacatccatttagatttcatataaacaatctcctctctggatttgtttttgtgcgtgcaccattttctcataaaatgaaagtgctttttcgggctgtccgttttctatatagaattgggcagcatcatgcgccagctcttcaatataaggatacagcatatgttcttcaagaaattgaaaggtgtgtgagactgattctgtgtcaatgttttttccgtataacgcatgtaaaaattgaaaaagctccacaaataattcatcactgtattgacgggcgatttccaatccttcacgatactttttttgcgcttcggcgtcatttttttgtttatacagaacttgtgttaaagagtagatagaatgcggaagattatcgaacttttccgacttgcaaatagaaacagatttcccaaagtattcggctgccttttgcagttcacccattttctcatagcagtttccgagattatatagggcagaactgatcaggcggggattgccttctttctttgcaagatctaaagccagttctaagtggggcaatgctctttctggatactgcatatcatcataattacctgcaataacgaattcacattggattctgcggacggtgtacgtttcatacatttggtatgtttctaatgcctgaacggcgtagctcatcgaaacataggtttgttttaaattgtaaaaaatctcagccattttaaaagcaaactctgctttctcaatatcatccgagacgagggcaagattcttttctgcccgtttataatacatcatggcactgacaaacatcttctgcttaaattcatacattcctcgaaaaaaattaaagtaatattcgagaagccctgtcagcttgtactgattcccttcgatgtcttctaacaattctgaaaactctagctgcgacgtgtcctctccaaaaggcttaatgtaatccagcatgacacggtgcctgaactccattaaagaataatacagcagcaaatcttggtcttcttccatatcctcaatttctctttctacttcgagcttgacccgttcggcttcagcgacgtggaactgccggatatgagtataccattcattaattttaagcccgacataagaggacggaatcgtctgcttcatcctcaattaatccccccttttgaattacccgagatatgtcatattttatcatatttacaagaaaaagaagaacgcaaaataaccgcaattgtcgaatttcggctaaccgcaacaaaaaagcacgggtttttcaaacacccgtgctttcttttagtgaaaaccgactttgtttctttccatccagcttccccgctggctttttctttgctctcctgtcatgtctttcaccatggtttcaatatggtgattcccttcttggtgccattgaagggctgaagatacatataattctcccagctgtgcaaaggaaaagccttctgtaagttttgcggcgttttttatttctccttcactcaaaaagatgccaaagcctctcattttcatatattccagccgcagctcttcatccggaagcccgatttcataggcacggtcaaatcgtcctgcacgattcatcaaacctggatcgatctcttcgggatagtttgtcgtaccgatgagaaatagcccctcttttgatgtcgcgccgtccagcgtattgagaaaaaaggaccgcacatcttccggcatcgaatctatatcctcgatgaccagaactgcaggagcgaggcgtctcgctgcctgaaagacttcttctattgtctcgctcgacgtaaattcagtaatttgccaataagcaacaggtgcatcgatactgcctgcgatcgacttcactaacgtcgtctttccgtttccaggaggtccatataacagaatgccgcgcttgtaagggatgtcatatgtttgataaaacgatttatcactatgaaaaaactgatcaattgatctgtatatctcttttttcaatagcggattcatgatgacttgactccgctgaacctctctgacaatggcttcctgctctcttgaagtccctccatctccatccgtaaacacggtcactttccgcttgcttttttcccaaagacgcggtctgactccctccagaaatgcacgcatcttttcatcgttaaccgcaaacagacaatcaaaactcataatgctcccatcttgaaaatatggaattctggcaaaagcaactcccttttcaggatacgcgtatacactgtttcttatagacttatggacggtataatccggttctttctcatcttcatcgtaagcaaaggttttcttttcaagcttttcaaatatatatgccacatgctcaggctccaatgaaccgctgcggacatcttctacaagaagctcccagtattccgtatttggatcatcactggcatagagctcatagaatacaccgtattgatcataaagcgtttcttcaatccgtgtgataaggtaaccgaaagtgccgtagcccgccgcagctctttcattctctttttcttcgtactgataaatgaaaggtatgttagtcatgtttatactccatttcatgttttgtgaacgttatatatacgattgacatagcattttgtttcatcccacagcatattacttgtgaattcataaccgttgatataggatttcattgcaccatttatttttacatatggaggagatcataatgtgccaatccaatcaaattgtcagccattttttatcccatcgaaacgtgaccaatgagcttgccgaaaaaatcagcaaagaccattacagctacaaaccggcagaaacatcaatgtcagcagaagagctggtcaaacacattcttacgtctttccacttgttcgcaaatgtcattaaggaaggcaatgcctcaccatttcaaaacaagcaggaagaaacagaaacagatctcaatgttctggcaaaaacatatacagaaaaaacggtcgctatccttgaacagctgactgaagagcagctggacagagaaattgatctgacatccgctttcggcagaaaagtcacaggccgcgcgctgcttcagcttgcaatggagcatgaaattcaccataaaggcaacctgttcgtgtatgtgcgggaaatgggccacactgagcttcctttctatcagcagcgcatgtagcgtaaacaagaaaaaagatacctgttaagaggtatcttttttttgcgcctttagtacttctcgatttcgtccagacactcattatagggcaaatgaatagagatattgagcataccaaaatttcaagcaactaacgtgcaaaaattcaaaaaatttaattgattaacgcgtcctaatcatatataatctgataaaaatagtcgggttttcaggaggcctttatcatgagtgtaagcatcatattgatgggtttgtttgtcggagccttagtcggattgacgggagtgggtggagcggccttattaactccccttttaattgtgcttggaattaatccttccatcgcggtcggtacggatcttgtatataactcgatcacaaagctgtttggcgttgcctcccattggcggcagaaaacgattaactttaaattggtaaaatacttagccatcggcagtattccgagtgcttcgctagccattggcatattgcatttgttccccgcctttcaccagcatcaggaagaaattattaagcacgctctaggatatgtgttaacgctggttgccatttcaatcatcgttcgtttgtttttggatagaaaacttcgccccaaccgctggcagctgatgccgcttgaaaataagagggcgctgacaattcttattggtgttgtgtttgggtttatcgtcggattaacatcaatcgggtccggctcattatttgcaatcgccatgatttacttatttaacatgaaagcgtcacagattgtcggaaccgatatcgcgcatgcttttcttcttgttacggcagcaggcattttgaacgcaagcttcggaagcgtggattacatgctggcagctaatctgctcctcggttcaattcccggcgtactgatcgggagccatctttcgcctcgattctccccgcgtccactgcaatttattatggcttccattattttagtcagcggtttaaaattgatttaatgaagaaggctatccgcttgaaggatagccttttcttattataacgtcacacccgatttaaaaatggcgagttctttgaaatcatttttttcatggttcacaagctggccgcttgccacctcaatcatatagtggataaactcacgcagcacatattcctcatgaacatcatcctctgctaaaaggcctgcgttaaaatcaatccaatgcggcttcgcctcatacagctcggtgtttgtcgctactttcaccgtcgggacaaaggtgccaaacggcgtgcctcttcccgttgtaaagaggacaatttggcagccggcagccgccaatgcggaggaggcgatcaaatcattgcccggtgcgctcaaaagagtcagcccttttgtcttgagtacttcaccgtatttcaagacatccgtgacaggagaaatccccgctttttgcgtacagcccagcgatttatcctcaagtgtagaaatgccgcccgctttgttgcccggtgaaggattttcgtacaccggctgatcatgtttaataaagtattgtttgaaatcattgattaaatcgactatcttatgaaacacttcttcattggcagcccgctgcatcaggatggtttctgcgccgaacatttccggtacttccgtcagcacagtactccctccctgtgcaatgagataatctgaaaaacgtccaagcagcgggtttgcggttatgccggaaaaaccgtccgaacctccgcatttcagcccgatcttcagttcagacagcggaatgtcttctctcttatctcctttggccgcttcatgaatttccttcagcaaagcaacgcctgcctccatttcgtcggtcaccgactgggattccagaaacttcacccgcttcaagttcacatcttgcagtgcttccttcattcttgccagctcattgttttcacagccaagccctaacaccaagacgccgccggcatttggatggcgaatggcattcagcaggatctgcttcgtattttcatgatcgtcgccaagctgcgagcatccgtattgatgctttaacaccagtacgttatcaaatggagcgatatcccctgtttctctgacaaaacgctgcagcattttttctgctattccattgacacagccgacagttgggacaatccacaattcattccgtacacccgcatctccgttttctcttctaaaacctttaaacgtccggttctcattagaatacggattttcatcaaatctcggtgtatagctgtataattggatatcagacaggtttgttttcgtattatggacatgaatatgctctccgatcgagatatcttgtgatgcatgaccgattggaaacccgtacttgacgatgctgtcgttttctttgatagactgcaatgcaatcttatggcctctttttatatcatcctttacttcaatcgacacgccgtaagcatgcagcctctctcccttttgaatatcccgcagagcaagaaggacattatcttgcttatgaatctttataaacgacttcaacgtacctctcccccttgtatgcagtattgttcaagagccctctgcatgcccagctcatgaatatgattcaagtaaacagcgactctatcagtcagcttcggtatctcattgagatctgccccccacagccgctgttcgcctaacactcttgatgcaatccgaagcatgtcgccatcctcctgacaccaaacctctttgaaaaattgaagaactgccggatcatcctgcaatgtctcgttatcatgataaaaatacagaagagcgctgaaagaaaacaccaagcgttcaggaagctgtcccttttgttcagcatattccttaagagtcggcaggtttctcgttttgaatttggaaatggcgttcaatgcaatgctttccaggtaatgcttaatatacgggtttttaaaacggttcagcacatcgtcagcatactgagaaagaccttccatttttaaaacaggaagaatttcgtcatcaatcagctctcttataaatcgccccacttccggatgctcgactgcatccctaacagtcttcaagccgtataataaagccactggcgtcattgctgtatgagcgccatttaaaattcttacttttttagtccggtatggggtgaggtcgctgacgatctttgtatgcagccctgcagccgcaaagggaagttcttttccaatccaatcaggcccctcgataacccacaaataatattgctctcccacaactatcaaatcatcctgatagccaagatctgccgtgatctcatcaatgctgtcgacgggaaaacccggaacaatccggtctactaaactattacaaaatgtattggcctcatgaatccactgtgtaaatccttcctccagcttccacagatgtgcataatgaagaaccgtttccctcagcttttcaccgttattctcgatcagttcacatgggatcaggacacacccttttgtctgatctcctttaaaagcctgatagcgaaagtaaagaaatgcagttaatttcccagggaatgttttttgcggcctatcctctaaacgatctttttcatcacatacaatcccagcctcagtggtgttggagataataaaccgaagcctttcgcttgatgccaattctttgtatgcttcataatcagaaaacaggtcaattccccggctgattgagttgataatcatatgctcgtttaccgcttctccgtctttcattccttgtaaaaaaagtgtatataatccatcttgctcatttaatcgtttgattttttctgagcctcttggctggacaactgccacgctcccattaaaatcagtgtgttgattcaattgatcaatctgccaatcgataaatccccgaagaaagtttccttctccgaattggagaattttttctggatactgagtatagtgatcgtacacatttttattcagcttctgcacccttattgcctccctctcactttatgcacacgttaacatttttctgtataaagaatgcccgctgaaaaacgggacatcacgtcgtcaatcgtctgactgaatcacgcaccataaattctgtgttttccaagattttttctgcttttgtttcgggctcgctgatcagcgacaagagtttttgcgcaccgagcacgcttattttctccactgggcgctttactgttgaaagccttggcgtgatgtactgtgaaaacccaatatcatcaaacccgatcaccgaaatatcatcaggaacgcgcaggccctttgcgaatatcgcattcatcgctccgattgccatgtcatcattcgaacaaaaaacagcggttggaggattcggcagtgccagcagccgctccatcgcttgaaagccgctttccatatcgtactgtcctttgacactgtattcatgcttgatcggaatatgatgttgaatcagtgcggataagtacccttcctttcgctgctgggaggatttaaagccttcgatcccctcgatgatggcgatgtcttgatgtccggactgaatgaagtattctacagcttcttgagagccttccttgtcattggacaaaatattcgtgatggtacgatcatcaatatcacgattcagcacgacaagcggaatgtttttttcgcgaatatggtaaataaaagaattatcaatgtcactttggctcattaaaatgatgccgtcatatctcatcggtgtaacggagtcatagtttttcagatcatcaatgccgcgcacatacagattgtaatcctcacttatggcttgattgacgcctttgatagtgtctgcaaagaagctgtgtgaggttccgtttgtaatgcttgtaaagaatagcccgatcgtatgcgacttttgcatcgccagacttttcgcatttacatttggtgtatagttgagctgctctgctagctctaatatttttttcttcgtatgttctttgatgtaagggctgttgttgagtgctctggaaacagtagtgtgggatacgtttgcgagttttgcgatatcttttatggttaccatctaattcccttccttatcataccggctgcgattatttactgtatattgtatcatcaaacataccgcctctcccactatatttccagattaataagacacaggattctcagcttctgttcccgctggcttaccaatgattggacggacaaaacgaatcacagcaagtgaagcgaagacagccagcccaccggcaagcaaaaatgctccagaaaacgtgcctgtttggtcaacaataaatccggttaaagccgggccgataattcctgccgtgttggcgaggaaatgcatgaagccgccaacagaaccgacattgttttgatcaaccacatcttgaatgacagcccaatagatagcaccggtcaaataaagaaagaacactgacagagcgacaagagtgacagcccccgcagtcgttgccacaagcccggcaaaaccaatcaggacagctgatgaaaacaaacacgtgacaagcacaaccttgcgcgagaacagcacaccttttcgggccgtttttttgtacacatagtcagaaacaaatccccccgcagccagcccgataaatcctaaaatccacggtatgaccgtgatgacactcatcgattcaacacttaatccccgctcgtcgacaagatagctcggaaaccatgtcaaaaagaagaagaggatgtagttgtaagcgaaaaaagcgaacgccgtgaacaggactgttttttgcttcaggtaaaaggtgagcggaattttttctccgggagacgtttctgcttttattgccggtgcttccttgatcgtctcttgcggcttttctttgacaaacttgaaccagagcactgcccatatcaatccaataatcataatgagaacgaaggataccttccagctgaacgccactgcgatcatgccgactatcgggccggaaatggctcccccgaggggcgtgccgctgttggttacaccgataacggacgcccgctgggtcggcgggaaccagttgttcaccatcttgttgatggtcgccgaaagcgggccttctcccattccgaagagaatgcgtataatcagcaggctgacaaagccaaaagcgagggcgactgctccgctaaacagcgaccaaacaaccatcgcgacaaacaaggtcagctttgccccatagcggtcggatgccacgcccccaagaaaattaaaaatggcataacctatcgaaaaactgctgaaaatcaagcccatttgtgtggcagacaatgtgagatcatcctgaataaaaggagctgcaatggaaagcgccgagcgatccaggtaattaatcacccctgccaggaacaaaaaaaggataacgggaagcttatcttttgaaaacatctcaacctcacccctatgttggttcagtttctgttgcaccgctttcgttacacacctgaataagccataaatcctccatcgacaggaacggtgatcccagtgacaaaaccggaataggattcatccgccagccaaaggagcgtaccgagcaaatcctccggttttccgaagcgcttcatcggtgttcccgcaataattttgtgagatcggctggtgaacgttccgtcttggttgatcagcagatcatgattttgttttgtcagaaagaagcctggggcaatcgcattgacccgcagcccggtttcggcaaaatgaacagccatccacatcgtaaaattattgatggatgctttcgcagcactgtatgccggaaccttcgtcataggtgaataagcactcatggaagaaaggttgatgatcgcgggtgaatccgccttcagcagttctttaccaaacacttgcgaggccagaaacgcaccggtgaagttggtggagaatacagttagaaagcccctctcatccatatcaaaaaaggattggccttctcccgcttcttcatatgtctccacatcggttatcgcgtcaggatgattgccgccagccccgttaattaacagatcaacagcgccaaattggccaaggatgtcttcctttgcccgctccagtgacatcctgtccagcacatccgcagcaacagcgcacgctgtgccgccagccgccgttatctccttcacgaccgcttggcctttttcagccgtccgattcaaaatcgccaccttcatgccatgacgggctagctcccgggccatcgcagagcaaagcacgccgctgccgccagtgatgacagccgttttaccagccaggttctcatgcagcgggatcatatgcccacctctttttttgccattgcttcataagcgtcccacagcccgttcaaatacatgatgccaagtgcccgatcgtataagccatatcccgggcggcattgctcgccccaaagatggcgcccatgatccggtctgacatatccttcgtaatcctgcttatgcagttcttccatcacgccttgaatgttgatcgaaccatcctttgttaaatgagatgtttcaataaaatcgccattctcataaattttcacattgcgaatatgtgaaaatggagcgatgccggcatacgttttagcgatctccaccatgtcgttagcgggattggctcccattgaacctgtacaaagggtgatacaattagacggtgaatctgatatcgcccgcagtttcttatagcttgcctctcctgtgataatgcgcggcagtccgaaaatcggccacggcgggtcatccggatgaatggccatttgaacaccataggcctcagcaacaggaagaatttcctgcaaaaagaatgataaattgtcccatagcttttcttcatcgaccgttctgtaggcagcaaaaagctctttgatccgagccaatttttcgggctcccaccccggcagtgtcatgtcggatgcttcctccaccgtccgaatcagctcttgaggatcaaggctttccaccttggccttttcaaaaaacagagcggtcgatccatcttctagcggccggaacatgtccgtgcgtgtccaatcaaaaaccggcataaaattatagcagatcactttcacgccaaatccggcaaggttgcggatcgtttgcttgtagttttcaatataccggccgcgttcttcgttcccaagtttaatcgcttcgtgaacattcacgctttctacaacttcagcatgaaaaccataggattgaatatattcagtttcggctctgatttcttctttttcccacacgtcgccgacgggcttttgatggagagcccaaacgatgcctttgacaccgggaatttgcttcacgtattcaagtgtgactgtatcgttgcctcgtccataccatcggaatgtcatattcatgctcgcacctccggattcagtcatttaatcaaacgtgatgacggctttccgcacctgatctggatgctccttaataaactgaaatgcatgatgaacgtcatcaactgaaaatgtatgggtcaccagcccgttatgcattaaccggcctccattcaaaagctctaccacttttggaaactgattggtctgcaatcgggatccggttatcgtgacttcttttttgtaattggcagctgagaaatctgagccgctctttcatcaaatccaagcacaaccacatgtcccgccggtgacacagcctcaattgaaagtgcaaaagtctccggcaggcaaacagcatcaatgaccacgtttgctccttcattcccagtccattcaaggacccgctcggcaacatgttctgcttggacatttacaacagcatcggcgccgttttctttcgcaaatgccagccgctcgttgttcaagtcagtcatcatgacagcagcgcccgccagttttgccatttttaacacacagatcccgatgggccccgctccctggatcaggacggtatcacctttttccacctggcctctccacactgcctgggcgcctatcgtataaggctcggccatgactgcttcctcccaaggcaagtcctttgagaccgcgtgaagctgtctttccggaagcacaatatattcccgcatgcctccgtcctcatgtacgccaaatacagaaagcttggcgcaaacattcggccgccctttgcggcaggcatagcacgatccgcaataagaaatcggctcaatcaccacatgatcaccgggttttaggctctgtacattcgcaccaactgcctccacttgtcccgttacctcgtgtccgatgactctcgggagggtagcgagcggattcgttccatgataaatgtgcatgtctgaaccgcaaatgccgactcgcttgactttcacgagcacttcatcatcctttgaaagaactggcttcttcacctccgctgtcaccagatcatacgcttttcgcacttgaaccgctttcattttactcacctgctttttaagaattcatacacgctccgggcgatagaaattccgtttttcttatttctttcttcatgcagctgctcgatctcgccgggcacatacactctttcgaatccaacagccggcggtgattgctgcagttcatcaatcatggcatccatctgctctaaaaacgtatcccagtcagtaaaaaaggatggattgatcgcgcaaacgtaatgccccagctttcttttttgatcaaggccgttgtacattttggcaatatgagggccaaaagccgcgcccgccagcaatccggaaaacacatccactacaatcgatagtccatagcctttcgggcccccgaatgttgaaagtgagacgaccttgtcaggatcagttactgcttctccgttttcatcgactccccatccttcaggaatttctttgccctcttcacgggcctgcagaatcttcccaaaagccactttggatgtcgccatatctaggataaacggttttttatgcttagccggaactccgtaagcaatcggatttgtccctaaaataggagtcctccccccaaatgggacaacgatactgtctgtatgcgtcattgccattccgatcagcttttcgtcagccgctttttgcacaaaatagcttagcgctccgcaatggctgctgtttacggccgtgaccatgccgactccttttttcttcgccatgtcaattgcatggtccatcgccatgtcgcaattcacatgaccgaaaccatcgtctccgtcaagcaccccggtcacaggccccgtctctttaaaaacaggctgtgccccaggattgatccctcccgctaaaagcctgttcacatagtgttctgtgtgcagcacgccatgcgaatgtacattgcgcaaatcagcgtgcacgagaacatctgccactttttcagcatctcgttcattcaaaccggcaccgtccagcttttgccaaacgagttcctttgcttcttcagctgcaattgttatcgttttcaagcaagtgcctccttccttttcagttttttgggcactctccaagcgaaacccctacaaacacattttatttacaaattattttaaatattctttatattatattgtcagctcttttgatgaagatcctgaacgatctgagcatgctgctggtctgtgagtttataaagaaagccgataatgaacatcgctaatgccaaagcaatggccggatacagaagaagcagcgctttgatgccaatcagcgcctgtgctgtctggactgcattcggcacatagccgataatccccaaaccgatccccgagagaaagccagacaaagattgagcaagctttcttgagaaattgaaaagtgaatatgtcgttgcttccttccgttcaccggatttccattcgccatagtcgataatatcggagacaagagcccacgtgatgccatttgggatactgattccgataaaggcgatactggcgagaattgtaaacacataaacgttagatggaagcataaagttgatcagatccgcggccacactgatgccaaagccgatcattgccgttcgtttctttccaaacatcttgacgagctttggaaggaatacgacgcccaaaaaggaagaaccaataatgatgaagttcatataagccattaattcaacattgcccaagttatattgtgcgaaatagacgagcatggcggatttaatgttgtatgcggaaattgaaaaaatcgtcatcaggacaagggttaacagcggtttatttgtaataaatgttttgacgacagatgagagtgttaatttttctttgggtgcttccgatatgataatgcgctctttgcagttgcggtagcaaatataaaaccaaaacacaccgagcgcggcgaacaagcccatgaccaccgggtagccgaccttcggattatcaaacttgacgagcagcggcatcacggccacacttgtgataaacaaggcgccaagtgatccgatttggcggaacgtcgaaatggaggtccggtcctcagaattttgagtcatcgctgcccctaatgagccgtacggaatattcacaaacgaatagccgatgccccaaatcatataggatgcatatgcatatatcagttttccggtcgttgatacattgggagacagaaaaataagaacagtaagcaccgcaagcacgatgctgccgattaatagataaggcctgaatttcccccgtttgccgatgtttttgcgataatcgattgatgagccgacaattggatctgttatcgctgcaaacagcttactgactaaaaaaatgccgccggccatcgcagcggggattcccgctacatcagtgaaatacttcaataaataaatctggccgagatcaaacataaaaccgttgccaaaatcaccaaagccataggacattttctctttcaatgaaagccttttttccgtttcgaccgacacaaccttatttgccagttcagttcgcatgttccacctctgtgtcttaagaattttcggatagtgatccgctcagcgatactgagcggacactttgttacacgtttgctttctcttcttgaaattgaaagtagtgtttcgcattgtcatagcaaatcccctgaacgatgcttcccagaagctccatatcgcgcggcacttcgccgttttccacccattctccaatcaaattgcagacgatccgcctgaaatattcgtggcgcgtatacgaaagaaagcttctggaatcggtgagcatgccgataaaacggctgaaaaggccaacatttgataacgctttcatttggtcgagcattccgtctttagtatcgttaaaccaccaggctgtgccgaattgtatttttcccggggtaataccgtcctgaaaactgttgatcatgctggcgatgacatagttatcatttggattcagtgaatataaaatcgttttcggcagctggttcttcatctcaactgagttcagcagcttgtataaaggcttagcaatttcttcatcgttcattgaatcataccctgtatcaggtccgagccttttcatcatttttgtattcgtgtttcttaaagcgttgatatgaaactgcatcgcccaatcgagctccgcatacaaaccgcaaagaaactgaagcgtatatgtcttaaatttcttctcatcttcacaagaaacctctgttccttgtaatctgtcagaaaaaatccgtccagcttcttcttttgttgtttcggcaaataccattgtatctatcgcgtgatcagaaactctgccgccggctgagtggaagaatcgcactcgtttttccaacgcctttaaaaactcatcataggttgtaatcgatatggcagcggcatcttcaagcgcctgcacccactcaggaaagccttcacgattgatctcaagtcctttatccggccgaaatccaggcagcacactgacaggaaagtctttgtcttcttttaacaataaatggtattcaagagaatcaacagggtcatctgtggtgcacacgacctttacatttgatttcacgattaaatcccttgccccgaagccttcccctttgagcagtttatttgtctgtttccatatagccgacccggacttctcgtttaaaatctcgtaaatgccaaaaaaacgctgcaattctaagtgagtccagttgtagagcgggttgccaatcgccatcggcacggttttcgcccaagccataaatttctcctcatcaggcgcatctccggtaatgtatgtctcctcaattccattggctctcatgatgcgccatttataatggtcaccatacagccaggcttccgtgatgttttgaaatgtcttattttcatagatttctttcggacttaagtggcagtggtaatcaataattggcatgtctttcgcataattgtgatagaggctgacagcggtttcatttttcaataaaaagtttttgcccatgaagggttccatgtcctcaccgtctttcattctatttcaaaatgttaacgttaacattttgatttgtttttattttacctttatattcctttgggatcaatctcttttttgaaaatgaaatgttaacgctgtcataaacataaaaaaagacattgccagaaagcactcggaaaggaatgcttttggcaatgccagattcattaaaaggattagtaagccaggctgaaaagtcctttaatatgtgtcaaatatcgtacattacttgcttctttcatcaaggaagcaggaagacctttaagcggtgtagaattagcaccaatgatggcaaccgcgtctttgcgtccaaggcttgcaagtgtaccagagtttactggcttgaatgtttcaagcgttttgccttctaggtaagcgaataggttgtaaccgatcagctcacccatttgccatgcgatttgtgcagttggcgggtatggacggccgtctggaccgaagtaaactgcgctgtctccagcaacgaatacatcttcatgagatgtagattgcaggaagtcatttacagtcgcgcgtccgcggttcacttctaggcctgattcaccgactaatgggttaccttgtacgccgccagtccaaacaaatgtgttggcaacaactttagatccgtctttcagatcgattacgtttccttctacatttgtaacaggaagacctgttaagaactcaacgccgcgtttttcaaggcttgcagtcgcacgctcgataagatcatccggaagaacaggaaggatcttcggacctgcttcaacaagtttcaatttgatttctttatggtctacgccgtattttttcgcaaggttcggcatgatgtcagcaagctcaccaacaagctcaacacctgttaagccgcctccgccgataaggattgttgcatctgcttcgtttttcgttttagagtactcgcgcacacgatcttcaacatgttggaagactttgttcgcatcggcagcagatttcaataccatgctgttttcttcaagacctgggatgccgaagtaagccgttacagaaccaagacctacaacaagcgcatcgtaagttaatgtagaaccgtcagcaagcgcaacttcttttttatcaacagagaaagagcttacttccgcaattttaagatcaatgtctttgcctttgaaaagtttttctaatggcattgcaaccgctttttcagacacgttgcctgcagcaaggcggtgtaattccgtaatgatttggtgagttgggtatttgtttaccactgtcacgcgtgcttgttcttttgtgtaatgtttgcgaactgttagagcagaaagaactccgccataaccagcgcctagaatgacaatatgttttgacatcgtatatcctccgtcctttatatcaatttgaatctgagattatttttggttttcgcgttcgttcatgacttcaaggtagctgttagcaaaacggaacagcttttgagcttgaggatctttcagcatgcgaagaaggccgaaaagtccaattgtttcgttgcttgcttccgcgcggtcttttgcttcgatcgcagtcgcagctacttctttcgctgtttcttttacaggctcgagaatttcagtgatcgcaccgactgtgtcgctctttaacacttcgtcagtcgctacagactgagcgaaatcataagacttcgttaaaatattcactaactcagtcagcttcggaagctggtcaactaaaacagtcaatgattcttgaacttctggctttaatagctgatcaataagatcttgctggctttggctgacagacgcatttgtttgatcgattgtttctggcatatccaattctcctttactataagcagtttgctgatttttttggaaagggtagtgcctctccctgtctcacgcttttaaggcataagaataaggattgtgaattcatgcacaatcatttacaaaaataaatgtttactacccagtttttcatcttgccatattcagtattatttttatctaaaaataaacaattgaataagtcaaaatcctttactctctctgaaaatagcaaacacaaaaaactccaattcgattaccttctatatgataacactttttgaacaaaatttgaacgtgaattgcttcgattatgaaattaatttatatggagctcatgtcatatcgtttctgcggcactagttattgacaatccagcaatttctccccttcactttacccatatttccaatagaggctctctttttcctgtgatcggatcattcgccggcaacgccgcctgcttaatctgtttgaccgcttcctcccgctcattcggcttccccgtcttcatatcgtactgaacgccaccgggataggcgccaaggacagtaaaatcggggcttgagctgagctttttatgtccgactccggctggaatcacgactgcgtcgcctgatttgaaagggatggcagcccctttttctcccccaaactgaatcacagcctctctcctaagggcaatcaggacttcatgcgtattgctgtgataatgatggtatggaaaaacactccctgaccagctgtttgaccagccatgccgggtgacgatccgctctgccagtccggtgtccttaagcgcgttttgatacaccacgagcggaaaatcagggtgattcggaatcctgccgtcatccggaaagaagtatgtctgtgtctctctttccatcaatttcacctcccttttttgtcttccacatatagcggttcgccaaacatgatgtttttctcatgattccattgatctgcatgataccgaatagtatagtataaaaaaataatgccagaatgagggatatcatgaaagctatcgttatcggaatattggcttcactctttttcgccgttacctttatattaaacagagcgatggagttatcaggaggcagctggctttggagctcttcgctgcgctttatttttatggtgccatttttatgtttgattgtcatcatgagagggacattcacgcctctcttactagaaatgaggaaaaagccgttttattggatcaaatggagcttcgtcggtttcgtgcttttttacgcaccgattacatttgcggctgcatacggtccggggtggctcatagctggaacctggcaaattacaattgtagccggggtgctcttatctcctttgttttatgtcaaacaagatatgccgggcggtccgcagctcattcgccaaaagattcccctggtttcacttggcacttctgtgatcatcctgattggagcggctctgattcagcttcagcatgcagaatcgctttctgggaggatgctgcttttcagtgtgctgccggttgtcattgcggcttttgcctatccgttaggaaaccgaagaatgctcgaagaatacggaggccggcttgatacatttcagcgcgtgcttggaatgacattggcaagccttccattctggcttatattagcagcttacggctggtggtcagatggccttccaacagcaagtcaaaccgttcaatcctttatcgttgccgtcagctcaggcatcattgcgacggttttatttttctgggccactgatatggtaagagacaatccgcaaaaactcgcagctgttgaagccactcaatccggtgaagtgattttcgcgctgcttggtgaaattgttctgctgtcaggcgttttcccatctctattatcatttgccggtttgttcattataatagcggggatgatgttacataccttcgcttcacagccgagaaaaccgaaaaagaaagcacagtcaaatctgactgcgtagcatctgcaggagaatgggtgaaagcctgttctcctttatttgtgctaccaaaaggaatctgtttcacgttatagttaaatataatgtcagcctacttatattgaaaggtgattattgtaatggaagcaaacgatcaaacacaaaacataccagccatctccttcagatcagtcagaaaaagctataaacaagatggacaaacctatgatgtgctgcaggatgtcaccggagacattcaacagggtgcaatcgtagccgttttaggcccttccggctcaggcaaaagcaccctcctttctatgtgtaatttaatgagaacgcctgacagcggcgaagtcaacatatacggaaaggaagtcagagaatggaatgtcaatgagctgaggcgaacggcagccctcgcgtttcaatcggctcccgtgctcgacgggacagtgcgtgacaatttaagtcttgtacaaaggctgcatcaatcccagctgtactctcctgaaaagctggcttcgcttgcagggctgccgccagagttgttagacagaagcgccagagacttatcgggcgggcagcggcaaagactgtcactggccagaacgctctcaaatccttcctccattctattgttggacgaaatcacatcggccttggacccggtctctgctcttgagattgaagaactgatcaaacgtcagcatcaagagaaaaaatggacagtcatgtgggtcactcataatatggagcaggcaaaacgaatagccgataccatttggtttatggcagatggccggctgcttgaaatcgctgaaaccgacacatttttctccgctccgcagcatgaagcagcgaaagaatttttgaagggaggcactcggtaatggattacctttctctctctttaacgatgatctttgttttgatcgccttgtttttatcaaaatcctttaaagccggtgtagaaaaagacatgatcatcgccaccatccgggccgcggtgcagctgcttatcatcggttatgttttgtcgctgatttttcgcggagaccaccctgtttttatcctgctgatggtgctgttaatgctcgcggtggcggcgcaaaatgtcatcaagcgaaagaaaaatactatcggttcgttttggagggtgtttgccgcgttagcaatcgtagaaattgtgacgcagggaattctgctgtctcttcatatcattccgcttacggcacgatatgtcattccgatcagcgggatggtcatcggaaattcgatggtgctctcaagtttgtttctaaaccggcttaactcagaagtcggcgttcgcaaagaagaaattcaattaatattgtcacttggcggcacaccgaagcaatccatacagcgcattcttacctcagcgatgaaaatgagtatgatcccgacgctcgaaagccagaaaacactgggtcttgtccagcttcccggcatgatgactggccagattctagccggcgcggacccgattcaggcagtacgctttcaactcttaatcgtgtttacaacgatggcctcagccgcgctgacttgtgtaatcttaagcgtgctgacatacccatcattattcaccgttcatcagcagctgaagcaaaatgaatgacagacaaaagccgctttccgagggaaaagcggctttttgtacttgttattccttttcttcataatacttggccagctcaacaatcatcgcacccatccgctcaatctctggcgcaagcagtctcgtaatgccctcttcccgcagtgcttcagcagtcacttttccgacagcagctgcgatggcgcgttcttcgaataccttcttcacttcattgatataacctcgccccttggcaaaatcaaacagggaacgaacctgaatggccgttgtaaaacaaacggcatcgacctcatcgttcatcagctctcggcataaccgctccaccgtttcctcctccggcgggatgtgctgataaggcagaatcggcaggacagacgcgcctttttcttcaagaaatgccatgagagccggcgctttttcgccatgaagctgcaccatgactgtttttcctgaaaagtcgtgaggctccaaggaacggattaagcctcttgttgtcccgtcttcatccgaagcttccggtgtgattccaagctttttcagcgcagacagcgttttgtatccccggcatgccgctttcgcttggcgaatggcctgcagaaactcatctttcagtccaattttctctgccatatcgacaagagtctccaacccgatgcctgtcgtgaaaatgacccagtcagctttttcttccgcaaacgtccgcaaatccggctccacctgcttctctgctaagtaaactgtaccttggagaggccggatgacaggtattccgccctgtttttcaatgattgtactaatttcttccgtttttcgtgagccaccgattgccacgcgttttccaagtaacccttttcccatacccgtttcctctcctctttgcataggctttttatgtatataagcttaataaagctattttggcgcaaaccaagggagaaatcaagataaacccaacctcctaaaatccattgaatacgccggaagcttgctgtaagataaacagcagacacgtcttgtaacggaggatcgacatggaaaccaaaaaagaagaatatgaaacaaaaggctacgatacatcgattgtttacgaattcaatgaatatccggatgcccgcagcgggcgctgcgacaactgtgattacacactgttcaaaagctctgtaaaaggcggaaaatttcttagagaatgccggagatgcgggatgaaaaaaaatatttaaacagaaaaccgaaatcaaattgatttcggtttttatgtttttactgcgggacagcggattttttcataaacgcttcaatctcagctgccgcacgctccgctccgccagcttcttttacatccttttgcatattcttgacgcggctgagcagctcttgatcactggatacagcctgaaccgcttcctgcaggctggaaacagtcacttcctctttcggcaaataaacgccaaggcctaattcatcaacccgatttgcagtgagctcctgctcatacatttgcggaatgacgacaagcggcacacctgcgttcatcgcttccatcgtactgttcatcccgccatgagagatgaacaaatcagctttctctaacacctcaagctgcggcacactttggcgaatggtaaagttagcaggaatatcctccaagctttctggatcaatcgttttcccaaccgacatgatcacttgccatgaagaatcccgaaatgccttgatgcacatcttgtaaaattccggccatgcgttaaacgccgtacccaaagaaatcagcataagcgggcgatcatccttgtcaatcaacaggctttctttttccttccgttctccgagagaggggccgacaaaacagaaacggtcatcgaacgtctcatgctgaatctgaaaagacttcggcataaagacaatatttaatgcttccggcacagctaactgttcaaatgaaacagccggcaacttctcttgctccaagtaggctttaaattcagcctctgcttctcttatttttttcagcatgtcttcatttcctaactgaaaggattcattttgggcatatgacgaacagagcttaatgaccggaacattaagcttttcagcaaacaatttaccagccagcgcaacaaagtcatagatgatcagatcaggctgatcatccttatataactcctcaagctgcggcagaatgctgagtgattctttcaaaaggctgaggggcgcgtcattcttttccatcatctccctgatttgcttaggatcaatattcaaggatgtatgatagatcaatgcttctccaccggcttgctgaacagcgggcgcaaactcctcagtcgtcgcgtacgtgacacggtgccctttctcacaaagcttctctactaaagcaagcgtaggattgacatgtccgtacgccgggatattgatcatcgaaatatggtactttttcatgaatctccagtctccttatctattacattttcacacggaagctctttaatccgtatatcacactgttttcaatcggagtgatactgacgcactccatatgaggaaaagcagaaatcaaagacgttaacgcgatatttgcttcaagacgggcaagcggggccccaaggcaaaaatggatgccgtggccaaacgcaatatgcggattgggatggcggcggatatcaaacatgtgcggtctgtcaaactttgcttcatcacgatttgccgatgccacaaacgccaaaaccatatcaccttctttaatcaggtgccccccgatctccgtatcccgcttggcaatgcgcctcaaaaccggggccggcgctctgaaacgcaaggcttcctccactgcctgaggcatcagttcaggatggctgcgcagttcctcgtaaacgcctggcgtttctaatatgctgtacatcgcatttgaaatcaggtttgtagtggtttcatttccggccaccagcagcagcgtgcaaaacggaatcagctcttcaccggacagcttctcgcctgtttcttccgcttccactaaaatagaaataatatcctgttccggtttgtttcgcttttcttctatgatgccggcaaaaaacgcggccagttcttcctcacacttatctcgttcttccaaaaaggctttttcagcttcttcacttttatccttcggtgtactgaccagaagatcagaccatgctttaaactgttccatatgcgctgaaggcactcccagcagctcagatatcacaataaccggaagcgggtatgaaaaatcgtgaacaaggtcaaactcactgcgcccctgaaatttttgaatcagttcatctgtgatttcttgaattctcggttcccattgcttcatcacgcgcggagtaaaggctttgttcacgactgaacggatttttgtatgcttcggcgggtccatgttaatgatggaatttccaatagagcttgtctgctgcggcatgcaactggaaaacaactctttatccccaacaacttttttgacatcatcataaagaaaaacgctccacacttggttttcttcatcaaaggaaacaggcgcatcctttctcatcgattcataccatggaaacggatgatacgcatcctgtttgtttttcccattgagcagcgctcgctgcaaggcttgccggcggtttaacacattcatgtacggtcactccccttgaaagaattcagcaattaatgttccacttcacctcccgctttcgaaaaagagagggactaccacaaataattaaattgataacagcaggcaggcgatcacgatgttcgatgcaggcatcatatattccccctcgaatttcgttcatcttaccataatctttcaatttttttctattctgcactgctgttttggctcacaacgtgaccttaggcataagcacgcaaatccaatatggattcaattgcaccgctccgctcaaaaaacgtctctgttttcaaccaaatgcactaactccaaaaatgactttcccattatgtaaaataatttggttctatgattaaatagaaggtaaaaggtgaaggagagaacaacgtggcagcacagactgattacaaaaaacaagttgtcggaatcctactttcacttgcattcgtactctttgtgttctctttttctgagagacatgaaaaaccgcttgttgagggaaaaaaacaggaaaactggcatactgtcgtcgacaaagcctccgtcaaaatttatggcagccgattagttgaagaaaacaaattaaagcaaaaactcggccataaacaagccgattctattttgacccttctgaaactcgccaacgaaaaacacattacattataaaaaagaagagcccacaggctctttctttttagtcaaatatcgttttcttgtccggatggcgcaaaaagtcaaacagcatgctaagctgtgagggtgtgtttcgtttaggagaaagcggcgggagtctgtcttccggaaaaaaagcggcatgattcgtctcgatccctgtttccccctgcccgtccgtcatgctgcatgcgatgaagattttataatagtgataaggctgagggggatgagagtgtttatggctgtctagcacggccagcaatcgagacggctctgtatcgtaccccgactcttctttgatttccttgacaacgttttcagccggcgataaaccaatctcgcaaaatccgcccggcagcgaccacagctcatcatgcttctcccggacaagcaaaatctgattctctctgaatacagcgccgcgaacatccgctttcggtgttggatagcccttctcgccttgccataaatcagtgataacttcaatgtccttctccgagtaatccgccatcatttccgcgctaagcttcattagctcttcgtacctctccctgtcgtacacatccttggaaaaagcaagccccgcttgggcgatcgcccgaatccgctgtgcccgttccagccatttggtttgcacttttatcactcatcctttcaagtcaagtttcgctataaaaaatgcacgttttccacagatgaaaaacgtgcaactgtaaattagcatctaatctaacttcaccaagtaatcaatatcgtcctttactctctcttctgtattactgctatttgtatcagctaaaaacggattatataccagtgtgtaatgtttctgttctcctttagggatgacataactgagtacacctgtaacctttttccccgatactagtgttcctcccataaggattctgcccttctcttctatagaaaaaacaggccgcactgattgatcattcttatctcttaaatcaaacccgataaaattgtagcttattgaatcttcccctatattttccatcgtaacttctataataagccgttcctcatcatcttttattgtttttgtctcctcatttacagctccgccaacattcatatattcacctttttgcactctatcaactttattcactgtaaaattcgtatgtcctgctttaaatgtttctcctattttatgtatttgatcatcttttttggtcttcggctcaccgccttttttcaattccttatcaagttccttttcaagctcttcttgcgattttttctctttcggtttttccttctctgacgcatcgctcgattggctgcacgcagaaagcgctaacccgatcgtcaagacaaataatagtaataagacttttttcatgattgttcccccatctaaagtaatcgatttctattataatcagattttcccttttcttaacaggtaagaaagtaacgattatttctatctcattcatcacaatcttacttcttcctagtatttgaatattttttactagtccattagaccttttcatcaaaaaacccgagctggctgaagccgctcgggtgggaggtcaatctcgcttattcattcctcttttctctcggggttcctgatgatgtttttggtgttccggaggctgcgtcgtgcgttccagctcctttgtatcttgtcccattccttttaaaaaggaaaagagcagtgtaattgatttgttgatttccgggtcttttagcgagcggataatatcaaaataacctgtcttttcttcactgtttttctgctctacagcgcttgccacacccgcattcactttcaaaatgagaggctccagctgcttcacgtccagcatgccgagtgttccaaacagaagaagcagatttttcagcgtattggctgtttcctctgtatctgcctttttcaccaggatatcaagaactttatccccttgaccaaaaaggccgcggagcaacggcaggaccccgcgctcgttcatatggcccagcatatgcaatgtttcgagaatcgcttctttgtggtcaattagagcatcttcaatttcccgcaaatcacgctttcgctgatcctcttctgttacctcgattttttggattcgtttaatcgctttagccattatggcccatcccccttttcacagcgtcaccagggaaaatataatccttccgcgcccatttcttatgaacctgcacaccgatttgcggctgcggattgccgttgcggtggttgatcttaggcagcgggctgattccgtcgtgcttcaaaatttccatcttggccgatgtttctttgtaagcaggcgtatcggtatccttatcggcatggctgcctgttaacaggttgatcgccgcttcccctgaatcgttcattggcagatatacttccttccctttgactcgatcagtaatcaggcacttcactttgacatttccgaaaggcgatgtgagtctgacgagggttccgtcctgaatccctcgttctgccgcaagctcaggagaaatttctaagaacacttccggtgttttctccgaaatcccttttgatttgtaagtcaggttcccttcgtggaagtgctccaagagccgcccattgttgacatggatatcatattcctcaccgaattccttaggctctgtccactggacagggtagagaatggccttgccgtctgggaaagggaagcgctctgtaaagagtaaaggcgaatcctttccatcagcgtttacaggccattgcagggaattatagccctcaagacgttcataggtgacaccggcataaatcggcgacagcttggctgcttcctccataatgtctgcaggatgctcatagagccagccggcgccaagcttattggcaacctccataataatctgccaatccggctttgattcacccagcggttcaaatacctgatacaaacgctgaatccggcgttctgtgtttgtaaacgttccttctttttcaaggctcgggctcgcaggaagaaccacatcagcaaactccgctgtacgtgaaaggaaaatgtcctgcaccacaaagaaatcaagcttttcatatgcagcgtgtacatgattgatattggagtcgacaaggcccatttcttcaccttttacatacatcgctttcaactgtccggaatggattttttcaatcatttcgtggttggtcatacccggctccttcggcagcggcacaccccacacacgctcgtatttttggcggacttgttcgtccgtcactttttcatagcccggtagtctgtcaggcatactcccaaagtcacttgctccctgcacgttgttatggccgcgcaatgggtaagaacctgctcccggttttccgtagtttcctgtcacaagcagcagattagagatcgccgtgctcgtgtcgcttcctccaatatgctgtgtcacgcccatcgcccacaatgcgcacacactgtcagcttgcccgatcatctctgccatttggataagggtttcttgatcaatcccggttttctcctcagcatattcaagtgtgtacggcgcgaggctttttacatattcatcccgtccgttcactctttctctcaaaaatcgttcatcggccttgccgttttctattaaatatttggcgatcgcattcagccagacgatatccgatccggcacgcggctggacaaataaatctgagcgctctgccatttcgtgctttctgatatccgcgacgatcactttctgccctctcagcttatgagcccgtttaatccgagtggataagactggatgcgactcagacgtgttcgaaccgataatcaaaacaaggtccgcttgcgcgatatctgtaattgatcctgaatcaccgccatagccgactgtccggaacaggccggcagtcgcaggagattggcaatagcgagagcagttgtccacattatttgtgccaatgacccctctggccagcttttgcataagataggattcttcatttgtacatttagaagatgtaataaaagcgagagaatccgggccaaacgcctcttttaattcagtgaacttgctggcgatcagcaataacgcctcctcccactctgcttcacggaaatgatcgccttcacggatcagcggctttgtcaggcgttcttcgctgttaacgaaatcccagccgaacttgcctttcacacaagtagaaatgccgttggcaggcgcttcctcctgcggctctactttcagaatgtctctgccctttgtccagacatcaaagctgcagccgacgccgcaatacgtgcagacggttttcgtttttttgattcgttcatcacgcatggccgattccatatcagaaatcgcgagaatcgagccgtagcctgtctctacgcctttcgtgatctcgatcatcggtcgcagcgtttcgttattgatgcctgttaaatatccggcttccccttccattcctttttccatcatcgcgttgcacggacagaccgttgaacaatggccgcatgacacacatgacgactcattgatcggcacgtcgttatcccaaatgacgcgcgggcgtttccgctcccagtcaatggtcagcgtttcagttacctgaacgtcttggcatgcctcaacacagcgtccgcacaatatacattgatctggatcataccgataaaacggatgggattcatccttatggtatggcttgtgatcaaacggaatgctttggtgattgattttcatttccttcaccgtattatgtatttcgcatcccccattgttgtaatcgcaaactgtacaataaagctcatgattatataaaatcttgtccatcccgatgacctgcgcttttttcacgtcaggtgagagcgtatcaatgacatccccatcctttaattcagcggagcacgacctcttcagctcaccattgatgctgacgatgcacgtatcacatgtctcaatcggccctaagcttggatgatagcaaacttgcggcacttcaatcgagctgttattcaaaagctgcagcaccgtctgttcctcggacgcttccatttcaacgccgtttattgtgattgttttcttgccagccatctccattcccctttcttgctttatataccgaattacctatttcagttcccttacaacaactcaataaaacatacaaagcgcactcacatgtttcgttgcaaaaacacggggaaacggaatggtagatcaattaggagggattaacatgaaaaagacaatgtctgctataaccgcggcagcagcagtaacaagctgttttaccggctttggggctgcgtccttttcagcaccggcaaaggccgcagctcaaacaaacacactctcagaaaacacgaatcaatcagccgctgagcttgtcaaaaacctctataacaccgcctataaaggggaaatgcctcagcaggcgcaaggccttaccattaacaaaagcacaaaaggggatgtccacgctgcgtttggggaaccggaaagaccagtcgggggagacaatcgatttgatttatatcactggaatatgggacagccgggctacggattttcctatcataaagacatgacaatttcagaaatccgctactttggaaccggtgtggaacggcagctgaatttaggcggagttacgccggaagtgctgcagaagcaattaggaccagtaaatcgggtgttaaccgtcccgtttaccgatgaaatcgattatgtatatgatacaggccgctatgaactccattttgtaataggcacggatcagacagccgaccatgtaaacctaaaagcaaaataaacaccctacgcggctattcagccgcttttttagtggacaaataaaagctatattccttacaatacagggagatgaagcagagacggggtatcaattcgcaatgaagcgaaatcgttggatatatgcagttttcaccatactgatcattgggctggggcttggatccagagcattctccagtgttcttcctgataccctcaatacttatctgggagactcgttgtgggccgccatgatcttcacgggatgcggatttctatttcggaagctgaagacaatgataacgggcattatcagtctttctttctgttttgtcattgaattcagccagctctatcatgccgaatggatcgaccagattagagatacttctcttggcgggcttgtactagggtacggttttttatggagcgatatcgaagcatatacaatcggaattgccgcctgtgccgccatagaactgctggttttgggaatcaaaaagcgccgctgtatgtgacgcttttttcatgtagaaaacagaccgcattgagaaataatggtcttcgcatccaaacgtgtggcctcgcttatcgtgatatgatgttgattcataaatgactgaacggcatgatagccaactgcataacccgcaaaagccgataaacctgcaggcttaaagccttggtcgttagcaattggatcaccaaacatataacggctgacttccgaaaatcctttcacatccagcacctcattaatcacatcaatggaatattgcaagtcttcatgatcaaaacgagttacccaagggcccaatcgttccgtaccaaacagctctctggcgaatgattccgccaatccttcaatcacaagataatccccgacacttacagagccatgatgaaaatctatatacgaaaaccgcacattatgatgaaactcatgagcaataatggaaggaatccttggcaggttataactgttcggattaatccatacatgaataaagcccggtatcccgccaaacccgcagtagcctttttgcagctgaagcttatttggatcagcgatataaaggccgaatttgatctcctttgcattcacccgcagctgttcgcgctcagcaaaaaatatgcattgccgaagtgcagattcagctgtctctgaaacatgtgattctttcagtatttgtagtgctttctggccgctttcagcatcacggacatccaaatagcccagcattttcgcagccatgatcacatcatagccgtttggctccttcgctttcagcggaacttggatggcggtccacatcttttcaaacggcctcatcatcgtataccgaaatacatcttctcttttctgttcttccattgaaaacagcttttcgtattgctcaaaggtcttttccattactagattcatcctgattccctccttgtcaaaaacatacgatatgccgcagcgtaagggtcaacaagagaaattaagccatttttcactgtaaaatcatacaaacccgccgataggtaaggcataggaggtggaaccatggatattcctgctttatcggttgcgatgcatcaagcatcccttgcccagaatgtaaatattgctttaacgaaaaaaaggctggacaccgcccagcaaaatgccgatcaaaccttaaagatgattcaacatccaactctcggacaaaccattgatgtaaaagcataacctcataccagaggcggccaagaactccatcctcccggccgcctttattgttcacaaaaaagcatgcatgttttgattgttcctccatatgatttattgtttgccatattaaggaggtcataaattgaaaagactgtttatgaaggcttcattggtgttattcgcagtagtatttgtttttgccgtcaaaggtgcacccgccaaggcggaaacccatgcctacgatggaaaaagcccttattacaatgattgtgcgtccagcggctctacaaaaaaatcctcaaacttagtgaatgccagcaatcaagtcatcggagtagtcgagcttaaattcagcagtacatgtaaaacggcttgggcaaaaatcacgatgaataatacattgacgtctggctatgaagcaaatgcggagattacccggaacacagacggaaaaagatataattgtgattctgcaggcggcaatggaaaagcggtggccggccaaaagtcttgctatacaccgatggtatatgatttagatccaaggacttcttacgctttcggcaagtattcaggaccaaacttaaatgtttgggccaccacaggctcttattaaatagaaaaaaggctgtccgtacggacagccttttctaatttatttcgcttctctttgttttttaacctcttcaagctgagaaactgtcaccaattgatagccttgatcggtgagcttttttataatttcatcggccgcatcagcagaggtgcggtaaatatcgtgaatcaaaatggttcttccatctcccgcctgattcatgacacggtcaacaattgttttttgttacggtctttccaatcttccgggtcaacatcccataacgcaacatccattttcatttgactccgcagttcatcattaatgccgccgtatgggggtcttacaagcgtcggacgatatccgcttattttttcaatgatgtcttgcgtatcattgatctgctttaacgcttctttcactgaaagccttgtgagaagcggatggctccatgaatggttcccaacctcatttccttctttcagcattcttattagcgtttccggataatattgaactctgctccccaaaacaaaaaacgtggcatgacccttatatttcttcaaggagtctagaatctgatttgttgtcgcaggattcgggccgtcgtcgaaagtaagcgcaatgactttttgatttggatcaactgtttcctctttgggtaaagaaatcacttcatgcttcggcttttgttctttgattttatttttattttttgctttatcaatatattgttctttcagaatgtctttcaaaagacttttcttaatggcaatcgattgctctccaagatagcctgctgcaacctgatatgtgtcaaagtaaagttcgatataatcctccttgatggcaaagcggctgaaattttcttttttcggagccgtcccttcctttaacagtgcatcgtccgcggcaatgtccttattctttttcagctcgtgataagcgattaacgaaagcttatgtaagtagtcagcgtcctctttgaaaatatcatcaatggaaagaaacgcttgtttactaaaatcatagttaaacgtttttttcacggtttgcccgtgtgccccgccgatgtatttatattcattaaatacaatcgccactgtctgtttggcataatggacaattttataatcaacatttaattcgttgcgttttgtcgtatgctcttggtcaacgtcctttgtttccttttgaaattgacgaacctctttttctgcgaatctttttaatgccgaatccattttttcatttttgaaaacaggatagtttaccgcgtaattaaaagttttcccgtcattcacaagcgttgcgatctcaacattcccatattgagaatcagttcttactttattcatgaccgtttcttttttcaatgaatgattatggaaaaagccgataaggcccaccacacatacaactgctattaatacatgaaaccatttgattctttttgccaacaacaaaaactccttctttcgtagccatttcgatttactcttcatcagttggaactgtatctatttagaaatgtttttgtaacattgtagtaacatttatttcacatttgtaatactatgagatttagaagttcatgtcaatcctttttaaggaatttcatcataaaaaaaaccgaatttcatgaatgtacatacacccaacttaagcatcaggaatatggtaaaaggaataaaaaaagctagggaggttttcctcttggattaccctttgaatgaacagtcatttgaacaaattaccccttatgatgaaagacagccttattattatccgcgtccgagaccgccattttatccgccttattattatccaagaccgtattatccgttctacccgttttatccgcgcccgccttattactacccgcgcccgcgaccgccttactacccttggtacggttacggcggaggttatggcggaggatatgggggaggttacggttactagtcgccacatatcaaaatgggggcagtccagctccccatttttttgttttaaaaatgacaatatcatgacaaatatgggaaataattgtgattctgtccccctcttgttacgataacaaaagcatgcagttttgggggaggcgtctatttttggagaatacaagagattctgcagccatatctgaaacaaaatacataaaagcttcgaaccgggtaaccatttacgattttatcaaacttgcaaagccgggcattatcatatcaaactcgatagcagccttcggcgggttttggatcgcgtttgcaagcgcagaaaaaacgttaaccggcttggcttttttgatgacaatggtaacagcaatgttgggaaccgcgtttgtgatggcttccggcactgtctataacaactattttgatcggcatatggacgcaaaaatggcacgaactcgcagcagggcctcggtcacagggaaaatgccgccagccatgatcttaacatatggctctgttttaggaatcgcaggtcttgccatgctttattccctcaatccattaacggcctttctcggactggccgcctttattttttatgcgatcatctatacggtatgggtgaaacgaacgtctgtgtggagcacatttgtcgggagcttcccaggagctgcgccgccattgatggggtattgtgccgtaaccggtgacttcagtatgacagcagtgctgttgtacacgattatgtttctgtggcagccgccgcatttttgggcgattgggataagacgcaaagaggaatatcgcgctgctggcgttccgctcttgccagtagtcaaaggcaatcatgtaacaaaaataaaaatgatgcaatatattgccgtcctggtgccggtcacgctattatttcctttctctctcggcaccggccatataagcccattttatttcttagccgccttggttctcggaggcatatggatcaaaaaaagcatcaaaggattcaaaacagacgatgacgtgaagtgggcaaaggatatgtttgtctactcgcttatttatttttgcttgctgttcttcatcatgatgatcgattcatttatgatgtttctgatcagatgatgcaaaaagagccacacattaatgtgactcttttttgtttggaaaaacagcatctaatagaaatgtcatggcaaaaaacacaaccatgcaaatcaaaaatcgtataatctcactcaaaatccagctatcagctatgcgcataccatcggtttctcggagtgttgcgcatattgaaaaaatcatgagtatgttttttagggtttctttgttcataaaataccatcgctttctcgataggatgacttaaaggcaatgaaataagtcatcaagatataaaatgtgtcgcatcgttgcatgttttgattgaaagaaatcattgtttttttgccagccaattgtaaagctcaggcaaacagatgaaaaccgtttctgtgaaaaagcagatctaatcgaatgcttctatactctctccacaaataaaaaatgctaagaaatacatttgtttctctaatctataaacccgcactctttttccatcatcaggtattataagccaaaaacaaacaaaaaaatagacttgcgtttgagttgtatggaagtgaaattgcaagaataacccatacggtggtaatatattgtttgattttcccatattcatagatttggaggtcatacaaaagtgaagggaatatttttagttgttcagcttggattttctattatggtatttctgtttttagctgctgttaattggtatcaaggaagcgagcttgtttcagatcgatttgattggaactatactgctaaactctcaaaactgcttaatggaattgatgccgtcagcagccccaaacaaatttcacagcttgattttttcatctactccgctaaacactaccctgttatgagtgcgttaatgatcatctccttcttatatgttctggccgctctttttttacttatatactcagtcaaatgcaataagcaagagattcatttggactgctgacccggtaaaattcgtttttatagccccttaactcttcccagatgcatgcaggcatcaggcataaatggatttgtttagtgagtgaaatatactttccgaccttaacctaggttttcggaacttctcgctccattttacgtataccttaataggagggatcaaacgatgaaagaatatgaattcgtaagagttgagctgagtacgatgagaagaaggcctaaagaagactaccagcaaatcatccatgattatgcgaaaagaggctggagattcgttcagattttcgctcccagtatagatgggtatggggcagctgcttattttgaaatcatatttgaaagggatgcggaaaaagcttaatcgatatgactaagctttttcgttcccctatatctgcatctatacaatttctgcaaatgcggcatcacatgatctggctaaatcttgtggcgccaactttagctgcataccgattttccctgcactgacaataataaaatcaagcgtttctgcagatgcatcaatataggtcgggaacaattttttcatgccaattggcgagcagccgccgcgaagatagccagttaccgctaacagctccttcattgcaatcatttctattttcttttcccctgtcacctttgctgccttttttacatctaactcttctgcaacgggtacaacaaagacataataatgatttgttcctgctgctgcaaccaacgttttatatacatatttcaaagaataaccgattttttccgcaacagagatgccatctaccggctggccgtctgttttataccctaatacctcataagagatgttctgctgttctatcagacgaaccgcatttgtttttgccatttttttcgccattgttttcacccactatcaaaatgatgtatgtctaacttcttgcagtaatatgtaaattctatcatcctaacctgcattttcaaggttactagcattgaatcaacggaaggacaaattgatttccttggacgcctatagcccattattagtctacatggaacaaaacaggaatgaacaaataactcccacatacaatttgtatgaatggaaaataaaggagtggttgctttgtatcattacttttatggccctgcgttaattccttacttttcacatactcataaccctcaaagaagtccagacttttcagaaagacagcgaagaagagaaatcacattgactgtagatggctttgtccccccatcttccaccgaagatcttggagacggcttttattcttacgcatggacgaaccaacaggtcatcaatccaggtgaatacttagtttgtcatcttgaaggaagagatatcaacgtgataaatggtgggttcactccgcgcgatactgctccattgtatgcggtagcaagctttccaagacgaagaaaccaatgggtcattatcattcataatcctgtgcaaacccaaagagccatatcgctttatttgattgcgaaaaggtagcacaacatgttatcagaaaccctgcattcaggaacagaaaaacgggtagggacacattaacatcagcattttcctacccgtttttggtctgggcaaactctcacctgtcactctttcaatccccctcaattttttcatctttctctactgccaaggtaccagagaaaattgttatatgttatcattattcccagtaaaaagaaaagaggattaaatatatggttctccttgaaacgaatcgattacgattacaaacgattgatattccccttcttgacgccgcgtctaaacaagatcatcaggctatcaaagaattaggctatgaaacaaatggtgaatggccaaattctgatttttttgaagcgataccttatttccgcgagattttagtcaaaaacaatggaacaaaaggatttgattcatggattattgtaaagaaggacaattatgaaattgttgggggaactggatttttaggtgacccagacgaaaatggcatgattgaaatcggttttgcaacaaataaaagtcatcgccgcaaaggttattgtgtggaagccgcccaaaaactaataaactgggcattaagccgagaaacagtatcccggatcaccgcaagatgcgaacatgataatctaggctcacaaaaaaccttggagaagttagggtttatattgaatcataaatcagcggagtataaacattggatatatgttacaaagtagagtccttaattacaaaagcaggcactgcgcctgcttttgtttggattatttacctctgtgcttctttttcgctttttgctttttgagcatatacctttgctcttttacatgttctcgttgttctttcattatttgttttttcttttgctttcttgcttcaagctctagctttatcgcctcttgagctttagaagttactccggcgtttttcaactcttttgaaacctggcgctgcaatctttttggattgatctttttttgacgcctgccttgtaaacgcactccttcctgctcagcttgggccatcatattcaaaagttggttatgaacaaactctaatacttcagaatccctcggctctttgccaaaaagatgacgaaaggctcttagctttccattgtccacaacttcaacaacgcctacccaaaactgaccatcgtagtaaatcgttaatttcataacgattccctcctcataaaagatattaaagaatgatggacatcccgaggaggggaaggttactgacattctcaatcatgcatccggactaccaaccgaatcgtgttttttcattctttaccatatacagaaaagagtgtaacatttcttctccaactattaaactcttattttatttagatcattgctggagaataggcgtcttcactcgcaaatttatttctcaagccctgccatgttacagatgggagacgatacattctgcatatccttcgagtttaaattctccaagaccgtaaggcagcaacatatgatctccttttttgaaaggatagacatactcaccagagatcatacggccctccccttcaatcacactgataagaaggaatggtttttgctgctttaagcttgctgatcctgataagttccatttccccaccgaaaagtaagcgcattcaatcaatgtcgttgtaagcaaatcctcaatttgttcatggtgaactgtatgccgttctggaatagacgggacctctatcacttcaatgctctttttcagatgaagctcgcgcagcttgccttctgcatcttttcggtcataatcatataatctgtaggttgtgtctgagttctgctgcgtctccaaagcaagaattccttttccaatcgcatgaacagtaccgcttggcacatagaaaaaatcccccggctttacctttacacggcgcaagagctcatcccattctccacgctctatcatggtagttagttcttcctttgttgttgcattgtggccataaataatctcggcatctttttggcaatcaataatgtaccagcattctgtttttccaagctcaccgttttcatgtatgttggcatattcatcattcggatgcacctgaacagataagtcctggtcagcatctaatatttttgtaagcagagggaaacggtccccttcaagctgtccgaataaatgtctgtgatgttcccataattcgctgagcgtgaaccccttatacattccgttttgaacaacgctttgaccattttgatgcgcggcaaaagcccagcactcccctgttcgttgtgacggaatggtatagccaaaatcagctaaagcggtcccgccccaaattctttctttgaaaacaggcttgaaaaataacggttcagtcgtcatgaaaatcccccgctttattcgatttcttctagcagcttgtatgcttcttctgttgtttgcacggagagcagccgctccctataattgtcatccattagctttcgagatagcatctgcagtattttgagatgctggtttcccccgctctctttcggtacagcaatcataaagattaatttagcttctgatccatccaggctattccaatcaacgcctgatcgtttgatcccaaaggcaacactcggctccctgaccgcctcagactttccgtgcggaatcgcgatattcatgccaatcgccgttgttccctgttgttcacgattcaaaatggcttgtttaaacccgctctctgaaagcagcgcacctcttcgtgacaatttctgaatcaattcatctatgatgtcatcactcgtttcccccgataaatttggttcaattaattccgggctgataatgtctgtcagttttttaaattccgacatctcagctttttggctttgaattggctgctttatttcatttgctgccgcagcttcacttggcgcggaggtcggtgcagtttcactgagcacaggagacgccgtaatatccttttttagtacattgacgaacagagcagtgacaagagatcctgcaatcacagcaataaaaaacatcaagacatgatcaactgcgccaagcactgcaacgataggtccgccgtgcgccactctgtctcccacattgccaatcatggctatcacagaacctgtcattgagcctgccataatacttggaataacgcgcagagggtcctgcgccgcaaatggaatcgctccttcagtaatgccgaagagccccatcgtaaatgccgctttccccatttctctttgagatgcctcgaattttctttttcctaaaaacgtcgcaatgccaaggccaatcggggggatacaaatggcgacagcaattggtcccataatttcataatttccttctccaatcattgccgatccaaacagaaacgccaccttatttacgggaccgcccatatcaaatgagatcatcgcccctaaaatcaatgccagaaggatcgagctcgaccctttcatccccgccagccaaactgttaaagaggcgaaaatttgagctacaggcgcgccgatcaaaaacacaaacgctaaacctacaatcagtgatgcaaacaccggaataataataatcggcataatcggctggatggcttttggaacttttaattttttgatccaaagtgccgcgtatccggccaaaaacccggcaataatccccccgaggaatccggcgccgcttgcgctgtcataaaaacttccagtcgccgcaatataaccgccgatcatacctggcacaagccccggtttatcagcgatgctataggcgatatagccggctaaaatcggaatcataaatgaaaatgaagcactgccgatctgttcaatcgttttccagaaggaatcatccggaataactaagcctttaggtgttttctcccctccaagcgttaatgcaaccgctatcaataatccgccgacaacaatgaaaggaaccataaatgaaacgccgttcattaaatgacggtaaattggattttgtttcttctcctgatgattaccggattccgattttgtagcggaacgatagaccggtatatccccgttaagagctttttgaatcaattcttccggtttgcggataccgtcctgtacccccacagacagcagttttttgcctataaaccggtctttgtttaccgaacggtctgcagcaataatgattgcgtccgcttcgcgaatttcctcttcggttagcttattttcaacaccaatccctccctgggtctcaactttgatgctaacgcccagtctgtcagcagctttttgcagattttctgctgccatatacgtatgggcgattccattcggacaagatgtaatcgctaacagtttcataggaaacctcctttaaagtgtgaataataagatcttgtctcaactgtataccgaaatcagctcattaaaatcgctttttttaccataggttccggtaataaaggcatttttccctataacaaaaaagcaaggaataatccctgcttttaataatccaaatgagataaaaatgtcatgacattggtttctttcgtcagcttctggacgaaggccggctgctcgctaagatatgaaagctcgctaaacagctgctttgtcatagtttgatcctcgtgtttgacagccagcataaaaacgagcgaaactttttcatttccccattcaagcggctcctttaatgtggcaatcgcgattgctgattgtttaataaatttagcgtttgcatgaggaatggcaatgcctgacccaatatttgtagccgacattttttccctcatcaccgcatgaaccgcatagtccttatcaacatagcctttctcaaacaaagctgtcgccagctgttcgattaacttgtagcgatgctccgcctcctgctgcaaaaaaaccaaaaaggagtcgtattgttcagcatctgaaacgttttttgtttttggcggtgtgattcgcccagctgacgtataaacgcacttaatttcttctcttcgccaggctctaaaagcggagacacaacaatatggggaaccgttatattctccagcgcaatggtggatatgacaagatcaatatcctcatgctttttgatataatcctttaaatcggcctttgcaatacaagccattacagcgatttggtgatatttccgttcaatttttgtccgcagcaattgtgacatcccaatccccatgtggcagacgataaccgcctttttatgtgtctcgctgctgccctgcatccgttcgatcgctgcctgaaaatgcaatgtcaaatatgctgcctcttcctcaggaatatgaagatcaaaagtttgattgatgtcttccaaaacatcaatgatgaggtggaacaaataagggtacatctttttgatgtcattgagcataggatttgctacagaaagatcgtagctcagccgttgtagcacagtattgagatgaatgttcaaaccattgatcaaatcctgatccttgtgaaaatccatcattttcagctctgaaacacgattgattaaatgccctacaaccttaggaagcacagcattttcaaggttctcttctgtctgcaatggataacgaaccttaccgcccaatatatgtaatgttaagtacacggcttcttcttcagggaagcgaattgcaaaaaccggttcaagccgctgtaaacaagcaaatgtccattgatattctttcttcttttttactgccgccatttcttttggggacaatgaaatcggctgcttcattttgatgcggcggaccattaacaatgtatgcagcaacaaactttcaaacgtttcgtctgtgaaatagagggaatgctttttttgtagtgatttgatttctttcgtcacaaagtctacttcataatgtaaaaacttacttttaataaattggctggtaaacgctgtattgtgaatcaaatcagatattcttgccaatgcctttcttttatttctttcgttcccttcaacctttaatccaagccgctgcctagaaaccagtgtgagatcaaaacgcttcagccactcttctactgcgtataaatcctttttaatggaagatcgattgacaaaatgccgagcggcaatgtcttttgcggaaacaggcttcggattcattaataagtcataagcaatgtgcagcattctttccttatcgctccgctgcctagaagaaaaatgttcagtatgtaattgttggcttagccaggtcctttcctgttcttctatatgtaaataaacgcccaaccctggttttcgaataagctgtgcatgagaatgctcattgagataatcctcgatcactttcaaatcattccggattgttttttcagaacactgtaccctatctgcgaaatcttgcacaactaaatagtcatcaggttcagataacaacagatacaaaatctctttttgtcttgtatttatgtattccatctgtttttctatccttcctgtcagtatctacttgagcaaattgatagtataagtatactatataagaaaccgtttacattataaaacaaaatcatagagacaaaagtttcgttttttaccgaagcttccggaaaaaagcgatttttatactctttgagtttgctatgtaatgtatattcagcagaaattcataaaaatactccaattcttcacctatttagaacgaagattttctaatgtatgagtacgaaagtaagaacatgatgaagaaaagtgatttggtatcttcggggataaagtgcaggtaacaaaatttccacacgctcaacaaactaatacccatcaaatgtgtgctattaacattttaaggatggccattctctctcagcaattttccatcataaatacaaactctgtgcagggcacacaatattcttagctcaaatcaattgatcgttcacatattattaacatttatttacaaggaaaataattacttttattgaattgttatagtgcaagacaaaaaactttaaaggagtgtttcaaaatgaatttcaaaaaaacggttgtttctgctttatcgatttctgcgttagctctgtcggtcagcggggtagcttcagctcatgaaataaactccacacctactgaagtaaagaacatttctatttcacctacacatgttatcaagattcaagactataatttacctctaaaagttggagaaacctattctgttaaaaataattcagctactcgttattggactgataaccaaaaagttgctgaagtcgatcaaaatggtttagtgacggctaaatcaaaagggaaagccacgattactttgtttaaaggtactgcagtattcggaaaagtatatgtaacggtttattaatctttatccgccagattttctggatgcaaaacatgcatgaataaaataaggtccccctctaaaaagagaagggaccttattttcgcttcaagtttagatttagttttgggaatacatcatacattggtgtataccgtgtttcattagcttagccccgaataaatccaccttctgaatgaataatttgtccagttatccattcagcctcatcacttgcaagaaaggcaatcattcgtgctgcatcatctggtgtgccaatacgccccattggaaatttaggtgaaagaaaatttcttatttcatctgtcatccatgtagaatctgttggacctgggtttacggcgttaacagtgatgcccaatggtgcaagttcttgtgataacgacctagtaaatgcagaaatagctcctttagttgctgcatacgctaactccccaggcaaaggacctaaatcctgccctgatgtcatattgatgattcttcctgatattaaattagattttttaaaccgacgggcgaattcaacacaaagaagaaaattcgatctcatattaaccgcataatgctcatcaagtgatttagcatctaacgatacataattatcacttgcggaatgagctgcattattaataaggatggaaggatatcctaatttatctgaaattttttcatgtattgtgaatgcagcatgtgcatctgataaatcaattttcattgcctcacagcggacacccatacgtaaaatttcttgttgaaattcttctatccaggccgtatcagaattccagtgagtaaagaagatatgtataccctgtgaggctaacttacgacaaatagccgtaccaatatccccttgactgcttgctcctgtaattagtgcaattttttcttgagaatgactcattattttaacctccaatttataaggagtatctccattatgatggtaacaagctatccaaataatataatccattaaatcaaacagagctgactttgaatacattttaaaatcagcttaaaaaaacattttcgtctcaaaaaatattaaatagaaaaaataagagttggacaacaatttactacttagtcacaagtggctgatactaagtcattgaatgtctctttttaaagagcctttcaatcattcacattgcttttcattaaccattctacttccgttaattcttgtttttgaacgtctattgtgtgtttttttgtgaaatggattttcacagcttcttcgttttcccaaatctcccaaagcattattttacgttctgatggctcaagcggataagcatggaatgtaatacaaccctcttctttgttcgtttcttcctcaagttttttgaattccttcattatctcattaaggtctttatcactgatgatttttaaacatgccgttatgtaatgcatcgaaattccccctcccatcattttatggcttttcattataacattttcttgaaaaataaatataactgcgacattgattgctcgagttaatcaatcgctgtatgtaaaggatttaaaaattgaaatcaaataaaaaaccttcattttataggaaggtttagaagttatattatcaagtttgaaggcaatctgaagcaatgtgaaatgtgttaggtgtttgtttcactgtaaagtctgtagcgaaaccacgtactaaaactaatgacaagcccatcttcaatttcgctgacctcagatatgagggaccttttctttttcagctctttgatcatttcttccttatcagaaacgaacatgatcttttgcgcccgaagaatggccgcatattgaatctgtatctgatcccatatcatatcagctggcgaacgctcctgaatctcttccatgatttcaagcgtctcttctggcaagaatttagagaaaaagccgtgagtcacagcattttgattcttctgtggtgcgccgccattgttccctaatgcatttttgttgcccggttgcccgcctttttttgtgtgcacacttttttcaatgggtgcaccctttttcctttcccaaccatgccgctgcttccacgatttaatggtgttcactgacaccccgtatttctcggcaaggtccttgtatttcatgcctttgacgtaatccttatacgcctgaatgtgcttttcggccatctacattcaccgccgcccccttctgattcgtgttgttttggaaaagatattccctctaaaccaccaccgtgctcaagccgttaaccgccaattgtctatcctgagacttaccggaagcagtttacagggaacaaaaaaagcaccccgcaggatgctcttattatttaatccaatctttaatctctttaatggtcttataggccttagaccatgttccattctctttcaagtagttttcacctttctctgtcagttcaggtcctaatttgtataaatgaggtctatcatctgaataatggaccccaatgatatacccttcgcgttttaaaaagttcacagcatcatcaaattgatcttcagtaactccaatatcgttttctgacaaaggggtattaccttcaaaaatttcttttaagattgcataccttaatttatccttattcatattttctcctttcagtctttagatctgtctttcacttttctctctttgacttgttcaaatattttcataatagaaattgcttgatttctatgttttctttctactgcaattatccaaacaatagcagcaattgtaccagcagcaaaagataaagctccccaatgtttttcataaaaattaaagaacatggtgagatatgctgcaaataaagggataaaggctggaacatattttgaatgatcatggataatatctatatgagaaaatctcgatatagcaaattctaaacattcaatatccaacttataaagaagagattggaaccttttgtattcttccttatcatgaccaattcgagttttttcaagaaagaaagcaagtagctcctttttgtgataagtataaatcgcattttccagttcttctaagtcctcattattcttctcttcaatatttcgcttttcaatatttcgcttttcaatattcttctttttattatttttctgttttttcattttacaattcactcccatttttaatatcgggaatgaaaagttatcgattaacaatttgcaaaatttgtcgaacgaatctgttgaaaaaaacatattttgtcggggatattaacatgtacgcaatactgctgctgttttatcaccgattcactatgtaagacctcccagttgagttgatcctcgcttaccactgggaggttttactcattgtatgaaattggtggtgacgcaggaataatccgccgcgccgatcctgccccccattttacaccgccgatttaaacgaattcaaatattgcagaaagttggcttctttgactttattgacgatgttgccgattatggctgttttgatctttctgatggtatcccgggagcaatcaaggtggtttgcaatagcagtgtagctcatgccttccatcatgcaatcgtaaacgattcggtgcttttcttcttcaatgtgttccattgcattgtccaggtaatgcacaatagattcatatttgtgaagccgcctttctcttcggtccatctgccgcaattctgcctgactgacgcctgctgatccccttggcatgcccgcttcctccccgtatgttgcagtgagctttgtgctaataaaatccactttgtttaatacacggttgagccttttgatctcccgcagcatgaatttataatcacgaatccattcctcaatctcccatgcaatcatttgatctgtcatagtgctttccctcctgatagttaaatagagtaagtgtcattccagttgtttgctttttgttctgcgatatattgagggcctcgatacctctttcacgttgatactgaaggttttgaccaagaaggctttcaactcgttatagagctcttctttgccgcaaaagatattcacaagctttccgtttttataagcgaatccgtttttcatcatcctcaaactccctttttactttctgcgtttataagcgccgcctttgccacgtctgagtgtttgcatgttagtgttcatcatttgttgccagaaacgatctaagcgctcatgttgcttctgtgatggtttctttttggactgtttcatgtctaattactcctttcatagctagtaatcgcgatagacatctggttagttgcgaaaaaaaacggacaccgatcgaagcacaaatttctctgtaaaacgatcagtgtccgcaggctttccgtcttggacttattcaattttaaaatttatttttacggccctgtgccacaacttacttcgtattcaccatctgatgattttttcgaatagcataagtgaggagtttgccctgtttcatctttccaatctagccaatttacataataaagattcccagattcattgtctccttctcttttctggagaactgcaaagtagctttggtagggatatcctcttttataaatttcgtgtctgattgctcctttttccgaagaagctgtaaagacaacaggagatagaactggaagtactatcaatataacaataagtgctgccaagagagaaagtataattttagttttctttttcattttttcctccgatacctttttatgtatttatttttatgttatattattacatgtattttatgccatatttcaattggtgtaaatgataaatattacttatatttagattttattggaggtttcgtatgaaaaaagaattacttgcttcactagttttatgtctatcattgtcaccattagtgtcaacaaatgaagtttttgcagccactactaataaagagactaaagaaaatgtttcaattaccaacgagattggttacgaaaaagttaaggatatgttagaacaacaaaaatatgattttgaacacaacactcctttagcgcatcctaaagagtctaaattgactgattccgacgaaggagtcttactgtattctgcgttaagtaaagtggacaaacaaaaattccacgagtttacatacgatatagacgatgttaagacttctgaaaaaaacaataagctaattgttgaagcttatattactcgaaactttgtttttggtgttgaaaaagtaacaacatctctgggcgataatattaaacttgaaattcccaaaacaacttctaataaacaaagttctcaatcaacaaatacttctaatctaagtttctctcaagttaaaaattcttctaatcaactaaatgtaataccattgagtaattcttctaagcaactaaatgtaacacaattaaataattcttcttcaactctacaatatgaaaatgatgaagaatattcttcggatgttaaattagatgaatttttaaaaattataagcaagaagtgaaaaatgatgataaagaagaagtgaaaagtgaagataaaccagtaagtatgaacttcaatgctgctaactctaatcaactaactgtgactgcaacatctgttaaaggatatagtggttacgctgcaatgaaatatgcagaaaaatatgccttaaaaccaaataaaaactataaatattataaagacaaagattgtactaactttgtttcccaagcattaagagctggaagaatgccgtactttaaagaatggaaaccctatacagatgcttgggttaatgcaggagcctttagatcatacattttaaaagctggcggaataaaaatgaagactgtttctgatacatattcaaatgtaaagcttggagatgtatatcactatgattaccataataaaataggtcttcgctatgctgatggttggatggatcatacggctatcgtaacgagccgagcaaatatgaaactttatgtaagttatcattctaccaatagacttaatgttcctcgagaatatgttacttctaaggaaggcggaaaacggtatgtttctagtattcgcaattaataaattgatactaaatcgttgatcatgccttccgctacttaataagctgttgggaaagcaatcccctgatctagagtggttcaggggatttttgtaatttaaacgtgttccaacgctcagaaattccgttcatttgttttccctcttctctcaatacatcaatatctttaaagtaaaccgcagccgtaaatgaaatgattgccccgatcaaagcaaggttcgctttcatgtccggcctgtaatcgtgttggaaatatatccagaatcaacatcccatcagcagaaacaatattctaagtgccatccaatccccctaactcaacttactaacaaaaaacaccttggatgtttttgtattccatttaataataaagttgtattttaaaaaaagaagtgcttaaaatgaaattgaaaaagctttaactggttttgcattatcccttgctttactcgttactgttgctcctgcttttgctacaagccttgcaaaccatagcacaaatcacgaatcagtatcaccccaagcaatttatcaagattattataaaggggctgattctagagcagaatttaaaaatacaattgatgttttcagtacaaaatttcatttaaaagatgcatggctgaagtgacggtcttggactggctattctcaatgaagatttaacagaaatccgatcttccgtttgttactattgaactaatcaagtaagtttggaggtagtttttggactgcggtcaatgaatttcgccaacagttcgccaacaactcacgaatttgacgaaccggctttattaacgcaaagtaaaaaacccttgctgcgcaagggtttaagctatgattccgactgggctcgaaccagcgacctctaccctgtcaaggtagcgctctcccagctgagctacggaatcatgatatgtatgtgttgctgggtatgttgttatctttctgacaagttctattatataaccttaccttctattcgtcaactgcttttttagaaaaactttttttggacttgctgttccgttccccggctattataatatgtcttaattttctaacaatagaggtgatggggttttgcattctttgatttcttctgatgatgtatgggtattatgggggtttattgcggtgtgggcggcagtgagcatcgggctggagcagcgctttaagtgggcgtctgctgtgtcgggcgctattatcgcccttgcaggtgctatggtgtttacaaatgtaggagtgcttcctgttgagtcgcccgtgtatgacactgtgtggtcttatgtggtaccgctggcgataccacttttattgtttcagatcaatgttaggcaaatttttaaggaaagcaggcgtttgctgtttatttttctgattagctccgttggaacagtgcttggcagtatcctggctttttttctactcaaacagcatattccttacttagataaaatcggtgggatgatcagcgcctcttatatcggtggcggggtcaactttgcggcgatggcggcaaaatttgagacgcctggtgaatatgtgtcggctaccgttgtggctgataattttatgatggcgcttttgttttttattttaatcagcattcctgcactcaaatggtttcagcggcattatgccatgccgtttgaagagaaggtaaaagccgatggaaacagcggaaacagtgctgaaagctattggaaacggaaggatatttccttaaaggatatcgcttttaatgccggtgccgctttcgcgcttgttgcggttagtatgaaggtttccggttattttaaaagcattttttctcatcccctgctgaccggtacgcttggcgatcagtacctggttcttacgtctttaactgttcttatcatttttcttttcccgcgtttttttgaaaggctcaatggatctcaggagcttggaacctttttgatttatttgttttttgtggtgatcggcattcctgcagatctccgcttaatcgtcacgaatgcgcctcttattctattattcgtgtttatcattgcgattagcaatttagcggtttccttagctgccggaaaattgttccgtgtgcggcttgaagaaattctgctcgccgtcaacgctactgtcgggggaccgacgactgcggctgcgatggcaattgccaagggatggcgggagcttgtcgccccgatcatgcttgtcggtacgctcggctacttaatcggcaactatgttggcacttttatgggaaattggttttcttccttcttataaaaaggatatttgcatttccctgagaataatgtaagaggaatgctgacatgagaacggagagatcactatatgttaaaaggaaaaaccatttatgttagacctttagaagtaacggatgccgaagaaaatctggggctgcaaagcgaaaatcgagattttttcgaacagttttctatgatacgcgcagacgattactatacggttgaggggcaaagaaaacgaataaccgagtatcaggaaagacttgagaaagatgaagaatatcattttggcatctttacagcgtcagacgatagattaatcgggacggtttcgctctttcaaatcatccgtggcgcgctgcaaactgcgttcatcgggtattttttagacaaagcccataatggaaagggcattatgacagaggcagtcagattggttgttgattatgcgttccacgaattgaaactgcatcggattgaagccggtgtgatgccccgtaatctcgggtccatgcgtgttttagaaaaagcgggatttcataaagaaggcatcgcccgaaaaaatgtaaaaattaatggcgtttgggaggatcatcaagtcctcgcgattctgaatcctgatgacgaacaataataaaagaagccggactatccccggcttcttttttaacgaaccgaaactggagcaatttctttcagcgcttgttcgaaatcgtgttctaaatcgtctgcatgttcgacgccgacactcagacggagcaggccatcagtgataccgcgtttttcacgctcttccttaggcattgccgcatgagacatcgttgccggataggacaaaatcgattccacggcgccaaggctgacagcgaagactgggagtgacacattctcgactaacttcttaacggcctctttgctttcaagctcaaaagatagcacggcgcccgctcccgttgactggcttttatgggtttcagcgccgggatgatcagccagtcccggataatacacgcgcttgaccgccgggtgcttctggaaaaattccgcaagccgctgagctgtttgactcgctttctctaaacggacctgcaatgtttttaatccgcgcaggacaagccagcaatcttgcacgccaaggacggcgccgaacgcgttttgtagcttatacagctgcttcccaagctcttcatctttgacagcagccaaacctgagagcacatcgctgtgtccgcttaagaattttgtcgcgctgtgaagtacaatatccacgccgagatcaagcggacgctgcagtgccggcgtcatgaatgtattgtccagaaaggtcaggcagccgttttcttttgcaagctgaacaactgctttaatatccgtaatcccaagtgtcggatttgatggcgtctccatataaatgacctttgtgttcggcttgatgctccgcgccacttcattacgatccgtcatgtcgacaaacgtatgctcaatgccaaaccgggtcagcacctctgtcaccatacggaaggttccgccgtatacatcttctgtcacaagaacgtgatcaccctgtgacagcagtaaaaatgctgttgagatggcagccatgcctgaactgaaagcaaatcctcttgttccgccttccagtgcggcaattgtttcttcgagagctgttcttgtcggcgtgccagagcggctgtaatcatatgccccgaactcttcaaatgaagattggtgaaaagtcgaggcgtgctgaatcggtacactgactgccccggttccgccgtctgttttaaatggattgtgcacgagctgggtttccagcgtccaattgtgtttactcaaatgaaacagctccctctttgacctgacataatgcctgttttagatcctcttttaaatcttccgcatgttcaataccgacagaaaagcgcagcaaccgattgcacaccccgtttgcgatgcggatctcttcaggaatatccatgtgcgtctgggtcgcagggtatgtaataaagctttccaccccgccgaggctttctgcaaaacaaatggtcttcagtgcttttaaaaacggattgacccattcttctttttgcagacggaaggacagcatgccgccttttccgggatacagcacatccgaaatttcttcctgctcttctaaaaacgccgcaagctcctgcgcgtttgcctgatgctggcgcattctgaggctcagcgtcttcattcctctcatcagaagccacgaatcaaatggcggcaggacggcgccgattgcattttgatgctgaaacatttcctctccgagccgctcatccttcaccacgacaagtccagcaagcagatcgttatgcccgcctaaatacttggttgcgctgtgaatgacaatgtcagctcccagctcaagcggccgctgcaagaccggtgtataaaatgtattatctacgatcagcagaagaccgtgctcctttgtaatccgggcaatatgttcaatgtccgcctcctgcatgagggggtttgtcggcgtttccacaaacaccgcttttgtattcggcgtaatcttagagcgtaaacagtcctcatcgctgaaatcatcataatgaaaagtcaatccgtattttttccattcattttcaaataaacggtacgtgccgccatataggtccgatgaaacgatcagttcatctccgcttttaaacagcgccataatcgtttggatagcagccattcccgaactaaaggcaagccctctcgcgccgttttctaagttagcgatcgcgtcctcaacaagctggcgtgtcggattttttgtgcggacataatcaaatccggtagattctccgatccctctgtggcggtatgctgttgataaatagataggagcactcactgttcccgtgacttcatcgctacggttcccaatttgagctaatttcgtttcaacgtgctgtgacatatagctgacaccttcccttttcaaaataaaaaccccttcttcataagaagaaggggtttaacgcttcttcttatcttccaagcataaaaaacgcttgctggatttagcaccttggcgctttgcaaatgcaaaacaagccggttgctgaggtttctaagggccagtccctccacctctcacgataagaaatatcgatttcaattttctgattgttttatattagcgcaattcacagtttatttcaacacttttttcttcgtgtgccgaaccgtttaaagagagaaatttctaataattcatggtacaataattgaaaatgcaagaaagtatagtgatgtcctggaggaatgtttttatggcaccgaaaaacggcacagtgcaagaaaagaaattcttttcaaaagagcttaacgaggaaatgaccttgcttgtttatctgccgtccaactactccccgctttataaataccatgtcattatcgcgcaggacggccacgattatttcaggctggggagaatcggcagacaggttgaggaattgctgtcgaaacgcgaaatagaccggagcattattatcggtgttccctataaggatgtaaaagagcgcagaaacacttatcatccggagggttcaaaattttcggcttataaacggttcatcgcccatgagctcgttccttttgcagatgatgagtatccaacctatcagatcggttacggccgaacgctgatcggtgattcgctcggagcaaccgtgtcacttatgacagcgcttgattatccgaatatgtttggcaacatcatcatgcagtctccctatgttgacaaacacgtactagaagccgtaaaacagtcagacgatatcaaacacctctctatttatcaccaaatcggaacaaaagaaactgacgtccacacgacagacgggaacattctggactttacagaaccgaaccgggagctgaaacagctgctggagaaaaagctttccgattatgatttcgagccatttgacggagaccacaaatggacatactggcagccgctcatcaccccggcgctgaaaaaaatgctttaacactctatcatactttatttccaggagggacataatatgaaatacggaatcgttttatttccatcaaaaaagctccaagaccttgcaaactcttacagaaagcgctatgacccaagctactctctaatcccgcctcatttgacgctgagagcatcctttgaatgcgcggaggagaaagcggatcagctcgtatcacatttaagaaacatcgcaaaagagtcccacccactcgttctcaaaatgacaaaatacagctcatttgcgcctgtcaataatgtcatttacatcaaagcagaaccgacggaagagttaaaaacactcaatgaaaagctatacaccggtgtgttggcaggagaacaggaatataatttcgttccgcatgtgacggtcggccaaaatctttccgacgatgagcattcagatgtgctgggacaattaaaaatgcaggaagtgtcgcatgaagaaatcgttgaccgtttccacttgctctaccagttggaaaacggatcgtggacagtatatgaaaccttcttgctaggcagaggagaataatgtttgaaagcagttatcgcaaaaaatgaagaacaactgaaagatgcattctatgtaagagaagaagtctttgtcaaagaacaaaacgtgcctgctgaagaagaaattgacgaacttgaaaatgagtcagagcatatcgtcgtgtatgacggtgaaaagcctgtcggtgccggaagatggcgcatgaaggacggctacggcaagttagagcggatttgcgtactgaaaagccaccgctcagccggtgtcggcggcatcattatgaaagcgctcgaaaaagccgcggcagacggaggcgcttccggtttcattttaaacgcgcaaacacaggctgtgccgttttacaagaaacacgggtatcgcgtgctttctgaaaaagaattcctcgatgccggcattccgcacttacaaatgatgaaggactgaacgcatccggatcttttgagatccggatttttactgcatataaaaaaaccgttctctggtatgaacggttttttatacatatcgattaatatatgtccccattcctttttctcgcaatctcttataaagagagcgcttacgtttcatctcgtttacttttctttcagctgccgtttgattctcctgctgcttttccagttctttgtatacccgctgaaacgggacatagctgattttttcggttccggcataatcctgcttatgtccaatcgttctattagcatattgagcgtattgctggttctgaatttgacctgcatatatcatacaatacccacccctctgctgtctcttttcccttaaacttactttttgaaacacatttcttttgatatgatagtcattgtctgtaatgaacaccttttgattgggaggacccctttttgaaatgcgcccgactgaatgatagaatcatacatttacatacatattcgagagaacattatcaattcctctttgaagagggaataaaaggacatttattttgttctcattgcggaaagcccgttttgttacggcttaacatcgccgatccgccagagtttatccatcgccagccaggcgattttccggcatgtgaggaggcgtgcgaaccgaagccctctaaagaggggaaaaaagaagatgatcaggaatctggtgtcattcgtttacccaagggaaaagcgatcgccgctgacccgtccccagctgttacagaatggcaccgtcctagaagcattaaaccaggaacaccatttgtgccaaaaacaatagaacccgatacgagcctttttccgtctgtcggtttaaacacggatcagctgaaagctgtcacggaaacagagggcccgctcctcgtgcttgcaggtgcggggagcggaaaaacacgggtactgacagcccgtgccgcccacatgatcgaacacttaggcataccgcctgaaaatatgctgcttgtcacctttacaacaaaagctgtcgctgaaatgaaagagcgtatggcgaaccagtacggattacagccggcaaaagtcagaagaattgtgacaggaacattccacagtctgttttataagatcttgtatcactctaattctgctaaatggaacggtgagcatctgctgaaaatggagtggcagcgggaacaatatatcaaaaaagcactctatgaagaaggcatcgatgagaaagaatccccagttgaccaagccctgcagcagatcggtttttggaaaaacacttatgtcccaaatgaacgcatccctctaaaagatgagtgggaaaaacaagtttatcgtttatatgaacattatgaacgccagaaaaaagaacacagccaatttgattttgatgacatggcttcagcctgctatgaattgtttatcgagcggcctgaccttctggaacaatatcaatctcggtttacgtatatcttaattgatgagtttcaggacattaatccggttcaatacaaaatcatgcaaatgctcgccagcccggagcaaaacctgtgctgtgtcggagacgatgaccagtccatctacgcgtttcgcggaagcaatccgtctttcattcttgattttcaaaaggattatccgggagcgaagacgatctatttaactgcgaactacaggtctacgcacccgatcgtctctagtgctgatatcgttgtgaaaaagaacaaaaacagatatgccaaaacgcttgaagcggcccgcgatgacattcaggtccctgtgctgttttatccttatgatgaagaggaagaagccacaatggtcgtttccgatatcaaagaaaaaattcaaaatggagccagtccagaagactttgcggttctttaccgcacaaacagcggaggccgtgctatatatgaaaggcttcatcaatcgtcaattccgtatacagctgaccgcggcgtccaatcgttttacagcagacggatcgtccgccagattctcgcctacttgtacgccagccaaaatgaggatgacaccgaggcgattaaacacttgcttcccgccttgtttttaaaacagtccgctttgaatacgctgaaggcgctctcgattacagaggactgtaccatgatcaaagcgctggccaaattgcctgatctgaagccattccagctggacaaaatcaagaaaatcgtaccgttttttgcaagcctccgcacaatgaaacccgtagaagccatcacctttgcagaaggaaaaatgggcttctccgagtatttaaaaaagcggggcaatgagggcaacaagctggaaaaaggctctgatgacctgcgcgacatcaaggttgtcgccaagaagttcaaaacgattcctgactttcttgcccacgtagaccatatgagggccgctgagaaaaacagaacggatgaacatggcgttcagctgatgaccattcaccggtcaaaaggccttgaattcaaaacagtctacgtgttaggcactgtagatggctcgattccgcacgatttctcattagaaacggcaagaaaaggagacgaggccgctcttgaggaggaaagacgccttttatatgtagccatgacccgggcgaaacagcatttatatttgtcttgccctgctaacaggcgcggcaaaacagccaaccgctcaagatttttgtatcccctgctacagaaagcaagacagcccttgcatcattaacagcccggcagattactgccgggtttttactgtaaaaaaaggcccgctgcagtgagtcagccaggccatccacttatttattatccatcattttagaaatcgtgccaaaatcaagcttttcttttccgcttgtaatagattccacaattttatcttctaattcttttggcacgcgtctgtttgccatctgcgctacgcggttaatcacactgcgcactgtattttcatctttaaaattagcgttttggagtgatccggcaagattcattacatcctgcatcttcacacctgttttcttttcgatgttcttaaaaaattgattatccataatgcgcctccttttggcggagtaatacggtattgtatgaatgcacataatacaatgtgcttttccaacatttttaaaaataaacacaaggcaaggaagtacgggttataacccgtacttcctcaatacatcttaaaagaaagatgcacctacgatgatgaggagaatgaataatacgaccaacaaaacaaatgttgaaccatagccgccgccgtaaccgccagcataaccgccataacagccgccgccgtagccgccgccgaatccgtatccaaagcccatagataagcacctcctttactctctatacactatgtgagctgctgggatcggcttggatattcgcatagggcgtttgcggatttacgattgatcatattgagcttgatgttttttaagtaaggcctccgttttttcagccagctcttcaatctcatcttcaaattccagaccggctttatcaaatgcatccaagtcttttctgatactgcccatcgtgtcttcatgctctttttgcttttgttcatgtggttcatatcttccttctatccatttttcaaactcattcacttttatccccccgcttatgatatatgctgagcgagaccgcctcgttaaaaaaacaaaaaaccggagttctccggtttctttgccaggctattgaggctttttctttttatttccgcacccgcagcctttcttttttatcttttttgattgatacgatgaatctgtatatggagatttttgggaaggtttatgatgctgattcatttttgtccccttcctttccttatgtcatatatgctactttatgcgtattctgacagaaagttgctggtggtaacgccttattcttgcagccattttgatacgagcgtttctataatgccggcaaggccggcgatcgccaaaagtaaaatcagccactgcgccgcttgcgggatcaccgcctggcataaaatcaaaaagccggcacaccacacgcctgtgcaccaatagcagctcagcaattcaccaataaacgccctgacaccggttcccttaatcacgatataggtttcaatgttcccgtccgcatccttttcttccttctcttcatgaaacagactgcgaagcggcgccataatcgtgtcaaacaccagcaggcgggcgagccgaaagaccgcaagcgatagaagaacaattgtcagcccatttataaccactcgttcactcctttgccaatcatgatcccttcacatatatgccaaaaccctattcttcatgaattgtatcttgtccggcagaaaattggttatttttattattccgctctgcaccccatttgcattatatagagtatggataagaaaggagtgaaggttatgtcatttgaagaaaaagtcgaatccctgcaccctgcaatatttgagcaattatcaagcgaattcgaacagcagatcgaagtgattgattgcgaaaatatcacaattgacacgtcacatataacagctgccctttctatacaagcctttgtgacaaccatgattatcgtggcgactcagctcgtcatcgccgacgaggatttggctgacgcagtggcaagtgaaattcttattctcgatagctcccaaatcaaaaaaagaaccatcattaaaattatcaacagccgcaacatcaaaattactttgtctgccgacgagataataacctttgtacaaatcttgcttcaggtgttaaacagcattcttagtgaacttgacgtcctttaaccctttcttttcacaaacttaaaagacgaggtgaaaacaaatgtcagataacgataaattcaaagaagagcttgcaaagcttccagaagttgatccaatgacgaaaatgctggtccaaaatatattttctaaacatggggtcacaaaagacaaaatgaaaaaagtatcagacgaagaaaaagaaatgctcttaaatcttgtaaaagacttacaagctaaatcacaagcgctaatagaaaaccaaaagaagaaaaaagaagaagcagccgcacaagagcaaaagaacacaaaaccgttaagccgcagagagcagctcattgaacagatcagacaaagacggaaaaacgataacaattagccaatcataaaaaatagggttcttcatcaggatatatgactcagtcaaaataagaggctcgctcatttaataacagtaaaagaaaaggaggaatagatatggaaagcagaccatattcttgggttgcacttgatcctgactgtgaccatccgttagatgacaaagagaaagataaagaaaaacacgaaagaaaatgtcattgcgacgtttgctgtaatggcaatggtttttttggcaacgacaacgccttcatcgaccaagatctagctcaagcaaatctcaacaaacaagtttcagatgaaacgattattattagagattcttgtgacatcaatgttacatctacagacgttcaagccgtaacatcagttgtaacagcacttaatgccgctgtcgtaacggcaactctgacatcaattgcagacggcgtaattgccgaattagtcgcacaagatttgttacagcttacagctaacaaacaagtaaaccgccaaaaacttctcatcgaatgttcccgcggcgtaaacgtcacaacagtagatgccgatatcgcaacccttatttctacagcaacaaatacactcgtagccatcctagttatcactcttgtcctctaggacctaaaagcagagctaaaaacgctctgctttttcttattttccaagcatatgatgaatatatagacgttcacccacaccaagtggggcacgggtacatatgttgttaaggactaaagtcaaataccctataaagaaggagctgaaatcaatgagctgcggaaaaacccatggccggcatgagaactgtgtatgcgatgcagtggaaaagattttagcagagcaggaggcagttgaagaacagtgtccgactggctgctataccaaccttttaaaccctacgattgctggaaaagacacaattccgtttctcgtttttgataaaaaaggcggattgttctccacattcggaaacgtagggggatttgtggatgatatgcaatgctttgaatccattttcttccgcgtcgaaaaattatgcgattgctgtgcaacactgtctattttacgcccggtcgatgtcaaaggcgataccttaagtgtttgccacccttgcgacccggatttcttcgggctagaaaaaacagatttctgcattgaagtggatctcggatgcttctgcgcgattcagtgcctgtcaccagagctagttgacagaacatcgcctcacaaagataaaaagcatcatcacaatggataaacacttgtaaagaggaatccccttccaaactctattacaggtgcaaatcattcagctgcttccagcgtgaggcagctgactctccatcatttcgccagtctcaaatttataaggcaggagggataatatgagccagaaaacatcaagctgcgtgcgtgaagctgtagaaaatattgaagatctgcaaaacgctgttgaagaagactgcccgaccggctgccactctaagcttttatctgtaagccattcgttaggcgacacagtgccttttgcaatatttacatcaaaatcaacgccattagtcgccttcggaaatgtcggcgaactcgataacggcccttgctttaatacagtatttttcagggtcgaaagagtgcatggaagctgtgcaacactgtcattattaatcgcatttgacgaacacaaacacattttggacttcaccgataaagatacggtgtgtgaagtgttccgactcgaaaaaacgaactactgtattgaagttgacttagactgcttctgcgcaatcaactgcttaaatcctcgattaatcaatcgtacacatcatcattaatcataagctggaaaagcttgcaggcctgcaggcttttctctatgtaaaaaaagctgtccggcaacatcagccgggcagcttttttctttttcgttaaaaaccgagcgggtgcaaagaggtaatatcatcgattgccagttcggttggggctccgtttccggttgttcgaagcaggacggaatcatttcttcttccgacaatcacgcccctgtacgttcttccattggcttcaatcaaacaaagcgctctcggcatgttatgaggcagctttgttaaaaaatcaattttttcgtggatcgtcatcttgctcatcggttttttcacttttcgtgccggcggtgctttttcctccgctttatcagcactatggacagcttccggttctttctcaggcttccgggcctcaagtgcaggctcttcctttttttctgctttcgggggctcgtgttcaacggtttcttctacggcctgcggctctgccttctgttcctcttggctttttatgttctctggctctctcgcctcttgtgtttgctgactcactggttcggctgcaggcttttggtcttcttgcaggacatcctgtgccacggcttcctcctgctgcttctcatggtaagccggcttttcctcagcttttggcggagcgggtttgtcggcctttcttttgatgacaatctcctgcatggatgaccttgtagtttctgcataatccggctgaacaatatacatgagcggttttttatccgcgtttcttttcttattagacatcttcatccctccgattgtgtcatattctatctatatgacagaaagctgaaaatcagaagaaataaaaaagcaatccctattcgggattgcttgatatagatcctgcttagcgggcagtgatatggaaaccagaatcaacgtgaagattttcacctgtaatcccgcgggacatatcgctgaacaagaacgcagctgtatcgcccacttcttcaggtgttgtcgtgcggcgaagcggtgcacgctcttcgatgtcttttaagatagagttgaaatcgctgatgcctttagcagataatgttctgatcgggccggcagaaatgctgttgacgcggatattttcttttcctaagtcagcagctaaatatttcacacttgcatcaagagaagcttttgctacacccatgacgttgtagtttggcatcacaagctctccgccaaggtacgtcaaagtgacaatgcttccgccttcagtcatcatcggacgtgccgctttgacaacagcagtcagagaatatgagctgatgttatgagccaaaaggaagccgtcacgatttgtgtttaagtactcgccgacaagctcttctttgttggcaaacgcgatacaatgcgcgataccgtggattacaccgacctgctccttaatgcttgcgaagcaagtttcgatttctgcgtcgtttgtaacatcgcaagggaggatgatggaatcgttgcggtctaatgttccggcaagctcgtgaacggatttctccaggcgttcaccagcgtatgtgaaaatcaaacgtgcacccgcttcatgtaaagaacgcgcaatgccccaggcgatgctgcgtttgttggctacccccatcacaacaatgttacggccttcaagtgaaaaattcatatgtataaagcctcctatatttaataaagacatagtattagtacctgatcttaattcctatcatatcataaccttgtccagatgaaaagcgcataccgtagcaaacgcaaaagagatcaccatcagctggtgatctcatcggcttgtatttaagctgtttcgtttaaaagcgaaatggtttgtcggcccgtgtcccgatccgatgccgagcgtattttccaccgcttcacggacaaagttggccgcaacctcaaatgcctgatggatgctgtctcctttagccgtttgggccgttaaagccgcagcaaaggtgcagcctgtgccatgcgtatgcttcgtattgatataaggatgggtgatttgcataaacatgctgccatcaaaaagaaggtcagtaatgtgattgtcctcaggctggtgcccgcctttgataatgacatgctgcgcacccatcttgacgagctgctccgctgcttttttccggtcatccagcgagctgattgtcattcctgtcagcgtttctgcttccgggacattcggcgtaatcgcgtagcttcttggaatgagcaactcctttaaggtggcaactgactcatcacgcagcaaggatgccccgccctttgcgatcataaccggatcaacaattacacgattgaatccgtactcgtcaatttttcttgccacttcttcaatcatgtcggcattccagagcattcccgtcttaactgcatccggtctcaaatcctcagcaacagcgtcaatttgctgtctcaacgtctctacagtcagcggatgcaccccgtgaacgccaagcgtattttgagcggttaccgccgtaatcgcagacattccgaatacatcaagctcttgaaaggttttaatatcagcctgtatccctgcgccgccgcctgaatctgatccggcgattgtcaatgctttatatatactcattacactacactccttttattacccaatccatttatgataaatggattttgcccgggcaatatcatttgttccatggatcaaagctctgccgtcccggaacagcaccattttcatatcatccgagcggcaggaaattaaatacgggttcgcagctacttcaagcccggcctgcctcagctgaccggcaagcgcttcaagatccgcttctttcgtaatagatgatctgatctgcaccgtgttcctgccgcacaatacagccgcttttgtttgattttcataagacaaaaacggaaaatcctttgtgccgcagcttgggcatgcgtcatgtttgagactggccgctctcacttctgaccgctcgtttttccacaaatcaaaggagcgcagcaccggctcgcactcctctcccgtcagcagtttcagtgcatctgttacctgaaagactgctacctgcaaaacagccggactgatgatgccagctgtgtcacatgttgctccgccaatcggaagtgcatcgagcaagcaatgcaggcaaggagtagaacccggcaccacggtaaaggtaagaccgtagctccctacacaggcaccgtaaagaaaaggaatcccttcctttaccgcagcatcatttacgatcaggcgggtttcaaaattatcagccgcatccacaataatcgatgcatccctaatcagctcgaagatattttctgctgtcacatccatgacaaggccggtcacatcaacatcgctgttaatcgaacggagacggcgctccgcagcggctgctttcggcatttcttttttgacatcatcttctgtataaagctgctggcgctggaggttgctccattcaacataatctctgtcggcaattttcacagagccgactcccgctctcaccagcatttctgcactggctgttccgagcgcgccggcgccgataatcacggcgcgcgcttctttcaattttttctggccggatgggccgatcggagcaaacagctcctgccttgaatacctgcctgtcatacaggaagaccttctcccggactgcttgccgttccgtattgcttaagcgggattcggcccgcctcataagaaaggcgccctgcttccactgcgagcttcatggcacgagccattttcacgggatcgtcagcgccagatacagccgtattgagcagtacgccatccgctccaagctccattgcgtatgccgcatctttaggcgagccgattcccgcatccacgatgaccggtactttcgcctgttcaataataaacgacagattcaaaggatttaagattccttgtcctgatccaatcggagatgcacccggcatgatggcatgaacgccgagctcttccagctttctcgccagcacaacgtcatccgacgtgtacgggagcacaataaagccttcttcaagaagctgttcagacgcttttaatgtctcaacagggtcaggcagcaaggaacggctgcatccgatgacttcaactttaatcatgtcacaaaggcctgaagctttcgccagccttgcaatccgaaccgcttcttcagcagtactggcgcccgctgtattcggcaaaagcgtatatttggataaatcaagctgttccagaaaattcggctgagatgcttcaaaaatgttcattctccttacagcaaatgttaaaatatcagactcagaaacagctactgcttccttttgaatgtcaaacgatgggtatttccccgtgcccagcagcaatcttgattgaaatgattttccgccaattgttaacatgctcatccgcctcctacaaaatggacaatttcaatgacatcacgatcacaaagctcaacctcgtgatagcgttctttcccgattatttctttatttctttccacgataacgattttattttcaagctgatacgacgccagcaggtcttgaattgtacctgtgtcttttttccacttcacgtctttaccgttcagctgtagcatcatatctgaaccgcctccttgcgatcaattcggaatgcgtgcagccagtcttggttgacctctttattcatgatgagatcactgatcaaagcgcccgttgcgggagcaagcaggatcccgtttctgaaatggccagccgcaaataaaatacggctgtcctcaggatgtctgccgatgtacggttttccatcctttgttcccggacggagtcccgcccaaaaacgatccaccttcatattctgtatagccggcagcatcgtttttgctttttttcataacagattccaatccgccaagatccggtgtttcactccagtcccccggcttcattgtcgcgccgacaaccagtcttccgctttttctcggtacgatatagcagtgatcatggtaaagcgtttttgtcagcgggatatcatcattccaaacggacaggcactccccttttacagggagaaaagcattgttcagtccaagctgtttaaaaaacattccgctccacaccccgctggcaacgacaacatgattagcccatacgtctccgctaggggtcttgatgaacagggcttcaccgtcacgttcgacatgcaggacgggcgtatgctcaaaaatctccgccccaagcatttttgctgctttcacatatgccttgcaaacaaaataaggctccacatgcacatcatcctgaataaaagatgcaccaaagatgtcaccagacgcatacggctctttttctaacacctcttcttttgaataccagctgacagagtccaaatcgtccatctgtctcagctgcagcacatcttcttcagaaaatgcaagcttaaacataccgccgttatgctgcctgatatccacaccggataatgcataaagctcttctccaagacctttgtacagacgctgactgtgcatagcgaaatcaaaaaacgcgtcacgttcctcgcattcggcatgggcgcccagcattccggcagcggcacttgtcgttctgccgcccattgttccgctttcaaacaatgcggtgtttttgttttcctttgccaaataataagcaattgcggaaccgataattccgcctccaatcaccactgcttcataatgccttttcatagcgcatctcctttagcttgcgggaatatcgtctggctgcttccaaaggttcagcggaagagaaaattcctgacataacagcaatgccgtctgcccctgcttgttttacgtctcttaacctgtccggcgtcatccccccgatggctataaccgggatggaaatccgctgtttgatatctgacagcaaagatactcctctgccttcaagaccctttttgcaatccgtttcaaacacatggccgaacagcacgtagtccgcgtcttccttttctgcttgaaccgcttcctccagtgaatgcaccgacctcccgatatgaaggtgtggaaatctggctctgatctgcttcggtgaaaagctgccgcttggcagctgcacgcggtgaatagtagagaaaagtgcaatatccacgcgcccgttcatcaccaattttcgtttatctataccgccttcaaaaataagatcgagcagtttcaaaatatccgccgccgattttgagcgttcccgaatgtgaataaaatcaacttcattctgaatcgtaatgatgattctcgctagctcttctaccggcttgctgtcatccgttatggcgtgaagctccacattcctccacctcttttatggcgctgtcagaccagccttcttttcgataggccattccccaaaattgatattcatagtagctggagatgacaaaattctctttcatcttggcacgcacttcctccgtgctgttttccgccagctcatcaaagcggttgatttgctcctcgacctgttgtctaaaccaatcaccgccatatgtgccaatccacttctgataaattggatgccccggatcacaatgcagcaatttctcaccaacctcgtaatagagccaatagcatggcagcagggccgctaagatttctgcgaaattcccgctcaaaaccgaacggtacatatgggatgtataagagtacgccgtaggagacggcttaaacgccttacgctcttcctcgctgatttccaacagctcggcaaactcgcgatgaagcgccatttccgcctcatatgtaccttgggcatggcttgccatccgccccgttgtataaagatccttcgcataagcggcaccaaatgactgcacctttgcaaaatgcgttaaataataggaatcctgaagtacgtagtatttaaaacggtcaatcggaagcgttccgtcaccgattccttgaacgaacggatggacaaagctcccctcccaccattctgcggctgcactgcggcattcttctgaaaacttcacaaatcattccccctctgaaaataaaaaaaccactttcccgcaaggaaaagtggtttggaattggcatagtaaaataacacaaataccgctccacttccctacgcaggtctgaacctgttcaagttatgagggtctaaaagtcacacttttatctcagcccttatgaaggacacccctagtggttaaacgaatacatattgaattgttctgcacctctatattaacacgaatccttatttggtcaagatttatccttccaatgttttcttaagatccgttacgtacccccgagatccggtgacaattaaacggtctccaagtttcagcctcgtatccccatgaggaacgatgctgtccacacctctgaagatcctgacaaagatgacgtcacctgttaaagggaattcccgtaaaatgacaccatcatatttactgttctccatattaatttgatacagcgaagactcttggttcgtgagcagcttcatgacgccaggcgcttcaatcagtgcgcgaagcagcgtttttgtcgacagcagaatagaaaagatgctgattccctgctccttcagagctgcttcatgctccggtgatcctacgcttgcaatgactctttctgtgcctttatcttttgcaagtaatgcaatgtctgcattcatatcttcatttcctgtcgccacaacgaggatatccgtttcaaaaatgccgagtgattcaagcgtctcgtgttcatagtcagaaattgtttcaacagcaaacactgattctgacagcttttcctccgcattctcttggtagacgtgtacaacacgcacgtcatactcttcctctggcaattcgagtgtgacaggcaaagtcatttgattggcgccaatgaacgtaatcgtctttttctcctccggctgctcttcccgtttgtataattttttaaaacagatcggcgtaaaaatacttgcaatgacggctactaaaattagcgctcctgacatatttgtactgatcacgtgaagctgctggccgattgttgcagcagcaatcacgagcgaaagcgttgatgtcagcaggaaaccagacgcgaaaatggttcggttatcataccacttctttaagtacatgacaggaatgattttgctgactaacagcgcaagcagcaggagcggaatcatgattaaaattgttttatcctggaaaagagtccaaatatcaagcttcacaccgaccatcacgaagaaaatcggtattaagaacccataaccgaatgagtccagctgctgaacaagttctttgtttggcgaaagcagggaaacaagaacccccgctaagaaagcgccgagaatattttccgccccaagtgattcagacagggcaacgagtacaatgattaacgtaaaaatggcacgcgtcccgatctggatcgtcccttttgacatggattgaacaaaagagcgatgtttgaagacccggccgaaaaagtaaagcaccactccggccgcaaacagaatcatcaggagccacatgtttccgctgtcctctccgtataaagaagaaaaaacagcaagaagaatcatcgtggccaaatcagcaataacagcaacaagcaaaataatctgcccgatattcgaattcatgatccgttcttcttttaatgttggaacgacaacgcctaatgaaatcgttgaaataatcagggtcatcaaaaatgcattttggataaatccggccaagacgaacccataggacaagagcaatgataaaataaaaataccgacgaaaataacagatgccgcagcaaacgtattcggcgcttccttgccattcggcaggaactgctttttctttcctttctcaaacgacgaaaaatcaatttcaagcccgcttaaaaacattaaaaagataaatccgagcatagagagtgtctggagccaggtgtcaccctccacaactaaattaaggccgcttttcccaattatcagccccataatgatttcagcaacaacaaccgggatgctgagtttaaaccgatgcaaaaggatgggtgtcaaaaatgcaacgataagtacaacaactaaagatgcgacagatgtatgcgccataatcagaacctcctttttaagtcagggttatgctagttctcactcagagaacaaaacctcatttttaaaaaacataacgcgattttaacaagggtgatgatgaaaaataaagtgataaggtcttaatcctgtttagaaaatgattcttcttctataatttgcacataaaagcttgtgatgactcacaacactttgcttcataataaataaaacaatcggtaaggaggagaccgcatggcttacgatatcatcagcgatattcatggctgctatgacgaaatgactgcattaatccaaaagcttggctatacaatcaaaaatggagtacctgtccatgaagaaggcagggtgcttgtttttgccggagatttaactgacagagggcccaaatcgatagaggtcatccgatttgtagccggcgcttacgaaaaaggcgctgtgcgttatgtcccgggaaaccattgcaataaattatatcgttacttaaaaggaaatccggtaaaagtgatgcatggtctcgaaacaacagcggcagagcttgaggaactttccaaagatgagaaaaaatcagtcagcgaacagtttatgaagctgtacgaaacagcgccgctttacgacatcttacataatggagaattagttgtcgcccatgctggcataagagctgacgatatcggcaaatatacccgcagagtgaaggactttgtgctttacggtgacgtgacgggtgaaacatatccggacggcagacccatcaggcgtgattgggcggcagcctataacggaaaggcttgggtggtatacggtcatacacctgtgaaagagcctcggaaggtcaatcgcaccatcaacattgatacaggctgcgtgttcggaaatcaactgacaggctttcgctttccagaaatagaaaccgtctctgttccaagctccctgccttacgacgaatcaagatttcgccccatataaaaaaggagagaatcaatgattctctccttttatcagtttgctcatgtcctgaggcagtggagcatgaaacctcatgttctcctgtgtcagcggatggataaacgaaagatgctcgctgtgcagagcctgccggccaatttcctgtctcgttccgccgtacagtgtatcgccgcacaacgggtgcccgagatagctcatatgaacacgaatttgatgggttcgtccagtctcaagctgcaatgccaccgaggtcatgtcatcatttgcacatgtgacgtaaaaatgagtaacagccttctggccgtctggcgttaccgtccgttcaataatactgtcaggatgtctgccaatcggagcatcgactgttccctccatctgtgccatccgcccgtgaaccactgccgcataccggcgtttcacaaggccgtttttttgcgcagacgataaaatggagtgggcaaatcgatgcttggcaacaagcatgatacctgatgtatcccggtctaaccgggtgacaagatgaactgtcgccctcactccggttgtttgataatgatcaataattccattggcaatgctgccggaggggtgctctctcgaagggattgatgacacatacggctgcttgtttatcacaagcacatgttcatcctcataaaggatatcgagcggaacaggctctgccaacagcgtctcgctcacctgctcctcaggaaacttcacgataagaagatctccctctttcaaaacgtatttgaccgtcacatgctcaccgttaatctgcaggtctcccccgccaaacttaatatcggtcagcagacgtttcgaaattcccagttcaccggcatattcttttacagtcatcccgtcctcagcggaagtaatgttctttctgataaaaaaatgctccacgatatgtcctctttctattcaccttttccaataaacgaatcctggactcttttccaaaatggaaacggacggaatctcgcaaaccgcactttttcggatgcaacttggcagcggatcgactttacatccttatggagaagggttaaatggtcaatcgtcacttgaaagtcaacttcgtttctcggcttaatcatgcaatcatgatgggatgggagaagcagaggtgacccgaccgtacggaacacgcggttattaattgaagccatttccgcaagctggatcgccctgatagacggatggataatcgctccgcccagcgccttattgtaggctgtgctgcctgatggagttgacaggcagaggccgtcgccccggaaggtttcaaagagctgccctttgatttccacatcagcaacaaggcttccttcgatgcttttaatcgtacattcattcaaagctaagtatctttcttcccgctcgttttcgtgataggtcacaatgacttcgagaagcggatattcgactgtatgatacggcgttttcgcgatggcaagaacaagtttttcaatttcatgaggaacccagtcggcataaaaacccagatgacctgtgtgaacgccgacaaatgctgttttgtccaaacggtcgctgtatctgtgaaaagcatacaaaagcgttccgtcgcctccgactgaaataacgatttccggttcattttcatccagttccatatcaaaatccaataaatacgcctgtattttgcttttcagcgtatcagaaacttgatctccttttgatgatacggcaaatttcatgctcttcttcccctttacctattgttgctcgcttccttttttctttcttgaaaaggcagcttgagcttcctgtacttcacccctgatctccgacatctcttcatcaagccgggaagccgcttcagaagcgcgctgaagccttagttttactttttcaggaatgtttccgctgtatttataattcaatgaatgttcaatggtcgcccaaaaattcatcgccagtgtacggatctgtatttctacgagaacatgcttttctccggataccgtctgcaaagggtacagcacaacaagatggtatgatcggtatccgctctctttatgttccgcaatataatccctctgatccacaacggtgaaatcttttctggcaaaaagcatctcttttacgatttggatgtcatcgacaaattggcacatgattctaaggccagcaatgtcctgcatggtttcaatttcatgcagcggtatgcttttccgtctcgctttttcaagtatgctcgccacaggcttgacgcgtccggtcacaaattcgatcggtgaatggtcgtcctcgtattcatatagtgtgcggatccccttgagcttcactttcaactcttcgacagcctggcggtacggcactaaaaaacgctcccattgtttgtcatccatcatacatcccccaattccgaaccagtttctataaaaacacgcgtttcactttttcttccatttcttctccatagtttgcattatcttttatattttctaaaagatattccagctcctcatgcaggcctgccagttcaattgtttggtctcctgcctctaaaacaaccggtattttttgtgcatgggcctgcttcagttccggccatacatgttcctttataatgacatattcaaaagaatcagctaattcaagtatgtatacaaaagcaaagtggtcagaatcaacaagcatttgacctgacggcttgcgttccgcttcgtttccttctgtctgacaggcaaggcgaagctgatcatccgataatgttgcattcaaaatttcgattctgttttgcataatgctctccttttttaaacaaagtacagattcattttatcatatcgagctcgatattgataaacctaacatctaaagagataatagtaaaaataagatttacagggcggaaaggaagagcatcatgagccaagagattgaaatcgaatttaaaaacatgctgaccaaacaagaattcaaaaacatagcatcggcactccagctgacagaaaaagattttacagatcaaaagaatcattattttgatacagacagcttcgcgctgaaacaaaaacatgctgcgcttcgtatccgcagaaaaaacggaaagtatgtccttacattaaaggagccggctgatgtggggcttctggaaacgcaccagcagctttcagaggtatcagatctcgctggattttcagttcccgagggccctgtgaaggaccagctgcacaagcttcagatcgatacggatgccatacaatactttggatctttagcaacaaaccgtgcggaaaaagaaacagaaaaaggcttaatagttttagaccacagccgatatttaaataaagaggactatgaaattgaatttgaggcggcggattggcatgagggcagacaagccttcgaaaagctgcttcagcaattcagcattcctcagcgcgaaaccaaaaataaaattctgcgtttttatgaagaaaaacgaaagtctatataaggtggaatgacatcgtgaatgtaacgaattgggcagcattacttcagcttcaggcattacagtccatatctaatgcacgcagcagctcggacactcagaatacggaaagcccgctttcaagtttcagttctttgctcagccaatatacaaacggtctgacatctcagcaatcagcaccttcttcatcgccaagcccgctcagcatgctgaacagcgcgaatacaacagcgccgtcactgctttcagcgtatgggcttaactcatatacgagcagcaattcaggttcagtcacaaaagcggcagaaagcactgaaacagctgttgcagattcagcttcaaacaaacatgaagcaaatcagatccgttcgggagacttctctattgacagtgcgattaaaaaagccgctgataaatatggcgttgatgaaaaactgatccgcgccgtcatcaaacaggaatcaggctttaatgcaaaagcggtcagcggagcaggtgcgatgggcctcatgcagctgatgccgtcaacagcaagctcacttggcgtttccaatccgcttgatccgcagcaaaatgtggagggcggaacgaaatatttaaaacaaatgctggataaatacgacggcaatgtgtctatggcattagcggcttacaacgccggaccggggaatgttgaccgatacggaggcattcctcctttccaagaaacgcaaaactatgtaaaaaaaataacttcagtttattacgcgtaaccagaggtgctctttccctctggtttttttgcgaagtgaaatcttacgcattcctgatttttatgtgatatgatatgaaatacaaaccccggctgtcagccgaaatgagtcatcaaacgcataaaaggcagtttgtttgtagaaatgatgccttgttgctaaaataaatctagatgaaacaatgaaatacagaaaattactttttgcaataggatttatgattcctattagccatatttaaaggagtagtcaacatgggacaatcgtttaacgcaccttatgaagcgattggagaggaacttctatcgcaacttgttgatactttttatgagcgtgtcgcgtctcatcctttgctgaagccgatttttccaagcgatttgacagaaaccgccaggaaacagaagcaattcttaactcagtatttaggcgggcctcctctttatactgaggaacacggccatcctatgctcagagcaaggcatcttccctttccaattacaaacgagagagctgatgcgtggctcagctgtatgaaggacgcaatggaccatgtagggctggagggcgaaattcgtgagtttttgtttggccggctggagttgacagcaaggcatatggtgaatcaaacggaagcggaggatcgatcatcttgacaaactatcagcatgagctatacttcgcccattgccacggtcatccaaaaaaaccgcttgaaatttatatgtttgtagaccctttatgtcctgaatgctggtccttagagcccgtcatcaaaaagctgaaaatcagatacggacgttttttcaccttacgcattatcgcttccgcaagccttaccgctttaaataaaaagcgaaaaaagcatcttctcgcagaagcatgggaaaagatcgcgagccgctctggcatgtcatgtgacggcaatgtctggttcgaacaggatcagccgctttcatcgccttatatggctgctctcgcttttaaagcagccgaactgcaaggacgaaaagccggcatgcaatttctcagaaatatgcaggagagcctatttgtttcaaagaaaaatattacggatgaaaacgtgcttttggagattgctgaaaatacaagtctcgatcttgaagaattcaaaaaagatctgcattctcaaagcgcggtcaaggcgcttcaatgtgacatgaaaattgctgccgagatggatgtttctgttaatccgacactgacgttttttaatacgcagcatgaggatgaagggcttaaagttcctggcagctactcatatgatgtatatgaagaaattttatttgagatgcttggcgacgagccgaagccgtcggaaacaccgcctttagaatgttttattgaatatttccgcttcgttgcctcgaaggaaattgctcttgtatatgacctgagccttgaagaggtagaaaaagaaatgaaaaaactggcgtttgctaaaaaggttgccaaagtggaagccaaacacggaatgttttggaagtctctcagcacttattctgatgaatatcaatcatgtgaaaaatagccgcaggcgtgcatatgcttgaggctgtttttttatgccataaccaaacgtacgttccatttttagcactaaagaaaccgcgccgggataagcgcggtttcatatgtcttaacgacaacaaaggggatgggagaaatttttcacggtcaaacaaaggggtaatgtttgtttgtgatcaatttcacatccttatgataacaaaagatgtcgacttttgacaacctctatgcttaatgttcatatttttgtcacaaaacataacgaagtgcattcactcatatccttataaggaaaaaggacgaggaggaccgccatgatgtctactttgatctcaattgtgtgcattgctgtttttttctgcttgaatatcttaggcatgatgcatatgctgccgctttatattacctctcctctgctgtttctgtctattttgtttaccctctaccgcttgaatcaccggaaaacctttaaagggttttaaaaaagcctgtgcgtcatttccgcacaggcttacttttttaagactgcttgactttcatcagcagctcttccatttcatcaagtttttcttcaaacattttgcacgcggcttcgattggctctggagacgtcatatcaacacccgcttttttcaggacatcaatcgggtattgtgagcttcccgctttcaggaagtcaatataacggtcaaccgccggctttccttccttcaaaatctggctgcttaatgcttgggcagcgctgtaacctgtcgcatactgatacacatagtaattgtaatagaagtgcggaatacgcgaccattcaaggccgatttccttatcaatcaccatgccgtctccaaaatactttttattcaggtcgtaatagacatttgtcagaagctcaggtgtaagcggctcgccttcttgcgcctttgtatgaatcagatgttcaaattcagcgaacatcgtttgtctgaagaccgttcccctgaagccctcaagcatatggttgagaatatataagcgctgtttttcatcctctaaattgttcagcaaatattcgccaaggagcgcttcatttgtcgtagaggcaacttccgcgacaaagatgctgtaattgccgtatggataaggctggtgctttctcgtatagtagctgtgtacggaatgtccaaactcgtgcacgagcgtaaagagattattgacgttattatgccagttcatcaaaatatacggattcgtgccgtaagctcctgatgaataagccccattgcgtttgcctttattttcgtaaacgtccacccagcggttttccagtccttcttttaggatagaggcatattcttcccctaaaggtgcgaggcctttcagcatgtaatctttggcttcctcgtatgtcaccttcatcccagcatctttcacaagcggtgtatacaggtcatagatatgcacttcatcaagctcaagcactttctttcttagcgcaatatagcggtgcaggagcggcaaatgcttattaatcgtcttaacaaggttatcgtatacttcctcaggaatactgttgttagaaagcgcagcctcacgcgcggacttgtactttttcactctcgcgtagaagttgtcctttttcacagtgccgcttagcgtcgtggccattgtgtttttatattgtccgtacgttttatacactgcgtcaaacgcatttttgcggacttcacggttttcactttccaagaaattaataaagttgccgtgagtgatctgtttttcattcccatcttcgtctttaatggatggaaacgttatatctgcgttatttaacacgctgaatgtatttgaagatgaccccagtacctcggaggcttcagcaagcagcgcctcttccttctcgctcagcacatgcggacgttcctttgtaatctcctcaatcgcatgagagtacagcttcaattcttctttttcaagaatgaactgctgcagtttgtcttcttctatggataaaatctccggaaccaaataagctgtcgcgcttgcggcctgtgtatacaggtttcccgccttgtcattcagcccctggtaaaaggagttcccagtatcctggtcagagcgcatatgcgcatatgtgtacagcctacctagccgctccatcactttatcttgatacgtaagagcctcgtataaatgatcagctgaatctgccagctttcctttatacttagataaattcggaattaattcttttacagcttgaaattctttattccaggcctcatcactaggaaaaatatcctcaagtctccatgtgtcttctgcctttacctcacttctgtcaggcagttggtttgcgttttttttcctcagccatggtgatccccctcgtcttctttgattcaagccaattgaaaaaacagctgtttctcaataaacttgtgttgtgaatatcttccggtttttcactgccttttgtcaaatcatatgcagtaatgaagagaacgaatgccaaaaaagcagtaaaaacacgaaaaacctttccttttgtgcctttcacagcctgcccaccacctttgtcttagggtgagccaaataagacaaactcattctataaaacagctgcggtctctttctatgagatcctgcatggagtgtatgcctcctgcaggctgattcagcacatatacttctttctgagtctcccttaaaaatcccttcttgcacaaaaaatcaatatactgtttaaccgcttctgaaagacactcttcgctgcattcggacctgagtgcaatgttcttattatgaatgtgcagtttgcactgctgcaaaacggctgaaaaacgaattggcgcacgtttacctccaagatccgtcataaacaaataaagaaacccctgccacacaaaaaccggactcttaaaaactgccccttttctaacaggaacaaacacttcagtcggcagaaaagaaaaaggcgtctgtcgtttctcataaaacagcagcctaaggcgatttgtttcctttgagttaaaccgatggggtttatggcgaaaacggtgaatcgctttcgtccagcctgaatattgaattgagggtttcggttcagtgaaaaaaagatcgcctgcacctgcccgatggatagggatcgtttggactgaggaataagaatggtttgtgtagaatggaatgatgtggctgagccggagaaaagaacgcctttcaggacaataacatatcagttctctgtatggacttgcattgataaactgccaatgaaaagttgaaagctgataaaaggacgaagcagtccgttttaagcggctgtatcccataatccactgcgggatgattccttcttgtttgaagccctctgtccgcttttgaaagacatctggagcgatagtggcgcattgatattcaacagcaagcatatgctccttgattcttgccatgacgtccggtctttggttgattgtccttatatacggctccaatattggtgaagcccgttgcgttttcagccatacatacagctgtctttttccttctaagtggtaggcgctttccggctcgatgtctatggcgcaggacttgttctgtttatgggcaaaatgcggcgctttttgaagtccgagcttcacagctagctctcccccgcataccggacagaagaaccgtctccgctttaatttctggttttgctgagcgcctagaaggtgaaacatttggccgtcttcagtcacagcactaaacaattgtcatctctcctttccagatgaagtatactttctggaaaagatgatcaactcctgttcgctgtattttctgcttgtctatatgtttttgatttttcacatctctaaaatggcattttcgtgcataaaaaaaaccgatttccggaaggaaatcggtttgctatgatgcaaagtgtttttttatcgtttctagagcatgctctgaaataatcagcttgccgtactcttcaagacggtgtatgctgattgaggattcagttgcgtactccagcaggatgcttagctgattttcaacctcttcatcagtcatattgcaaaaatctacatataaataatatcggttctcaaacgaatataaagtcgttttgcttccgttaacgttcaatttagatagagaaataacatcctcaaaatcgccaaatcgcaagacaaattgaagcttttgctccttctcttcctgattgacggcttgctcttctttctggaaatcatccagcaaggcgtcaagatcctcagatgctggttcttgctttttatcctcaggaatcggcagttcgagcttttgtccgtctttggaaagctgggcttttgtgacgatgatttctaatcctttgtccagtgcctgaacttgaatccaaagtgggccttccacagcgaattcctcttcttcatgaacttcatccatgacttcccagaaaagttcttcactgcgctcacggttataccaaatttcttctctgtcaaaaccgcgatcttcaatatctccgtaagacatataaaattttactgtatgctcgttaattctttcaatttccatttgccaaccttcccttctatataagatgttgaagggacatctaagctcccgattaattgtactttactacactttacccattccgtccacatcttaaccttaaccaaggccagtgtgaattcctttgtatttctattttatgataaaacagtcacaaaagaaataaaaatgcacctttgcctaaaaaacggcagatcaggcggctgatatcataaaatatgacctgtctcatatagtagtagtacaagcgaaggactgaaagcgaggtgccgcttcatggagcatgactatctgatttctctgctcgtcattgttgggattgacctgatcctcggcggagataacgcggttgttattgccatggccagcagacatttgccggacaagcaaagacagcaagccattattctcggaacatttattgccgttgccatgagaatcggattaacaagtgcagcagtatatcttttgaacattccgttcttgcagtgcgccggcggaattttcctgctgtatttaggatatcagctgctgattgaaaaaaaagacacgaaacacattaaaagcagcacctccctgtggagagcgatacgaacgattgtgcttgcagatctctttatgtcgctggacaacgtcatcgcagttgcgggagcttcacacggtgagttttctctcgttgttataggattgtgtgtatcggttccggttattatttggggcagcaaactcatccatattgcactagagaaaataccgcttctgatttacgcgggaagcgggctgcttgcttatactggcggagaaatgattgtcagagacaaaaagctgtcgctttttatggcgcagcacggcacagtcgaaacgctcctccccattttgacggttgcgtttgtcatccttgcgagcatttattaccagcaggttgaaaaataaaagaaggctgatgactcagccttcttttgatgatacgatctattagtttgccaaacgctgtgcttctcttaattggaaagagcgaacttttcttggcaggaaacgtctgatttcgtcttcgttatatccgacctgcaaacgtttttcgtcaatgatgatcggacggcgaagcaaacctggatgctcgttgatcaagcggtacaaatcttgcagcggcatagattcaacgttcacattcagtttttggaatacttttgaacgggttgagatgatttcatctgttccgtcctcagtcattcgaagaatttgttttatttcatcaattgataaaggttcagagaaaatgtttctttctacaaatggaatctcgtgctcctcgagccacgctctcgcctttctgcatgaagtacagcttggtgatgtgtatagtgtaaccattcatcttcactcctctaattagtaggatgaacatctattttattcttaaattgaaattactctaaaaaaggaatctttacaggtattatactataaaaaagtaagtgtgaacagtatcctaagaaaaaaatgtgtcaatccagcaaatttttaatgttcatgatatgttcttattctcaattagcttaactgatcgaaaatattttttgtttttcttcatcgatgatttccaagacctcatccgttttttcgtacgattctccgtaccatttctcatctttataagtatgaatgttttcatatgtctgtttcatggcttcaagaatttcttcttctgattctgtttttggtgaccagtacagaatctccatcttgtttacttcattcgtagccaatgaccggcgccggtacccaattgactgagcatgcttgaaatgctctctttgataaaacctcaggcgtttttctgtatcagtatcatcttcatccacaggttccacctcgagcaatatgggcttatttttctttttcagcttcgcgatcaatttgccgccaagcccctgccctcttgcatccttagacacatacagataatcaacgaagataaaagaatcgaattccgcaaacattaaaatatgatgtttgccttcatctttatgataaatatcgcttcgctctttcagaagagcttccatatgcgcttttgatttcatttcttcaattggaaagtactcgctaagcttttcataccagttcattgatttgctccttatgagttcgttgtcttcatacttttagatataccccatttcttcttgtttaaacagccttacatctataaagacgtgcgaacttccgccatggtttcattttttttcagcaaaacggagccagctgctccgttcattttgaagtgtttctcattgaactcgattttctcgcctgtaatgaaccagacggggctgcgccagtgcaatcagaaatgtcatgatatataatgcagcagccgcgataaaagctattttcgcaccagcagcatcagccactagccccataatggagtaggtgacgcctgaccaaggagtcaaaatcgcattttttgcagccatgattccgattcgtttctgctcgggaataacttcctgcagcatggtttcctggcaaatatcacgcacctgataaaaaggccccattgcagcacaagccagagcgcataaaaatgggactggagaaaatgaaaacaaaagggtcagcgccgacattacaagcgagctgaacataatggcatagcccatattccgctcaaaaaaagaagaaaaacgaatagcaatcacactgccgacaattgcgcctataaaataggaagcgttaaacatcccccaccacacctctgtttcatgcaaaacagccgcagtaaatgcgaggagaatagcagatgaccatacggaacccgccaaagcttctaacatgtccattacagtaatgtctcttacaatagggatgatcattaaatccttccatatacttctgacagatgctgtttcagcagttcctgcagcctcttcttcatttacatgcagcacactgatggaagctcccgatagaacaaacaggcaaatggcagcgccgacaacgagttcaaaagggacggcgtacgtcagaaggcctccaaggccccagcctgctgttaagaacaattgattcgagagggagatcacaccattcgcttttacatattgcttctttggaacaataatcggcagcagcgcaaatcttgccggctgaaaaaaagcgcccgcgaaggaaaaacaaaacacaaacagcagcgtaatccaaaagaatgcctgtccgtgatgagtgacgctgtatgccatcagtataataaagaccgctctcagcagattcgctcccgcaagcacctttttaaaaccgagaatgcgaagcaccggagagacgcaaaagcttgctgctatactcgcaaacgacatgaacgataaaataaggcccgccaaaaaaacggagtcagtcatttgatagatccggaccattaaaacgattgtgacgaggactcctgctaaagattgaaaagattgagacagcaatagcgcaaaaacatttttgttatgcagaaattgaatcgtatttcgcctccgctttttcctctaattgtaaatgttatcattctcactttctatgaagacgcaaaaaaatccttcaagagaaatctcttgaaggattgatgaatcatgaaaaagctttaaattcggcttccgtgcacatcacaaaatgtcccggtttgacttcacggaattccatcgtttccccatcctttaattgatggacagacggatcatatttctggcgaacgcgatttctctcatagtccggatcaggaagcggaatcgcagaaagcaatgattttgtatatgggtgaagcggattttcataaagctcatctgccggcgcaagctcaaccagtttcccgaaatacatgacgccaatgcggtcactgatgtatttgaccatcgataaatcgtgggcaataaacaggtatgtgagccctttttctttttgcagttctttcattaaattcacgacctgcgcttgaatggatacatccaaagcggaaatcggctcatccgcgataatgaattccggatcaacagcaagcgctctggcaatcccgattctttggcgctggccgccggaaaattcatgaggatagcggttcgcgtgttccttgttcaatcccactgtttccaatagttcatgaactcgctgcatccgctcttttttcgtttttgccagcttatgaatatcaaggccttcagcaataatatcagcaactgtcattctcggattcagggatgcataggggtcttggaaaatcatctgcattttgcggttgaattccagcagctttttccgcgattttctcccgtgcacattttcgccgttgaacagcacctcaccatcggttgcttcgtacagcctgataatgcttcggcctgttgtcgatttaccgcagccagattcaccaaccagccctaatgtttcacctttatagatatcaaatgataaatcatctacagccttaaccgttcccctcggcgtgacaaagtgctgttttaaatgtttgatttctaatagtttttcagtcaattcattcaccttctctcactaagacaggtttttcaaacgtgtttgccagtttacgcattttcgcttttaccgcttcaggcggctctacctttggcgcgtcaggatgaagcagccacgattttacataatgagtatcggataccttaaacattggcggctcctgttcaaaatcgattttcatcgcgtaagagctccgcagggcaaaagcatctccttttggcgggtttgtcaaatcaggcggcgtgcccggaattgcagtcagctcttcctctcctgaactttccagtgtcggcatggatgcaagaagcccccaagtgtacggatgtctcgggtcgtagaagatttcgtctaccgtaccagtttctacaatctgtcccgcgtacatgacagcgacccggtcagcaacgttagccacaacaccaagatcgtgtgtgataaagatgatggacgtgtcaattttcttttgcaaatccttcattaattccaaaatttgcgcttgaatcgttacatcaagagcagttgtcggctcatcggcgatcagaagtttcggattcgctgcaagcgccatggcaatgacaaccctctgtctcatcccgcctgaaaattcatgcggaaattggttcacccgcttttccggcattgggataccgactaattccagcagttcaaccgcgcgttttttagccgcttccttcgagatcttttcgtgtttaaaaagcacttccgtaatttgtttaccgaccttcatcgttggatttaaagaggtcatcggatcttggaatatcatgccgatctcttttccccggacattttgcatttctttttcggacagcggcaccagatcctttccttcaaacaggatctcaccgcgtttgaaataacccggaggcattggaatcagcttcataatcgcttgagaggttacactttttccggaacctgattctccaacaatggccagcgtctcccctttatccagatggaaattcactccgcggatcgcctggacctctccgccatatgttttaaatgaaattgctaaatcttttacttctaataggcgtgtcacccgtatcactcccttatttacgtaacttaggatccaatgcgtctcttaatccgtcgccgacaacgttaaaaccaaacattgtaatgcagataaatccggcagggaagaataaacgccacggataataggtcaatgcaggcaatccgtcagaagccatcgttccccagcttgccagcggagccggaacaccaagtcccaaatagcttaaaaaggcttctgtaaaaatcgcagtaggaactgtcagtgtcatcgtgaccaaaatagaacccattgcgtttggcacgatatgtttaaatagaagacgggatgtttttgcacccagtgtctgtgaagcaagcacatactcctgattcttcagctgcagcacttgtccgcgcacgattctggccatattaatccagcctgtaatcgtcatggcaataataatcgtaaatagacctttcggaagaacaaccatcagtaagataaccattaataatgaaggaactgcccaaaggatatcagcgatacgcatcatgatttcatctgttcttcctccgcggaagcctgaaatgctcccccaaatgacgccgatcagcaaatcgagaacagcagctgcaacaccgataaagattgagattcgcgcccctacccatgtacggacgaaaatgtcccgtccaagatcatctgttccgaaccagtgatcttttgaaggcggcttatccgcatttaagagattagtagttgaataatcataccttgagaacatcggcgcaaaaattgccataaggataataagtacgataatgataagcccgaccattgcaagcttattgctgcggaagcgaagcatcgcatctttccagagggaaaggctctttttacttattttttctgcatcgccggcattcgctgcggctggttcaaacatgttttttggaatgttctgcatggcctaggctcctttctttgctttggaaagcttgattcttggatcaataatgccgtataacacatctacgattaatacacacaatagcaagatgacactgaagaacaccgttacacccataatgaccgtataatcacggtttgtaatactgttgacgaagtgtgcaccaagccccggaatcccaaaaatggtttcaataatgaagctccccgttaagacctgtgcggccatcgggcccatatatgtaacaaccggcaaaagtgcgtttcgaatggcgtgccgcactgtaaccgctgggcgggaaagccctttcgctttcgctgtgcggatataatcactgtttaacacttcgatcatgcttgaacgggaaagtctggcaataaacgccatcggcatggaagcaagtgcgatggaaggcaaaaaggtgtatgcccaggaatcccaccccgcgaccggaaacagcccaagcttcatggagaacacatattgcagaacagccgccatgataaagctcggaaccgaaataccaaatatcgttaaaatcgcgacggtataatcctgccacttattatggtaaagggctgcaatgaccccaaacaatacacctaacgctaaagcgaggagaatagcttctgctccaagagtaaatgaaacggggaaacctgaactgatcaggtcgttaacactctgacctttatatttaaatgacggtccgaaatcccacattgcaactgatttcaaataactgacatattgtacaaacagcggcttgtccaagccataatgcgcatttaaatttgcttcaatttcaggcggaagctttttctcacctgaaaatggcccgcccggtgctgcttgcattaagaagaatgtcacagttacaatcacaaatagtgtgataatcatatagactaagcgtcttccgatatattttagcaagggggaacacctccatggtttttacatttttatactccatcagtaagaaaggtatatggggcttttctccccatataccttgaggtcttttattttcagacgtagccttatttaaaatatgcgtttctgaaataaacctcaccagtacctggcatgataacaccttttaggttttcatcctgtacccaagtatcagtatagaaatagattggggcaaccggcatttcatcaatgaaaataccttctgcttttttcagcagctctgcacgttttgttttatctgtttcagtttgtgactgattcagaagctttttgaattctggattttcccagcctgtatcgttatttcctccgtttttgtcgcggaacaattcaaggaagttgataggatcattgaagtcgccgagccagcccatacggccgatttgataatcttggctgtggagcttatcaatatagacattccactctgagttatcaagctcaacatcaacgcctaaatttttcttccacatttcttgtactgcttgagcgattttcgcgtgtgcgtcatcagtgttgtaagacaatttgatttttggcaaatcagatgccttgcttaagcccatttcttttaggcctttttcaaggtattcttttgctgttttgacatcattgtctttgaagtatccttctttgttatcctcaaatcccttcattgtaggcggcactgcagccattgccgggatttgctctccttgcgtaacgtttttaacaatcgactgacggtcaagcgaatatgttaaagctttacggatattgacgttgtctaatggcttagcttcagtgttgaatttgtaccaatacactcctgcaatcggctcaacatgtaaagaaccgtcttttttcagggtcggcagggattctgtcggaagctgtccgagcggcataccggcccaatcaagttcgccagcttggaatttttttagttccgtattgttattgttgatcataaccatatcgattttcttcagtttgactttgtctttatcccaatactggtcatttttttcgagagtaatagagccgctgtgtttccatgccgtcattttgaacggcccgtttgatacataatcatctccggcatttgtattccactttttatttttctctgcaattttcttattgatcggcatatacgtatagaacgcagttaattcagtgaaatatggagtcgggttatttaattcaaccttcagcgttttgtcattcacagcttttactgccacatcgtctaggctgccttttccggtattcgccgcttcagcaccttttatgtagtagagctggtaagcgtattgtgattcattattagggtcaagcgcccatttccaagcatattcaaaatcttgtgcagttacagggtctccattagaccatttcacaccatcacgaatggtaaatgtatatgtctttccgtccttgctcgtttcaattttagaagccatgccttcttcaggctcaccatctgcattgatacgtgtcaatccttcaaaagtctgacggataacaccgcctgatactgaatcatttgccaatcccggatgtaaggagaacggctcagttttaatattaatgttaagtgtcgtctttcctttactgtcctttttcccttcaccgtttgatccgctgccgccaaagccgcacgcgctcagcacgagagtgaaaatgagcatcaacgtgacaatcgaccaacgttttttcatattcgcaaaccccctaataataattttcagctccttacggctaaatcctcagaaatatcagacaaatgaacctgagtttccacaacttttattctgttccgtcttttctgattatttttgtaaaaaagctgtaacaatagagtgaacaagttcattataatgaaacaaataatttattgcaatattattttatcaatttaaaatatttaaacttcgttagtttttcttccatgaacataatatccttctaccatttaaagcataaattgattaaaaactttttcatgtgttttctgcccatattgctttttacatataatatctgcctgtttttacgctgatagcagttatcatttaaggattttacagcactcgtgttatttatattattacaattttactggaaaaaagaatgttttttcatgatgacaattggttataattgatttataatgaagcaatcaaaagaaaagcttgctatgaaaaagagtagtacacgtttcacctgtttgaagagagtctgcggtgctgggagcagataacgggcaatgtggaatggactttggagcagctgaccgaactggaaaaaagtaggctcagccggagcagtctccgttacaaacgtcagagtgattccattttaatggaataatcagggtggtaccacggttcattcgtcccttttttacaggggaagaatgagccttttttattatgttttaagaaatgaggttgatgttttcatgaaacaaacgattttttcaggcattcagccaagcggctcagtgacgctcggcaactatatcggtgcaatgaagcagtttgtcgaactgcagcatgattataacagctatttttgcatcgtcgatcagcatgcgataactgttcctcaagaccggcttgagcttagaaagaatatccgcaatctcgcggcgctttacttagctgtcggacttgatccagaaaaagcaacattgtttattcagtcagaggtccccgcacatgcgcaggccggatggatgatgcagtgtgtcgcctatatcggcgagcttgagcggatgactcaatttaaggacaaatccaaaggcaatgaagctgtcgtctccggcctgttaacatatccgccgctgatggccgctgatattctgctgtacggaacggatcttgtacctgtcggcgaggatcaaaagcagcaccttgagctgacgcggaatcttgcagaacgcttcaacaaaaaatacaacgacatctttacgattccggaagtgaaaattccaaaagtcggtgcacgtatcatgtctctgaatgatccgctgaagaaaatgagcaaatctgatccgaatcagaaagcttatattacattgctggatgagccgaagcagcttgaaaagaaaatcaaaagcgcagtaacggattctgaaggcattgtcaaatttgataaggaaaacaaaccgggcgtttccaaccttcttacaatttattcaatcctcggcaatacgacaattgaagagcttgaagcaaagtacgaaggaaaaggctacggcgagtttaaaggtgatttggcagaagtcgtagtgaacgcattaaaaccgatccaggaccgctattacgagctgatagaatctgaagaattagaccggattcttgatgaaggcgcggaacgagcgaatcggacagcaaacaaaatgctgaaaaaaatggagaatgccatgggtcttggaagaaaaagacgctaatcaaaaaaccgctctttgcaaagagcggtttttttcagttgacctttgattcgttttccatttcccaaagcttttcgaaaaaaggctgtccttttattaggttttcgcaaaaagctaggtgtttgtccgaccagccttcaattgtttcgttatacagcatgtcccaaatctcttcaaagctcatccttttgatttgttcatacatatgcggattccactctgtgtaccagtagccaatttccgctcggtttttcagcccttttaattggtcaagcgccataaacatcagctgcttaatttgccgttcttttcttgtcagtcctctgacatgttctggtgctaatgataagatgtgatattccttggaggattccagcttctttggctcaaattcatatgtttcaggctctacatcttttaccatttcataaacgagctgctcctgtcttgggattagacggctttttctgacagggatcgtgtagccgatcgtgtcaacagctaaaatgccgattccgtctgttacgacaaaacaatactcaagctttgtccgctcatgattttttcgaatgtacgatttctgatgtacgtcttcaagcaaacctttcggaagctctgacaaatcgttttctatgtaatgaaacagtactgacggcacccttaacagcggcacctgatccaaaagctcaaccgtatcttccttgcgccattcgtgaaagtggcatacattgtagccattttcttccccttcaaaccaattgacccacacatcatgaagaaataacatctctaacccctcacttttataaaaactgttgtccacagtataggcaagggatagagaaattattccaaagagattgaggaaatctggaatcactgggtttatgtaagaatcataaaaagcagatctctttgtatattttctgactaaaggagacctgcttttttctgatttggtgatattttataacagatatgatattcatttttatttaatatttttcgggtcaagcgcatcccgcaggccatcaccgacaaagttgaagcataaaacggtcattaaaataaatagcccgggaaataacgggtaccaccatgcttgaatcattactgtgaaattctgtgcgtcttgaagcatgttcccccagctagcgattggcggctggattccaaagcccaagtagcttagcgccgattcagctagaataacagacccaactttcagcgtagctgacacgataatcggccctaacgcattgggcaggatatgagaaaaaataattttgtgcgtttttgttccaattgttttagcagcaagaacatattcccttgaacggagcgacaagaattctccccttactaatcgtgctgttgtggtccatcctgtgagacagaaaattaaaatcaatttgtccacacccggcttgaagatggtgaccagcgtgatcaacaagaaaatatcaggaatggataacacaatgtcaactacacgcataatgacagcatccactattcctctgaaatatccggctaatgctcctaaaaccgttccgatcaaaatcgaaccgactacggacgcaaatccaaccaataaagagacacgcgctccatataggatccggctgaaaatatcacgtccaaatttatccgttcccatcagatgttcaaggcccggcgccttatatttatcaagcaggctttgctgctcttggggataaggtgcaattaaaggggcgaaaacagcagacataataatgataaaaagaataacggcacctaaaatggccagtttgtttttcgagaatttttcccagaaaatctttgtcattgtttctggctttttcgaaatattttctttcagcctgatctccggcgagggagttgtttgcagctctgacatctctgtttccctccttttaatattcgatccgcggatcaacaatcgcgtaaaggatgtctgcaatgaggtttccgacaacgacaagaaccgccgagatcacagtcattgccatgataaccggataatcgcgctggaatgctgaatcgacaaacagctttcctaatcccggccaagtgaaaatttgttcgacaacgacagatccgccgataaatgaaggaatcatcaaaccgaaaattgtaatgacgggtaataatgcattcctcaatccatgtttaaatagcactctgttctctttaaatccttttgctctcgctgtgcgaatataatcttgatttaatacatcaagcatattggatctcgtgtatctcgtcagtccggccatgtcagctgtagctagaacgaatgcaggcagaattaaatgatgaatccggtcaaatatattgaattcggtattcagtgtctcgacacccccagttggaaaccagccgagatttaccgataacaccataatcaaaattaatccaaaccaaaagtttggaatagccaggcctataaacgaggtaaatgtaatgccatagtcgatttttgaatacggccgctttgccgacaggacaccgaacggaatagaaatcataagagccaaaatcgttgaaaccagcatcagcaggagcgtattgggtagtcttgccataatcaattctgaaacaggcgttccttttctgacaatagacgttccgaaatcaccctgcaccatgttgcctagccactttaaatattgaacgtactgaggatcattcagaccgtatttttcaataaactgctctctgtcagcctggctgattttcgggtccatcattaatgtcatcggatctccgggcgcggctttcatgataacaaatgataaaatcgtaattcccaataaaatcgggatagacattaaggttcttctgataatatatgcagccatatacttgtccccctttactttccttattaaaaacagaagagggagaaaacgctctccctcccctttaagggaaatttattttgcaagccaccatttttcaatattatacaaatcacgtttcggatgatatttgtatccttcaagattttccggcattgccatatggttgttaggataatacaagaacgtatacggctgatcttccgcaattttttgatagatttgctcatattcttttgaatactgctttctgtcactgattgattttgcatctttcatgagtttatccgcttcggcatttttataccaaacgtagttcaaaccctttttaatctggcttgaatggaaaatatcatattgatccgggaatgtggataaactccatcccatgaccattgcatcaaaatcccaattcggaggattcatttgttcaacgagagcgctccattcaacgatctgggttttcacttcaatgccgatttttttcagctgttcctgaacgacgacagcgatgtcttcacggactttgtttccttggttcgttttaagggtaaacgagaatttctttccgtctttatccagaatgccgtcaccgttcgtatctttccagccggcttctgcaagcatctgtttcgcttttttctcgttgtactcaaatttcggaacatctatatctttaggatagttccaagataaagggctttccggaatgtaagctacctcgccgtctccatctaatacttggctgacgattgactcgcggtcaagagcggttgttagcgcttgacgaacctttttatccttgaataattcatttttttcattccacccgatgtacacataacttaatgccaaatcagtaacgatttttaggttgttgaatttttcagccgttttgtagtcagtggcgggcacattaaagaaattaatatcgcctgcctgcagctgagcaacggcagcatttgcgtcaggaatgactttatacgtcacagtatctaaatacggtcttccttcaaagtaatcatcattcgcttcgagcttaatatattggccctgcttccattccttaaacttaaatggtcctgaaccgattggtttctttctgttaaactcattttcttctaaatcagcaatcggaacattaccgagaatatgtttcggcagaatagctgtgctgtctaacgcattgttgtagaaattaccgtctttatatttcagcttaaacaagacttcgtaatcgccttttttttctacggatttcagcatttcatatgttgaaccgcgttctcccttgtaatctttgcttaaagggacactgtacgtaaatacgacgtcgtctgcagtcagttcttttccgtcatgaaacttaacgccttttttaattttcacatcatatgcaaggccgccgtctaattctttaatgctttcagcgagtgacaatttcacatttagtttttcatccgttttcgttaaaaagctgtacagcatattttcaatatccgtacttgcgtcatcggtagaatacagagagttaaaaagtgtgggttctccgattgaaccaacaaccaaatccccgccttgctgcggtttgcctgctgattttttcgcgctgctgttgcttgattttgatcccgagcaggctgataaaaagatggccagaaccatcaatacacttagcatcatcagtgcggttttccgtcttttcattagatattccccctcttgaaatgttcgttcttctaggctgttgtttatgtagtgtgcataccccctctcaaagctgtgcgggcaacattagctataaaggtgacaagccacaaagtggctgggagcagcttctttaaattctggtatttgttccttgcatatcggttttgcaacaggacatcttgtgtggaatacgcagccttttggcgggttggccggactaggcagttctcccttcaggacaatgcgttcacgtttgacagaacctctttttcttgtaaccggaacggaggataaaagcgcttgggtatatgggtgaagcgggttgtcataaagctcatgcttgccggtcagttccatcattttgccaagatacattactccgactctgtcgctgatatggcggacgacactcagatcatgagagataaatagatacgtaagattaaattcttcctgtaattcctccatcaagttaatcacttgggcctgaatggatacatcaagtgcggaaaccggctcatctgcaatgatcagctctggattcaaagtgagtgctctggcaatgccgatccgctgacgctggccgcctgaaaactcatggggataacggccggcaaacgacgggtgaagccctactcttgcaagcagctcttcaactttttcgtttcgttcacgcatggtatacatgttgtgcgtattaaacggctcctttatgatggaacgcagggtctttctcgggtttaacgaagcaaatggatcttggaaaaccatttgaatatttttgcggacactcttccgcagcttctcctctgacagattggaaatatcctgccctttaaaaagaatttggccctctgtcggtttgtacagtctgatcatcgttctgccggcagtcgattttccgcagcccgactctccaacgattccgagtgtttctcctttttttaacgaaaatgaaacaccatccaccgcttttacatcaccgacttttctttgaaaaaggcctgaccggatcggaaagtatttttttacgtcacgaagctctaagattgtttcttgattagctgctgtcatgattgttcggcaccctcttcctcatataaaaagcatctcaccgttcttccgcttttgtgtgtcaaaagcgaaggctgatttgtccagcacttatccatagctttcgggcaccttggggcaaaacggcaccccggcggcagattatccggtgtaggcacactgcctttaatcgcatttaatttatcaatctctccatctataacaggaattgacgtaagcaggccttctgtatacggatgaagcggttctaaaaataagtcatcaacagtggcgttttctacgacttgtccgcagtacatgacaatcactctatcggcagcttcagacacgacacctaagtcgtgtgtgatgagaagaatcgatgtattgaacttctgacagagatctttcatgagctccagcacctgggcttgtattgtcacgtccagcgctgtcgttggttcatcagcaatgagcagtttaggattacagctcagtgcgatggcaatcatcaccctctgtctcataccgccggacagccgatgcgggtactccttcataatttgctccgcccgggagaaaccgaccatctgcaagagttcaacagctcgttgacgggcttcttttttcttcatgtttttatggtaaatcagcacttcggtaatttgttctccgattgttaacaccggattaagggaggtcattggttcctgaaagatcatggatacttcgttaccgcggattttgcaataatcgttttcagtgaatgaggtgaggtctttgtcttcgagtttaatagagccgtccatgatttttccgcctgagctttggacgaggcccataattgataaagaagtaatgctttttccggagcccgattcacctacaagcgcgacggtttcgcctttgctgatgtgaaaatcgactccgtcaaccgcagggatcggctcctttttcctgaaaaaataagtctttaaattattcacttctaaaagtgtgctcatgctagctcccctttcccccctcttgttgtcaaacgttttcaagagaaagcaatccctttattcagaaataataaataatattgaattatcgaaaaattttatagttgtatattattacaatcattttgcaaaatcaagaattttttaggataaatgtaatattattaatgaaattccattattttatccttttaaagcattgcatccaaaaaggtctcagcaggaatggacagcccgtctgcggtgcttgccttgctggcggttaaatatttttttacaatattgaatccaactgcgtatccaagcatttttggctgatatcctttgccgaataacagttggggaaataatcgattatcccgtttgatatcccgatggggcgcaatctttttttcatataaagcctgaagctgttccggtgtataccaagtcgtccattcagccgtttgacttcggccgaacctctcataaacagcatattccgccagcccttccatgatgattgtatcaagtaatgtgacatccttttcctcttttgtcagatgacctaaccggcaaacgtgatgatactcatgcgtcataagggcagataccgacccaaaatctaaatctgacgaaagaaaaaggaacattttgtcttgaaaggcgagtcctgattttgatccgaattctaaacggattctcctgtttcgttcatcaaccggcagcgtaacaattggtacatcaggaccttgccatttgtttttgaggtactgttcttccttttggatatgtccgtaaaaacctttttccttcagcttggaaaccgtctgaataccctcttttatgtttttaaacatcccatgatgctgaagatgccccagaatgcccttccagttctttttctccgcacctgaaaaaagcgggataatgtaatgcgccaaatcatctattgaaccggccttcctgagccagctatatgtttgttctacactcatgtgatcgcctcctcttttaatcctatgcacacaaaaaaaaccggctaccctttaagggcagccggtttggcttgattatgattgatattttttaaagattaatgttgcgttgtgtccgccgaatcctaatgagttgctgagaacataattaagttcctgtctgcgggcttcatcaggcacataatccaaatcacattcttcgtcaggtgtttgaatattgattgtcggcggaatcacgccttctttaatggccaggatagagaaaatggcttcaataccgccggctgctcctaagaggtggcctgtcatcgattttgtagagcttaccgcaagtttatgcgcatgctcgccaaaaacggtcttaatcgccattgtttcgtatttgtcgttgtaatacgtgcttgtcccgtgagcattgatgtaatcaatttcttcaggtgcaatgcctgcatctttaatggcttcttgcatcgctctcgctccgccttcaccgtcttgggccggcgctgtgatatgataagcgtctccggttgagccgtagccgacaatttctccgtaaattttagcgccgcgggccagggcatgctcaagttcttcaagaacgataatccctgcaccttcccccatgacaaagccatcacggtttttatcaaacgggcggctcgctgttttcggatctggattagtagacagcgctttgttggcactaaagccggcgaatgacattcttgtcagcggcgcttctgttccgcctgtgaccatcacgtctgcatcaccgcgctgaataaccttaaacgcgtcaccgatggagttcgttcctgtagcacatgctgtaaccgtacaagagttcaccccttttgctcctaatgcaatagaaatctggcctgtcgccatgtcaggaatcatcattggcacgaaaaacgggcttacccgtcttgggccttttgttaagaagatttcaaattgagactctagtgtttcaagtcctccgataccggagcctacccaaacaccgactctcggcgcgatctcatcggtaatgttaagatctgcatcttcaaccgccattttcgcagccacaaccgcatattgtgtaaagcggtccatttttctggcttcttttttatccatataatcttcaacattaaaatcttttaattcagcggcaacttttgccggatattcttcagcgtcaacacgagtgatcggaccgattccggacacaccgttgattgcgttattccaacttgtatcgacgtcgttgccaagtggagataatgctccaagtcctgtaacaactactctttttttagtcatcttgtgtgcacctcacctttttttatcggccccagcggattgcaatggcgccccatgttagtcctccgccgaaccctaccataacgaccacatcgccgtctttgattttaccggcttccaattcttctacaagagagatcggaatggatgcggcagaagtatttccatatttatgaacagttttagacatcttttcgacaggaagctctaaacgctcgcgagcagcttccatgatacggatgttcgcctgatgcggaatcaaaaagtcgacatcctcttttgaaagtccggctttttcaatgacatttacgcatgattctcccatttggcggactgcaaatttgaaaacttctcgtccattcatgattgtatgtcgtttttcattcagatacaagtgctgaccgcctgtgccgtcggctcctagttcaaatgaaaggattcctctgtcatcactgactggcccgactaccgcagcgcctgctccgtctccaaacagaacggctgtattgcggtcttcccagtcggtaatgcttgagagcttctctacaccaacaactagaacatgcttgtaggttccggattcaataaattgtttaccggttacaaccccgtacatgaagcccgcacaagccgcgctgatatccatagcacacgctttcttcgcgccgagttgttcttgaatcatacaagagaccgtagggaatgactgatcaggtgtaacagttgcaaccaagatcatatccagatcctcagcagccacttcagcttgttccagcgcatttttcgctgctgcaacagccatatgtgatgaaaacacatcatctgctgcgattcttctttcttctattcctgttcttgtacgaatccactcgtcagaagtttcaaccattttttcaagatcatgatttgttaaaaccttctcaggaatgtaacgtccaacaccaagtattccagctttcattagggaagactcctttatatcttaaatttagaagatcaatcaggttgtgatcaattattagtatcaggtactaattctatcctattttttttcacatggcaatatattcgtctaaactatcagttcatcttactcatagagtatggtatatggaaaggaggcgtatgcagttggatgtgttttcaagaatgatgttcggcgatgcagcaaaaccaacagaagagaaggaggaggaacagcaagaggaagtttctcaggtttctcagacaaacgacgaagagacgattaattacatgcatattatggaccaaatcggttcaattatgaactctcttgatcaaatcaagcccgctttaaaggagcttgcgcccatgctctccgctattaaaaagaaaatcatgtgaaaagccactttcaaaaaagtggcttcttcttattctgtttcagatttagcgtcagacttgccaagctcataagcttccgccattaccgttgtaaatagattcataaacggctggatggcctccattgagagctcaatgcctgatttctcaagctgttctttcgcttcagggagatatttcatggcaatttgcaagaattcaagtgatttttcgtgctgcatgtgacgtcactccattactcgttttttggcagctcgcctgttttgttgtatgttttgatcagcttggcgattctttgctgaaagtcttgatcgacgagcgggctgaatgttcccatctcaacgactcccgtgttcaggtcgtagtaatgatcgccgccctcaagggtgcctttattaaattgttcagcaatgatttcataggccttgtccacattttgcaccgtgctggttaatacggtattctcgcccagatccgattgatctgtgacgtagcctatggcataaagaccgtcttttttgatttgctgaataacaggaacattatacccgtctccggcgggatacacaacatccgcgccttcgttcttcattttctgataaagctttactgctgttgtatcatcatcccaatgatccgtatatttcgtatttacctctatatccggattttcatacttggcccctttgataaaaccgtcaacctcaggctgccacgtaaaggaagcaattacaccgacctgattcgttttcgacatatgggcagcagtcattcctccaaaaaagcccattgcttccccgctaaaatggacacttgttacattatcagctttcgctttcgcattggaaatgacgaattccatatctggataatcttcgccgaccaagttaaacacctcagcatattcactcccatggccgtagagcagattgacgcccctcttatgaaaatcctcaatcgcatttatgatatcttcttctgttttaacgccttctttataatagacgtccacattgtatttggattgtatattcagtaatcctttatacccttttgtgccccatacgaggtcattaatcgtatcaggaaagagcatgccgaccttctcaatttttcctttgaacggagtttgtccacatccactcaataaaaggaggacagaaaagatcatgacaagccttgtgatcaagtcatgttcaactccttttgacaagctataacatgtattatttttatacgtttattgtatctagaaaactcgaaacatggaaggtttttcttaatatttgtcgaaaattgatgaaaattgtcttttccactcgataatttttgtttttgcttcttcttttgaggttttctctgtgacttgcaattcaaaaagctgatctttgctatgacggcttggttctaacaggaatctcagcaactcgtcagccacgtcgtttgtgtaatagccgtcttcctctgtttcttctttccatggcccgtacattttcggcaggatcacggttttttccgagcctgttttttcacgtttatcccattcttttcggtcttcttcatatactaaaatataaggagaatcatattggtctaaaggcaaaaaacttccgaactggatacaaattgtatcataattttggtctccaatgtgttcaagctggcgaaagagttcatttctcccaagccacatgagtctttcttctaagtacatttgtctcattttatcttctgtttccgccagaacaacgtcaacatgtatgccttcatccatcattcgctcacataatgaaaggccgaaaaattcgtccgcacctacaatcagcgttgattccattgcatctgccgcccttccggtttttcatttcccaaaacaaaacagcctccgcaaaagagaaggctgttgtcattatattctctataattctttttcatgactatgaaagaatttgcaaattgatgcataaattctgcttggatgctcaaataaatgaaatgtcatgtcgaccggtgagccttgcttttgctgtttttccttgaaaacttccgcatgtacgctgtagggatatggagctccggtcatacgctgccatatatgaaccggtacgccgctcgggtagctttgaattgttttataacgaatcgcttccgcttctttttcagaaattccgtagcttttcgatacttctttcaaaaattgcttatagaaaaatttattttctttttccgattcataatgtgcctgaagatcgagacaaggattcaacattgcggctgagcggatatgatccggggaaaaacgaagcagttcatcggccacgagagcacccatgccttctgctaaaatatgaatcttcggattgaggatttcctgcttcagcacagaatgtatcagctgtttggcataggtgactgctttttccgccccccaatgccttccgaacagattgctgttaaaaagagtgtatccttcattcatcaacatgctcagaagctgatttctgccataatgctgctgccaaaagcttgaatcatgtccgacaaagtgggttctgtcccccaagataaagatgccgaagccgttcgggcgatagggcagatgaatgacattatgctccgttcccagttgaaagtatctttccgttattcccatcgcttgcccgcctcctttcacacttcatctcacgctatcttatgtaaatagaaaagaaacgaataaggtaaagtcctagccttttacatttttggctattatactgattgacgttttatattttaccattaaagtgtgacgaatcagactcttttgtcacctcactttctgctaaaattggattcccccttcgctttttgtatggtatgataacttttagaatagaatgagaaggacgaggtggaaacgtgcgatatattattgcctttatttggacgttccttttatcacatatggcatgctacttggttgcaagcatgaacagcgttacgtataatttcaaaacatcatctgtcattgctgttgtactgtatgtcttaatcatggttttagcagaaatcatgcctatgaacaaaaatgcaagccagcattaaaaagccaaaaacccaaaacatttattgttttgggttttttagtggtcacggctttcttttgtaggtccacagccggttgtggtttgatgtttcggggaacatttcccctgctgacagatggaccttttgagggtttttaaccatgctccctgtctcgccgatttctacgtagacaccgttattaggcgctttctgtccgggccggaattggtgctgctgtcccactgtttttcctccttttcctttttgctgtagtatgcgcctaagcggctgtgaatatgttgccatcaaaaaaactgctgagtttggctcagcagttttttgatgattcccctttatataaaatggccttcagcagtgctttttgcacatgaagacggttttccgcctgctggaacactgcagagttcggcccgtcaataatctccgcagtcacttcttcctcgcgatgcgcagggagacaatgtaaaaatgtatagtcaggcttggcatggctgaccagcgccgcattcacctgataaggcgcaaagacagcaagacgttcttgctcttccgcttcctgccccatgcttgtaaacacatcagaataaatcacgtccgcgtcttttacagcttcaatcggatcatctgtcagcgtgacagaagagccggattgaagtgcatatgtctttgccgcttcagctgcttcatctaacacttcatatccctttggtgaagcgatcgagatatcacagcccattttcgcgcagccgatcatcaaggagtgcgccacgttatttccgtcaccgatgtacgcgacttttacgcctttaagcttcccttttatctccttaatcgtcaagagatccgccagcgcctggcatgggtggtatttatcggtaagtccattgatcaccggaatgtcagcttctttggcaagttcctccaccttttcatgttcaaaggtccggatcatgatggcatccacatagcctgacagcacttttgccgtatcagcgacagtctcaccgcgccccagctgcagatctttctggcttagaaagagggcgctcccgcccagctgcgccatgcccgcttcaaatgaaacacgggtccgcgttgatgatttttcaaaaatcatcgccaaggttttgccatggaatataggctgaattttgttttgtttcagctcaccggcttctgcgagcaaggcgtttatatcttcttcactaaggtcctttaacgttaataaatcttttccgtataaactggtttgcgtcactgtgtgcatgatgccacttcctttttatagaggtctttgagagatacaggctgcggatggcctgaaccgctttgtaaaaacgcccgcacagtttcttcttctgtaaagacggggatgccgtgcgtcatggcttccaaacgttctttgcgtgcttcttcagaaccgctcagattaatgtggagcgagtttccttcctgttccatccatgaggcaaatgttccttcatgtattgtaaaacctgcgttttctgctaactccttcacatcttccggaacgttttgcaaataaatgcttcctttttgactccagactcttgtatagatttttttcaaggcgctgttagaatcatatgcgacacacatgccttctcccgttgatttcatttccggtccaagcttgacatccacatcctggatcgcatgagaagaaaaaacagggaacttcacggcaactccatgatgattttgaactgccggatttagatcttttaaggacgctcccgccagcagacgtgtggcgagcggaatcatcggaacgcccattactttgctgacgacaggaaccgtgcggctcgctctcggattcacttcaagaacgagtatgtttccattgtcgatcacaaattgaatgttcatgatgcctttaaatgaaagttttcgggcaattttttgtgccgcatctttcatgccctgctgcagcccgctcgtgatggacggtccgggaagaatggcaaaactgtcccctgaatggacacctgcccgttcaatatgctcggtatatgtcgggataaagacttcctcgccgtcggaaatcaaatcaatttcgacttcctttccagacacatactgatcaattaaaatcgggtatggcatgctgtcctcatcattcagcagctgagaaagctgggcttgcgagtcaacaatgatcatgcccattccgccgataacgtaagatgggcggattaacaccggatagccgatctcactcgcttttgaagcggcttcttcttttgtataagcaatttctccttttgcgtgcttcaatcccagctcgtcaagaagctgataaaattgatcccgatcctctaacacgtcgagcgtttgaaatgatgtgccaagaagagtaatgccggctttttcgagcgcttcagcagcattgattgcagtttgaccgccaaattgcacaattgcaaaatcaatattttcctgctccgccacgtttacaatatgctccgttgtcatcggttcaaaatacaggcggtccgcaatttcataatcggtgctgacagtttccgggttattgttaatcatgatggtttcgaacccaagctcttgcagtgtcagcacaccgtgaacagcactgtaatcaaattcaacgccttggccgatccgaatcgggcctgatccgataatgagcgcgcgttttttctctttgcggctgatgtctccatcggtctctccgaaatatgtggagtaaaaatagtttgttttcgcatcaaactctgccgcgcatgtatctacgattttaaaggaaggcgtaatgcccatctccttgcgaagcgcgcgcacctcttcttctgttttgctgatcagcgaggcaatcgttgcgtctgagaatcccttttcctttgctttcttcaataattcaaaagagagatcgctccctgcttccatcaggcggttttccaatttgatgatgttgtcaaaggtatgaaggaaaaacggatcaatttttgttttttcatggatgtcatcaatcgagacgctgcggctcaacagctccatgacaacgaaaaatctgcggtcatccggagtgattgccaaatcccatagcgtatcaattgacaacccgctgagctctggaaggtgtgtcccgatattttttaattcaagcgacgcggctgccttttgtatcgccgcttctaaattccgttcaatcgccatcacttcaccggtggctttcatttttgtgccaagcttgcggtctgcgtttttgaatttatcaaacggccagcgcggaaatttgacgatcacataatccagtgccggttcaaagcttgcgtaagtcgagcctgtgagcggatttttcagctcgtcaagagtgtatccgactgccagtttcgcggccatcttcgcaatcggataaccggtcgctttagatgcgagagccgatgaccggcttacacgcggattcacttcaatgacgtaatattgcttgctgaatggatcaagcgcgaattgaatgttgcagccgcctacaacatcaagtgctgagatgatcgtcagacttgctgtccgcagcatttgatagtcttcgtctgtcaatgtttgtgacggcgccacaacgatagagtcacctgtatgcacgccgaccggatcgatattttccatattgcagacggtaatgcatgtgttattgctgtcacgcatgacttcatattcaatttctttaaagccggcaatgcttttttcgacaaggcattgattgatcgggcttgctaatagcgcctgcttaatcatagctgtaaaggcttctttatcaggggcgattcctccgccctttccgcctaatgtgtaagctggtctgataataacaggaaaaccgatggattccgcaaaatggagggcatcggcctcgttatcaacaatttcactctccggcacaggctgttttaattcattcattaacgaacggaatttttcccggtcctctcctttttgtatcgtttcaacggatgtgccgaggagtttgacgccgtgctcttttaaaacacccgtttcttcaagctccaccgctaaattcaacgcggtctgaccgcctaaattggcaagaagcccatcaggccgttctttcttaatgatggctgtcaggctttctgctgtcagaggctcaaaataaatttcatcagcgaaggcttcatcagtcataattgtcgccggattgctgttgacgagaattacccggtagccctcctccttcagcgcgatgcacccttgagtgcctgaataatcaaattctgccgcctgcccgatgatgatcgggcctgagccaattactaatatgcttgaaatactggtgtctttaggcatgcgcgatttctctccttgctggtatcacattctttagataatcatcaaaaatccattcgctttccgcaggtccgggatgggcttccgggtggaattgaacactcatgacaggcagttttttatgggcaagcccttcaactgacgtatcattgacatgatgaaacctgatggtgagctcttcttcattaatcgactgttcatcaaccacatagctgtggttttggcttgtcataaagacccgtttcgtcttacggtcgatgaccggatgattagctcccctgtgcccgaatggcagcttaaaagtattccctccaaacgcgagcgcgatcagctgatgtccgagacaaatgcctagagtcggaaagcggctgatgatgcttttgatctttcctaaatatggctgaatggctttcggatctccaggtccgttcgatagcacaattccatcgggtttgatgttgtatacggcctccatttgctggtatggcaccacggtaaccttgcagcctcgtttgacaagtgatgatgcgattgactttttatagccaaaatcaatgagagcgatatgtttattcccgtcgccgaatgtgctgatttcctgggcggaagcctgctctgccacattctctggttgaagggcaatctcagctccttctttagaggctgtgactgtcgcacccatcgtcccgtttgcccggattttcttcacgacagccctcgtatcaacatgggttaacagcggaatattccatttctgtagatactccttgaggctgtataccgcttcataatgagaaaagtgatcacacgcctcatagacaaccgcggcttttacttgcggtttcttgctttcaaaatccttttcatttatgccgtagttgccaatcagcgggtaggtaaatacaataatctgtcccttatatgatggatctgtcagcacttcctggtagcctgtcattcctgtgaaaaaaacagcttctcccgtgcagttttcatgaccgtccagctcgccgctgaacgatgtcccatcttctaacactaaataaccttccatctaacagcccacctcttgatgaataattaattataaaaatgaatttttatgcctttatatcgaaaaaaaatcactggtttacagcggaatgatgagcgattgcctgtttcagcttgctgacggcttctgctatttcatccttagtcacggtgagcggcggcagcagccgaatcacgttcgggccggccggcaatacaagcaagcctaatgtctgcaattcagcaataatgtcagcaaccgggccatcacactcaattccaagcattaatcctttacctcggatttgtttaacaaaagggctctttagctctgcctcaagctgttcttttaaaaacgcccctttgtcagcagcctcttgcaaaaagtcaggctggaatacaatttgcaatgtggcattcacagcagccatcgccagcatgtttcctccgaaagtcgttccgtgagaaccaggggtaaacgcttctccaagctgtttctttccgatgacagcgccgaccggaaagccgtttcccaatcctttggcgactgtgatgatatccggtgagagtccgaagtgctcatatgcgaagccttttcccgtccgtccgatgccggtctggatttcatcaataatgagaagggcttgcttttccttgcaaaacgactgtacggctgataaaaattcagcactcgccggattgactcctccttctccctgcactgtttcaagcatcaccgcggcaatatcgccttcctccccaagagctttaaaagcagaaggatcattgtatggcaggtagtgaaagcctccaagcatcgggccgaagcctgttttgattttatcctgtccggtcgcagccatccctgcatacgtgcggccatggaacgactgaagaaaagtgatgatttttgtttttccagttgcttttctggcaagctttatcgcaccttcattcgcctccgcgccgctgttgcagaaaaagacaagatctcccgcactatgcgctgccagcttctgcgccgcttgctcttggagactgttttgaaacaggttggatacgtgccatacgctgtcaagctgttttttgactgcctctgtcaccgcttcatggcagtgtcctagatttgataccgcaatcccctgaatgaaatcaaggtacgttttgccgttttgatcctcaacgtacgttccctttgcttttttgatgtcaatatcccaacggccgtaggtttgaaacaagctgctcatgaaacagcctcctttgctttgacaatttttgtcccttgaaaggtttgttctgcgaagaatgatcctttaccgtttacgatcatgacttcagacacctgatctgataaagctgacaaggctgaattgaccttcgggatcatccctcctgtgatcacttcctgcttgatcagcatctgaatctccttaggggtcaggacgtccagacgctgcttttccttcatgattccatcgacatccgtgacgaacatcagcttatcggcttcaagcgctccggcgactgctgaagcagccagatcagcatttacattcagcgttttgcagtcgcttgtcatagacagcggcgcaataacggggatgatgccattttccatcagcgcgttcaccatggacgcatcgacttttttgatttctcccacttctccgtatgtttccggatctagataatcagcctccaaaagaccgccatccttaccagaaatgcccgcggctcgcagtccgtgtttggcaagctcagcaacgaaaaatttattgacagaaccggataaaaccatttccgccacttccagcaccggcttcgttgttttcctctgtccgcccgaaaactctgtcttgatatttaaccgtttcagcatatttgtgatttccggtcccccgccatgtacgattgccagcttccagcctgacgccctcagctctttcagattttgataaaattcctccgacagctcacggatgacgcttcccccgcatttaaaaacgattgttttcttcatttcgctcccctttattacgtgcgatagctcgcgttaattttgatatagtcataggtcaggtcacagccccacgctctcccgtttccgtccccttcagccatcttgatgacaatggtgatttcatctccttcaaggtattccttggcgatagattcagagaatggctgaggttcgttattcttaaacaggcattggccgccaagataaacctctacttcttctgccgtcacctgtgctgcggagtgtccgatggctccgatgatccgcccccagttggcatctgttccgtatactgccgtttttacaagatttgagccgacaatctttttggcaatgacgtttgcatcaagattgtttttcgctccctgtacttgggcttcaattagttttgtcgcgccttctccgtctctggcaatctctttagctagatcctcacaagtgagcaagagcgcttttttaaagaccggccagtctggatggtcttctgtcaggcactcgttttcggcgcagccattcgccataactaataccatgtcgttcgtggatgtttctccgtcaactgtgatttggttaaatgaaacgtcagtgatttcccgaagcgccttttgcagcgctttttcttcgattgccgcgtcagttgtcacaaatcccagcatcgtggccatgttcgggtgtatcatcccagagcctttggccgctccgccgatcgtgactgttttgccgccgattgccagttcatagcacgtctgcttgatcaccgtatcagttgttaaaatcgcttcctcaaaatcgcctgatcccgcaggtgtttctttcagcagttcgatccccgcgtggattttttccatgtctaaatgctcgccgatgacacccgttgatgaaacagcgacaagctccggctcaatgccaagctgtgaagcaaagctctcccgcattgtgtatgcgtcctttaagccctgttctcccgtgcaggcgttggcaatggcgctgttgacgatgacggctttcagtgtcggtccgtgctttaagctgtcttgtgtcactttgatcggagcagcctgaaagtggctttgggtataaactgctgcactcacggccggtgtctcgctgataatgacgccgaggtcttttttcgagtagcgcagtccgcaatgcacaccctttgcctgaaacccttttggcgaggatacatcacctgttacttttacaatttgatcttcacttaactgaatcatggttcgattctctcccgttctatggataaattggcgtgatggtgagtccagtttcttcattccagccattcatcaaattaaagttttgcactgcctgaccggcggcacccttcattaaattatcgattaccgagacgatcgtgactctgttcgttctctcatcgagggtcacggcgatatcacagaaattgctgccgtacacttctttcgtttgcgggtactgaccttttggcctcactctcacaaaatatgaatcttggtaaaattccgaatataaatcatgcaggtcatctgcggttaggtcacaggttaatctggtatacatcgtcgccatgatgccccttgtcatcggaaccaagtgagccgaaaatgtaatgggcccgagacctggctgccattcattcagcgcctgctcaatttccggcgtgtgctgatgttcattgactttataaattttaaaattgtcgttcagctcagaaaaatgagttcccatggatgcttttcttcccgctccggaaacaccggtcttcgcgtcaacgataacgaaagattcatcgagcagtttcttttgagccaatggcgcgaggccaagcaaaacagctgttggaaaacagcctggattggcaatgagtttcgcctgttgaatttgcagttgattcagttctgccagaccgtataccgcctcttgaatcaccgccttcggtgccgctgtccgtttataccatttttcatattcagccggttcttttatcctcagatcacctgacagatcaataaccgtaattcccgcgtctgccagctttggagtcaattcacttgatactccgggcggcgcagcgagaaacatgatatctatttcgtgtttgatcgtattcatatcaatcggcttcagctgctgatccgctaagccggtaagatgaggataaccctcgctatagacattcccttctccgctggatgaataaagtatgcattcctctgcatgaggatgatgcgaaagaatcctgacaagttcggtgcctccatatcctgtagcacctacaattcctattttcaaaacaagttcaccctcttggtctttgtgaaattatttaacattataacatgaataaaaattaattcaatcgtatatttaatatttttattcatttataaattttctgttcaatgggaattccgctcaaaaaaaatcagcacgactccagcacaaaaacgttgatgcggtgccgcatttcagccgcataaaaaaaccaggctgaccgcgtcagcctgttttcatcatcatcaatccactcaaaaaatatagaatagagcttgcataaaaaatcatttgcactgtgaaaaagtcagcgagaaagcccccgagcataatggctgctgctgaaaagacagctgtccaaaaatggtaattcccgatcttctttccacgctctccactgtctgtaaaattagcgatcagcactttttctccatgcttttgcatcgctccaaagagccctaacagcacttggacgatatacacttgaacgacgcttccgatatgcgggacatataaaagcagaacagccatcccccacgagttcagaagcagaaaataacggctgtcaaacctttcagacagccgtccgaggagcgggtaaataagcgctccgctcaacccgaacaatccgtaggaaaaaccgaactgtgtgtagcttgagccgatatttttcacaaacagaatataaaacggaaagattaagctgcttgcgaaaaacacgctgctttgtgataatgtcagccattttaatttgtttttccccattatttatacctctgataaaagtaattcataaagcgctcatccgggtcataggttcgttttttctgaaaaaacgcttcacttttcggatatgcctgtctcatttgcgcttttgtctggtaggtcatataaggcagataatagctgccgccgtgcttgatggcaacgtctgtcatgcgcctgatgattcgggcggtatctgcctggtcttcttttgaaaagccctcgtttattaatagtacgagcgaaaacatatcgtccttcgcataggaaaggtcggccttttcatttttctgcacgtagcggatcgtaatgttcagcaggttcagatcttcgtccgacagcgtttgtctcaggtcatcaatataggacccatactccttcacgggcacaaagtattcttgcaaaacatctgtgttgtcattgttttcatactcaagaaactttgattcggaccgcatgacgttattgcgtgaaatctctgtgccgttctggctcaggaaataggattgctgtgtgtcccacagccaattcctcccccattcataccgtcttgacaagccgagtgcaaactttgtggctcccgtatactcgtcttctttaagttcgctgtatgaggacagctgatcctgatgattagccaatacgtaattcgtgacatacatgtctttcagaaatccttttttcgctgttgaaattcgcgccagatgcattcggacatctggatttccttttacatgctttgaaaaatagtctgagtatgtgctgtaattcattttttctgtcttcatgacatacagctcatcatctgtcagctcaagcgttacatcaagaatcacgccaaaaaggccgtaccctccgatgaccgccgtaaacaaatcatcttttggagtgacagtgataatcatcccgtcagcttttaaaagccggaatgatttgactgtatcaattagcgagccgtagcgaatatcacgtccgtgtgcatttgcgctgagagatccgccgattgtaaaaatgttttgtgactgcatgacttttaccgcgagtccgtatggattcacgtatttctggatatcattccacgttgcaccgctttgcaccctgatggttttcttctcttgatcgagtgacaggattttgttgtagcccgtcatgtcgagaacgatgccgtcctcataatatgtatggccgcccatggagtgctgggccccggcgattgaaatttttatgttttttcgatttgcctctttgactgtgtcaatgagcatttcctcttcctgccctttcactgtctgctttatttttacaggcatcaggcggctgacatccgtcatctcgcttgtggctgttttttgctctgagttcacagagtacgcaaacagggccgcatacgcgccagtacaaagcgcgaatgcaagcaatttctttttcatagtgctctccctgctgtttttatgaccattataccatgactgcgtcctcatttttccaaattatcttcttgcccgtttttcggcacggcggtcggcgacgataaagcaggcgtgaatcgcgcccggcagccaaaagatacaggtcaatatgagattcagcaaggcctgaaacggttttcccgaaaacaaaacagcaagcggcgggcataaaactgccagcaggtacatcatttcctttcactcctttcagctgtaaaaaaggacagcctcacatgtcaggctgtccttttttgttttattgaatgccaagcgcaatttttgcgtatctggacattttatccctagtccaaggcggattccatacaatgtgaacctctgtgtctttcacttcaggaaggtccgctaatgcttttttcacctcatccacgataatcggcgctaaagggcatcccattgatgttagcgtcatggtgatgtgcgtcaagccatcttcatccatatcaacgtcatataccaagccgaggttcacgatatcaacgccaagctcaggatcgacaacctgttccagggcgcccatgatgttttcttttaatgcttcttccacgttccctcactccttttttctacagtataacgtaaattcagctcttgttaataacttagtgctttataagtacgtttcaaaccattcaatcgtttttaacacagctgcccgcgggactttatggtcagcgttttcatctccgataaattgcaggcgttccggctgctcgctgtaatgggatttaatcgtgtcataaaatttccgggtcggcgcgtaaggcacaactttatcttttgcgccgtgccaaaataaaagcgggcgctgttgcagtttctccggctgaaggctgagatcccgcaactcgagacgtttcatcagctgctgtaccttctcttccggcacatcgatttcaatgccctgagattgaatatggtcaatctgctgctgaaacagctccacgtaattcgggcttcccatcaggctgacgccggcttttatccaatcatatgcagtcaaagcgccaagcgttgtgatgccgcccattgacgtgcctgcgagaccgatgcggccgccgtctatcaggccctctttttcaaaatggtttttaagtacgccgatctcttcaatctcgttgaggacgatatcccaaaaatgccccgccagctcttcaacagccatttcttctccccgttccccatggtgcaaagcctccggcagaacggctctaaaacccttctccgcaagcagataagcaatatgaaggttgtgttccttcgcgcttgtaaaaccatgtataaagatcacgagaggaacagcgcggtgcctgttctcttcctttacaatatgtaaaaacggaataccggaaacggtttgattctcaatttgtatcacaatgtgcccctccttaggataaccataatcataagtgtaacatgtagacaataaagatggtaaaaagctacactgtaagtaaggcaaaacaagcaaaatctaaggttaaaggagcttttcatggagacaaaaccctatttaatcgcattagatttagatggaacattattaaaggatgataaaaccatatctgaaaacacccttcatacgatacagcgcctaaaagatgacgggcattatgtctgcatctcaacaggccgtccgtatcgttcaagttccatgtactaccagcagatggagctgacaacgccaattgtcaattttaacggagcatttgtccatcatccgcaagacgacagctggggacggtatcatacgtcactgccgcttgatgttgtcaaacagctcgtggatatcagcgagagctacaacgtacataacgtgcttgctgaagtgattgacgacgtatactttcattaccatgatgagcacctgatagatgcctttaacatgaacacaacaaatgtaacggtcggagacttgcgggaaaatctcggtgaagatgtgacgtccgtactcatacatgcaaaggaagaggatgtgccggcaatacgctcatatttatcggatgtgcatgccgaggtgatcgaccatagaagatgggccgctccttggcatgtcattgaaattatcaaaagcggcatgaataaagcggtcggcctgcagaaaatcagcgattattacggcgtgccgagggagcggatcattgcttttggagatgaggataacgatttggaaatgcttgaatttgcaggctgcggcgttgcaatgggaaatggaattgacgcggtcaagcagattgccaaccgaactacggccacaaatgaagaggacggcgtggcaaggtttttgaaagaatatttctcactttaaagaaggtccgtattaatttttcccactcataaaccttactttaccccaccatactattgaagacgactcatctcgtcaaagtatggaagggggcagtctcaaaatgggtaaacgaagcaaatccagaaggtttattcagcagggtaaagactccatcgggctacacgccgcaagatttccatatcggtctactttagaagaagctcaccagcatgccgcggcacgagactcggctgaaaggcagtatgaatattaaatgagaaatgaactgtttcagcaggcaaaatcatttgttcaacaggcggtcatggtgacaaacggctttgaggaaggcgatcaggagcaagcgattctgagagccaaaaatgctgtatcttctgcgtatgccaattcgacagatgcggaacgtcaacagttgcatcaatttcaaaatcagctggacaaactgcaataaaaaaaggctatggcgactcgccatagcctcttatttgacttcaaactgctgaacagcctgaacctgcttgagattttccgccctgcccttaaatgtcacctttacctcataggttccgggctcagggacttccttccacacatcagagaaatcatatgtttctccagattcaagcgtcaggttttgaaaagcctgcgtaaacattttttctttcgaataacggtatctttctttgtgctcagaatcatacacgacaagttcaaatttttgccctgtgctgaattgaaactcaatagcacgttcgctttggttcttcagcgacatgttaaacttgatttgttcaggctcctgaattgcgtcaatagataaaacaacctcttgattctccattccgcctgatacctccttatcgggttctgtctgctcatctttcccgcagcctatcaaaagcagcacggggaggagcatcacaagcagccgtttcacgacttccacctgctttcgtcagtcttttctaaagaaaccaaaaatccctgtcgtttgaacgatgttcgtaaatgcttttggatcaacttctttgacgatcttttctaaatcgtacagttcatacctcgtgatgacgataatcatcatttctttctgttcgttcgtaaatgctccttttgccggaacagttgtgatgccgcgcaccatttttccgtaaatggcttccttgatttcgtccgcttttttcgtcacaatcattgccgtaagcttcatgtggcgagtgtgaatggcgtcgatcaccctcgttgtcacatatagtgtaaccagggtatataatgctttctcccaaccttgcaataatcctgccgtcaagatgataatcccgttcagaatgaagaaatacgtgccgacgggtttatccttccactttgcaagtaccatggcgacgatatcaagcccgcctgtcgaagctccgtattttaatgttaagccgataccgactgcggaaatgacgccgccgaacaccgcgttcagcaaaatgtcatgtgacaggcttgtttccggcaggatccccataaacagagtagtgagtgcgacacttaaaatgctgtacactgtaaacgatttgccgaccttcagccatcctaaaataccgaccggaatgtttaagaggaacaagagcgttcccgtcgatatgtaaaagggggcatattgatcaacgacgcttgataaaagctgggcaacacctgtaaatccgctggcatatacatctgcaggtatcaaaaataagttcagcccggcagcattgagtaaagcgccgatgatgacgatgagtaatttttttgtttgatctagtaccatggcatgttcctccgctctttcttctttattatgttttcccttaaaacaaatatttgaacacgattttggcaaattaatatgatatagttggcttaactctcatgataacgagcgataacggaaagaagggaagcaatatgacagttcatctcatcgctgacagcgccactgatttgcctcgttcttattttgaagaaaaaggcattggctttattccgctcagggtttctctcggcgataaagaattcgaagatgcagtcacaattcatgcggatcaaatatttgaagcgatgcaaaatggagaaacgcctaagacgtcccaagcctcaccgcaaacgattaaaaatgtgtttttgcaatatgccgaaacaggtgatcccgctctttacattgccttttcctcaggtctctccggcacgtatcagacagctgtaatgatcgccaatgaagtgaaggaggaattccccgatttcgatttgcgggtcattgattccaaatgcgcttcattaggatacggtctggctgtccggcatgctgccgatctctgtatcaacgggaatacaatacaagaaattgaaacgtctgtaaagaacttttgcagccagcttgaacacatttttaccgttgatgatttaacatatctcgcgaggggcggccggatatccaaaacgtccgcttttgtcggcggcctgttgaatattaaaccgctgcttcagatggaggacggcaagcttgtgcctctggaaaaaattcgcggacagaagaaacttttcaaacggatcatcgagcttatgaaagagcgcggggatgattggagcaatcaaaccgtcgggattagctacgccgcgaacaaagaaaaagccacggatatgaaacacctgattgaggaagcgttcaagccgaaagaaatcattatgcatccaatcagttcagccatcggctcgcatgccggtccaggtacattggcgatattctttttaagaaaatgagcaaacaaaaacagtcagactctgtgtcctgactgtttttgtttgctcatagaatgccgacagcctcatacgccttttcgactgaagctgattgcttcgagccttcaccgtataaatcattggcagcttcaatcgccgcttgcttcatcatgctgaaatctgtagatgccgttacataatatgttaaagcccgatagtaaatttgttcacttgcttcacgcccaatcccttcaacctgtacaccgtggtgcacgcctccttctgcaagaagataagctgctttattgtgaatggacgaattgatatggactccgccataatcctctgttcctgtgtagcggttcgagtaatgatctggatttccctgcttagatgggtcctccaatgaccgcaatgaatctcctgcaataccaggagtatagacatcttcgccgatctcccaatcatcacggtcagccatcgcgcccataatgtcagaaatggactcatttaatgcaccgggttctccttgatataaaagaccggcggaatactgtgtgactgcgtgtgtgatttcatgcgcgacaatgtcgagcgatccagacagcggcttaaatttcgaaccgtctccatccccgtataccatctggacaccgttccacgcagcattgttccattgtttgccgacatgcacggtagacgtaatccttgctccgttttgatcaaaagaatcacggccaaatgtcttgctgtaataatcgtaaacggcttgcgcatttgcgtgtgcgtctacagccgcaggttcattaaatacggacgtgccgctgactatttctttgcccgtatacccgatcagttgagacaaaagcgtaaacaaggtttcgttcaggttcttcgcgtcaaatgtattgatcccttttccccttgtttcgtcagccaaataaaagcgcccattttgttctgtgacgtcaaagcttttttcatcacctgacacgccgattcctgtacctgccgcttcatgaatggcattaaaggactcgatgacctttccgtttttggcatcgatgaaataatgccaatagccaggctcaggttcagatgtcgagagtctcacaaggtaggcgagatcatattcaccgtcgtgtggatagatatataattcgccttttggttccccatcaagatattcgatttttccaatggaagcctcgagctcacgccttgctgtatgtattgcttttttctcagaaatagacggtgtgacggagacgtccttgatttgcggatgcacctttccaaagaaacttttcacttgtttgttttccttcatcgcgaccgcttgttcaaagccgtaaatcggaattcctttgtaaacctccgttaatttaaaaaacgtttgttttgtctttggatcctttatggttttcgaaacgcgaaaatggctgttcgcattccctttgagcttaaactgcgtttgatgcttgtcaagataggaaaatagcgattctttctgggttgtgttttgtaccggcttctgcggtgacttttcgatgatgtatgaaggggtttgatacgtatggtcgtattcgatgctttcttcagctgaggcatgtgttacaaaaaccatttgggccgctgtgcataagccggccagtaatagagatgtcttggtcaagttgcgcaaaacaccacatccttcctattttggaatctaccatttttcttcatcctatcaaaaatacaaaaacttgtatgtggtgcttcgttcttattttcccaaaaaagaagggcagagatatttcgctctgcccttctttttctactctactaattttttattgacataaataataacccctgctccatatgccagtataagcggaggtatgagctgctcctgaccttgaaatgagataaaactattcagcaaaatgaacaaaccggaattcaagaaaaagtagcctgctattctggccagccgatctttatcccgtatacgcgcctcgttaaacccagccaacatccaggtttgttttttgattccgacaaaataggcaaccacaaagaataaaagcgcgatgacaattaatagataattgatgctgatttccatcttacagcctcctacaagattacttgatgttaagaaaaagaaaaaaagcggcgcagcttactgcaatcagcagcaggacgacaagcgcattgaggaacgggctcaaaaggagcaccactgctaaaaacagcagataaaccgcaccgactcgcgaaatcttgacaatctccttttgagagcgcattttgttttttctgacacctgcaaacatcaccaattttttccgcttccatacatatccggcgagcaccattaaataaacagccagcggcagatgtctgaagtcggacggcagcagcggcagggcgataatcgtgacaatgagaaggaccgaaatccagcttttgcccaataaagacctcctccttttcgtctctcccccatcacccatcatcaattcggcaagctccttcggatgagaaaattcagattcaacagcttcctgcagttcctcttcactaaggccggctttgattctgtcttgaacgaaagcggtgatatgcccctttaattcgtcgatagcgttttctctctctacatcaggcatattcgccagctctgcatttagttcctccatgtatcggtcaatgataagctgtccattcatagcaaatcccccgataaagacagtaaggcttgatgggtttccaggtatttctccagccgttcttttaacatttcttctcctttttgcgtcattttgtaatactttcttttcgggccgtccagtgaatcttcccaaaaaaattcgatccatcccttctcggtcatacgtttcaaaatcggataaatcgctccctctgaaatagccagcgccgaggtggtttttaaggatgacgtcagctcataaccgtacatcggtttagaacgcagaagggataggatggccagctcgaaaatcccttttcgaaattgaacaatccagcggtcattaacttgattcgttttcatggtttaaatatatcgaaaaaaacactatatatcaatcacatatagcagtgtaaaatgtcctgtttttccttttaacaaaaatggaatttctcatactttttaaccttttattacataaatgtttttatattatgaaaagtgtaaaaacgattcttcaggttaaaaggagcagtcgaatgcagaaatcgatatcattttttgtcattttttcaatcctttggggttcgctatttctgttttctattattggcagcttagggacaaccccgattccgctgacaaaggactccaaatttctcatgtccagcatcctccctcagggctggggcttttttagcaaaaatccgcgtgatactgcaatcggcttatatgaggctgaaaatgccagcgccaaggtcagatggcccaatatgagggctgacaacctattcggcctgtatcggtatgggcggtcacaaggcgttgaaatgggcgtgatctacagccaagtcggcaaggaacagtggacagcatgtaaagaaaaggacctcggcgcatgcaaaagcaaagccaaaaccgtgcaattaaaaacacccgctccccgcccgctgctttgtggcagctactatttgacgaaagaggatattgttccttggagctattctaaatataccccttcgtcttatcaggtaaaaagcatagtcaaggttgtgatctcatgctcgaaaacataaaacagaccatcaccagatgggacgaaagaaacccgtggacaaatgtatatggcctcgcgcgaagcatcattgcgctatccagcctgctgacgctgctcatcaatcacccgagcctcattatgaagccagccagcgggatcagcagctatccagcttgtaaaatgaatctcagtctcttttgtctcggcgaaaataactatatgatgttaaatcttttcagatgggtctgcattgccattctggtgcttgttgtcattggctggcgccccagaatcaccggggttctgcattggtatgtcagttacagcctgcagtcatcgctgatcgtcatcgacggaggcgagcaggcagcagcagtcatgacctttttattgcttcccatcacgctgaccgatccgagaaaatggcattggagtacgagacctatagagggcaaaagaacacttggaaaaataacagcttttatttcttattttgtgatcagaatccaagtggcggtgctttattttcactctaccgtcgctaagctatctcagcaggaatgggtggacggaacggccgtctattatttcgcccaggaaaaaaccattggcttcaacggcttttttcaggcgttaacgaagccaattgtaacaagtccgttcgtggtgattccgacatgggggacgctgctggttcaaattgtcatcttcgcggcactgtttgcgccgaagaagcattggagattgattttgatcatcgctgtttttatgcatgagatttttgcagtcatgctgggcctcatcagtttttcgattatcatggccggcattttgatattgtatctcactcctatcgattccacgattcaatttacatatattcgcagactgttgtggaataaaaaacacaagaagggagaggtttcagtttgaagaaggcgtttctagtatttttgtcggttgtattggtgacgactgtgtttttggtgaagcagcaagaaagtgtggcacaggcaaagcagcttgagtattcaggtgaggaaatttttaaaggctttgtgtttgcccaaggggaagttggcaaacagcttccagaggtctttaataaagcgatgacagacaaactcaacacaaaacaggcaaaggcttttgccaatcaggttgtcgctgatattaaaaaagaggatgctgacttttttgataacctgaagaaagctgtttacagcaaagatgcattgaaagtggatgaactgctgaaaaaagcaggtcaaatcgttgaagaaaaagtagaagctgcaaaggaaatcgccgcttctaaggatgatacatccagagttcaggccgagcttgtcaacactgttgataccgctaactatttctattatgtttcttatgttgctgcagcaggtgccctgattctgatcattctcgccattgatattacgccgattgcgatttcagacaatgtggatcgcgaaatggcaatcagaacgctggttgatgaattaaactagacataaaaaaacggctcgctccgcagtctgctgcaggcgagccgttttcatgctattttttctcgtatgtccatccattttcctgatacacttttccgtttttcatcaaatggcccagcgcgcgtttaaaggcggctttgctcatattaaaacgttctctgatatcgtcaggctggcttttgtcactgtacggcatggcaccgtttctcattctcatatacgttagaatgcactcagcatcaactgacattgcatcctgttttctcggaagcagcgacaagttgactgaaccgtcttctttcacttgaatcacccggcctgtgactcttgaacccagtcttggctcctcttttctttctgacgggtgaataaaacagcggataccgtcatccgtgatcacgaatgaacccgatgcgatcagcctgtacaccgtacctgtcagctctttattcatcagatcttctgaagcgtcggtaaacagttcgctgatgatatcttccggcgctggtttcgcaaacatgcgcccccggttcgtcaccttcagcatacagtaaagtttgtcccctttttgcggccagacatcttcgtacggcggcaaatgctcagttgcgactagtgcgtccttcgataaaccgacatcaacgaaaacgcccatatcttccactttatccaccacttcaacccagccatattcatccgcgctgatgatcggaattttcatcgtggccgcaagcctttcctgctggtctacgtatataaagacttctacttcgtctctgtcctcgatatcctcagtcatttcactgttatgtaagagaatcgtatcttccccatcggttaaaaagtaaccgaagtcggtttggtgatctatactcaaggttaattgctgccctggtctcatgctatcgtccttcctgttccgcttattctctgcggattttgttaacattttttccaatcatcacaaattgattctttgttctgttggaagtttctctttattctactataatcaacacataagttaaatgttatggaggttttcatatggcaaaagaaagttcatttgatattgtatccaaggtggaattgcctgaagtgcaaaacgcaatccaaatcgcactgaaggaaatcagtacccgatatgactttaaaggcagcaaaagcgacatttctttagataaagaggagctggtcctcgtttccgatgacgaattcaaattaagccagctgaaagatgtgctggtcagcaaattgattaaacgaaacgtaccgacaaaaaacattgattacggcaaggttgaaaacgcgtcaggcggaacggtgcgccagcgtgcaaagcttgttcaaggcattgacaaggacaacgcaaaaaaaatcaatacgatcatcaaaaactccggactgaaagtaaagtctcaggtgcaggatgatcaagtgcgtgtcaccggaaaaaacaaagatgacctgcagcagattatctcagctgtacggggagcagatctgccaattgacgttcaatttataaatttcagataaattttctgattcctattgattattgtctttattttcggtaaatttggagaaagggaaaaacgccagatatcttttggcacttcctgacacgaaaatttcatatccgttcttatcaagagaagcagagggactggcccgacgaagcttcagcaaccggtgtaatggcgatcagccatgaccaaggtgctaaatccagcaagctcgaacagcttggaagataagaagagacaaaatcactgacaaagtcttcttcttaagaggactttttttatttctcttttttccttgctgatgtgaataaaggaggcagacaatgggacttttagaagatttgcaaagacaggtgttaatcggtgacggcgccatggggacgctcctctactcctatggcattgacaggtgttttgaggagctcaatatttcaaagccggaggaaattcagcgcatacataaagcgtacgttgaagcgggagccaacattattcaaacgaatacgtacggagccaactatattaaattatccagacacgggcttgaggatgacatcaaaaaaaatgaatcaggaggccgtaaagatcgcgcgggcttcagcaggcgatgcatacgtgcttggaacgatgggcggcatacgcacatttaataaaaacgcatacagtcttgacgaaattaagcgcagcttccgcgagcagctgtatctgctgctgcatgaagagccggatggcttgctgttagaaacatattatgatttggaagaagcccgtgaagtgctgaaaatcgcgcgcaaagagactgatcttccgattatgctcaatgtctccatgcacgagcaaggcgtattgcaggacggaacgccgctttctgacgcattgcgctcgattgcggatctcggagctgatattgtcggcattaactgccgcctcggcccttatcacatgattgaagcgctaagcgaagtgccgatttttgatgacgtattcttatccgtttatccgaacagcagtcttccttcgcttgaagagggacggctcgtctatgaaacagacgacacgtattttcaaaacagcgcgtcagaattccgtaagcaaggtgcgcggattatcggcggctgctgcggcacaacgccgaatcacatcagggcgatggcggaagcggttggcgggctggctccgattacggaaaaagaagtcaaaacccgggcgaaagaattcatttctgttcatcacgagcgaaccgagcccggcctggatgagatcgcagcgaaaaaacgctctattatcgtagagctggacccgccgaaaaaactaagctttgacaaatttctgtccgctgctgctgaattaaaagaagcgggaatcgatgccctgacactcgccgacaattctttggcgaccccgcggatcagcaatgttgcctgcggcgcccttgtcaagcagcagctcgatatgcgttcccttgtccatattacgtgccgtgaccgtaacattatcggcttacagtcacatttaatgggccttgatacgttagggctgaatgacgtgcttgctattacaggtgacccttctaaaatcggggattttcctggggcgacgtctgtatatgatttaacatcttttgatttaatcaggctgatcaaacaattcaatgaaggtctgtctctgtctggaaaaccgctcggcaagaaaacgaatttctcagttgccgccgcatttaatcctaacgtccgccatctggataaagcggtaaaacggcttgagaaaaaaatagattgcggcgcagattattttgtttctcagcctgtctattccgagcagcagcttgtcgatatccataacgaaacaaaacatctgaagacgccgatctatatcggcatcatgccgctgacaagcagccggaatgccgaattcatccataatgaaattcccggcattaagctgtctgatacgattcgcgaaaaaatggcccatgccggtgaagataaagaaaagcaaaaggcggaaggccttgcaattgcacgctccctgctggatacggcatgcgagctgtttaacggcatctacttgataacgcctttcctcagatctgacttaaccgctgagctcacatcatatattcagcaaaaagatgagcagcgccaaaatatctttttgcattaatttccaaaagactgcctgatcgaatcgggcagtctttttcaacgagattcgtgttacgatatagaaaaacaatcatgaggaggaacattatgctcgaagtcaaaaccatttccgcggaagatacatatgaaatccggcatcgcattctgcgtccccatcaatccatcgaacaatgcaaatataaagaggatcacgcagaaggctcctttcatctcggcgtgttttatgatggaacgctgatcagcatcgcttctttttccccgcaaagtcagcctttattaacggaagcctctgcgtatcggctgagaggcatggcaacgctcgagggatatcgcgatcaaaaagctggaagcacgctgatcaaacacgcggagcacaaactggcggagagcggcgttcaggcggtatggtgcaacgcaagacaccatgtcaagggctactatgccaagcttggctggaaggaacttggcgaaccatttgacattcccggcattggcaatcatattgtcatgtacaaaacacttagaacaagcaggtgatcttatggacgtagtagatgaactgattaagcttcatgaagaacacgtttccggcttattgcggctttgcgggcaagccgggtggccggattatggcgaacaagagctgaaactgcttgttcagcagggacgctttttcggttatcaaaatgtcagcggtgatattatttcctgcatcggcttgtttttgtttggccgtcttacttctatcggccttgttatcgttgacaaggaatatcaacggctcggtcttggccggcgtatggtaaacgcctgtattacccaaacggatgaaaacaccgccatcaggctttgcgccacaaaagaaggtttgccgctttatgaaaaagcaggttttcatacggcaggttcagtgcgaaagtacagctgtcacagttttcaaccttatacaaaaaagcttgatgctgaactgacatcctttagagaacaagactttcacgacttaaccgcggcggatctggctgcctttggcggagatcgatcaaaccttttgcagcagcttatttctgcttcatgcgaatgtatcatcgccagaaatcaggacggacagctcattggctacggactttctgtacagacaccggccaatttgaaattcggccctatcatcgctccatcatcagatgttgcagcacagataattacaaggctggcggccggcaaacaagggccgatgcgaatcgatataccgagtgaacacacgtctctgcatgacagcctgatagaaatgggatttcataaagatgatgaacctccgattttgttctatcagaaaaaagcgcctattcaaaatggacacttatatgctttgatttcacaggctctcggttaaccctcttttttcccgaacaggtatcttctgttcggttttttgctgtctgatcgctgaataaacgaagccatcagggacattctaagcagaagaaaaggagtgtgctctgagatggaatcatcaaaacaaataacggaatgacgattgtggcaatcggttcaatccctttaatattaaccctaggaaactcgatgcttattccgattttgccaaaaatgaaatctgaacttcatttatcacaatttcaagtcagtctcgtgatcacagtattttccttgattgcagcatttgcgattccgattgtcggttatctcgcagaccgattctcaaggaaagtcatcattattccctgcttaattttgtatggtgccggcggtttgttagccgggtttgcggcaggtttttttgacaatgcctatccttgggtcatggcaggacgagcgttacagggaatcggggcagccggaaccggcccaattgccatggcactgacgggagatctgtttaaaggcgcccaggagagcaaggtgctcggccttgttgaagcttcaaacggcatggggaaagtgctatcgccgatcattggctcgctgatcgccctgcttgtctggtatggcgcgttttttgcctttcctgtgttttgtatcatttcgatcgtactgacttggatttttattaaagaaaagaaaaaggaaaaagaaccgccaccaatcggacaatatgcaaaagggctgttaagtgtctttaaacatgaaggcagatggctgtttaccgcttatttagccggtgcgacctgtttgtttactttattcggcatcctgttttatctctcagatgttcttgaaaaaacatacgacaccgacggcgtgaaaaaaggcttaattttagcgatcccgcttttggttatgtgtgtgacgtcctatacaacaggaagcaaaatcgggcaaaagcaatcgttaatgaaaaagctgatcgtacttggattggcgttcatgaccgtatcctacgcggcactgtcattcattgaaaatcttgtcctttttatcagtgttcttgtactgagcagtataggctcaggtcttgtccttccttgtgtgaacagtttcattaccggggctgtcggcaaagaaagacggggatttgtcacctcgctgtacggctctgtacgtttcttaggggtagcgatcggtcctccgattttcggccgcctgatgcaatggtccagacccggcatgtttttaagcatcgcgggattgactctcgttgtcgggattcttgtgatgatgctcatccatgtgaagcaaaacaatgaagaaacaaaagaaaaagaagaccctaaaatggctggcaatcggctccagcccgctgaggaaaggtagcacccagtgtgaaaattgtacggattgaaacctttccgctatttcatcgattagaaaagccatacggagatgccaatgggtttaaacgatatcggacttgttatctcatcaggattatcaccgaaagcgggatagacggctggggagaatgcgttgattggctccctgctctccatgtcggttttacgaagcggatcatcccatttctattaggaaaacaggctggcagccgcctgtcattagtgcgcacgattcaaaaatggcaccagcgggcggcctccgctgtaagcatggcgctgacagagattgcagccaaagctgcggattgttcggtttgcgaattatggggcgggcgatacagagaggagattcctgtgtacgcgtcttttcaatcgtactcagactccccgcaatggatcagccgctcagtctccaatgttgaagcccagttgaaaaaaggttttgagcaaatcaaagtcaaaattggcgggacttcattcaaggaggatgtccggcacatcaatgcgctgcagcatacagcaggcagctccattacgatgattctggacgcaaaccaaagctacgatgccgctgcggcttttaaatgggagcgctatttctccgaatggacgaacattggctggcttgaggagcctttgccctttgatcagccgcaggattacgctatgcttcgaagccgtttgtctgttcctgttgccggcggagaaaacatgaaaggcccggcgcaatatgtgcctctcctttcacagcgctgtttggatatcattcagcccgatgtcatgcatgtcaacggaattgatgagtttcgggactgcctccagctcgcgcgttatttcggcgtcagagcatccgcccatgcatatgacggatcgctctcacggctctatgctttatttgcacaagcctgtctgcccccatggtctaaaatgaagaacgatcacattgaaccgatcgagtgggacgtcatggagaatccttttacagatctcgtcagcctgcagccttcaaaaggaatggtccacatcccgaaaggaaaaggcattggcacagagatcaatatggagatcgtcaatcgctacaagtgggatggctcagcctattaagctgggccatttctttattttgagacataaataatggacagcctcataaaatgaaaacagcggacaagtcttttcataaaggagcaaatgacttaatggctgaactgctgatgaaagcaaaacttacgtttatgattgtcgtaggcggcgtactacaaggactcggcatgtccttgtttttatttccgcatgatattccgacaggcggtgcagcaggtattgcggtgctattgcattatctgtttcaaatcccccacggattttcagtgtgggctgtgaatgtatcaatgctttttaccgctttaaaatggctggagatgagaacattcaccggcaccctcgcttctatcaccgtcacctctgtctcggtattgatctttgatgcagtttttcctgatatcacatctaacctgtggcttgatctggcaagcggcgcagtgttattgggactcggaatcggacttttatacaaatataaaatttcgaacggaggattcggagcccttgctctgatgatttctatctaccgcggcgggaatcctggaacgatcctgctcatcatgaattgcatcatttttatggtcaccgcgtctattattgactggggcatcgtcattcaagccctcatatgccaggtgatatcgacaagagtcatcgacttcatctacaacatccgcctgacctcacttccctatctcacgcctatgtaccgccataaaaaataataggcagaggctctcttcacgacgagagccccgcagccgctattttacagaaaaaaggtatcggatcttagccctaaacgcagcgtttccaacgcgatggcatcatgaaatggaatattggcaagattcacattcggcccgattttttgaataaacccttgctgaagcgttttgttaggcgcttcaaaaatcagcctgttgatatcaatatccgaggaaatgatgtcgtcaacaatttgaaacctgacatcgccgctgctggaacagatccctcccgttccgctttctctggcttctgtaatcactttttccgcgcccgcttccatatcctcaacgatatattcaagccattcctcagagctttgccggcttgctaattccgcatccttgctgcccacctcactgagcacaagaaattcatcagaaaaatcggcaatgtaagccgctttctctttatttgtcatcgggagcgtaccgtttgaaatctcaatatattcacagccgaaataggtgcagtaccgatgaaattcattcacttttttctggcttacgtacttttcaaacagtgtgccgccaaagaaaaatgtaatgtcatgttctttcagtgtgctgattttttcttcaagatctttcgtaagtaatgatgtgccccagccgaatttcacaaaatcaatatagtcggacgctccggctatcgcatctttgaaaaattgcaagggatagccgttatcaattaaaatggactgcccggtttctctcggcttgtttgttctcactggcaattctagtgaaaaatcattcatattatgaccctctctatcgttggaacttctccatcttgtttcactttcatcacgaaatcgcccgtcagttcttttgtacagtaaacgatgtcttccgaatcaaacaatggctggcggcagtcaaaaaacttctccgcaacagaagagccttttattctttcaatcgcctccgcagccgttaccacatttgtcccttcaatgatgcctttgatatactccgcacatgccatatcgtcatcaccggatggatgggaagccactatgtttatgacacaatcgtttgcgacgagctttttcacatgctgtgccgttgttttggcattggaaaatccagttacgaacagatgctttgcgttcagcgcccccaatgctgctgtgacgccgtttgttgttttctggatcaggcttttatccgtcatattctgcccagccatacgttttggagaattatctaaatcaaatccgctgataccgacccccttttcctctcccgtcaaaacataatccggataggtgtctttcagcgcaaaggcttcatcagctgtccggaccaacaaaatctctttcgccccgccgataaacgcataatgggcgaccgtaaaggctctgatgacatcaatgacgatgttaatgtccgccggggcaagcgaatgatgatgcccctgataaatggcaatcggcatactacctctccttgggcataaaaccattttgctaaaaagcatattcagccgggctcttaatggttccgcacctcattttaggcgggcgcggcacctaaaacctgaacctttatgcaaaaaatgaatagtctgcctataactcgatcaatagataaaaaaagcagatgcaaacggggggaaaacattgaacgaaaccatcacatatgacacttggaacgacatgctgtccaaacagataacggatcaattgatcgatgagctcgatgtgttgaaatgggcttaccgaacgtacggagaaaagattgtgtacgcctgcagctttggcgcagaaggaatggtgcttctcgacttaatatcaaaaatcaacaaaaacgcacacatcatctttttggataccgggcttcattttcaggaaacatatgagctgatcgagaccgtcaaagaacgatatccgggatttgcaatccagatgctcgaacccgagctgagcttaacagaacaggggacgaagtacggcggagagctgtggaagcataacccgaacctctgctgccaattgcggaaaatcgaaccgctcaaaaagcacctgtccggcatgacagcttggatttcaggactgcgccgggatcagtcaccaacgagaaagcatattcaatacgtaaacctggaccagaagtttgagctcatcaaaatttgcccgcttatccactggacatgggatgacgtttggacgtacatccgcctgcacaatttgccttataacaaactgcacgatcaacattatccgagcataggctgtgaaatgtgtacactgccttccccggacccgaacgatgagagggctggaagatgggccggacgggagaaaacagaatgcggcctgcatcaagaatagcggatggcaggttcttgatgtgagaatcgaaatgatgttaaggcgctgatgtcaaactttcattaagtgcagaaaagaaaacaaggaaacgtataaatggaggttgaacacgttgaatggaaacgaaccccacggaggggtattaatcaaccgctgtgatcccgcatgccattttgaagggtgcgcgtgccaagcagagctggatcagcttgcactgagtgatctggagcttattgcgatcggcggctacagcccgttaacaggttttttgggagaaaaagattatcattccgttgtgaaagagatgaggctggcaaacggcttgccgtggagcctgccgattacgctgcctgtcggagaaaaaacagcaagacagctgtctgccggagatcacgtcaagcttgtgaaagacggtgttacctacggcatgatcacagtcaccgatatataccagcctgataaaacacaagaagcactgtctgtttttaaaacaaacgatcctgcccacccaggcgtaaaaaaattgctggcgcgcccggattactatatcggagggcctatcacggtcagcagcctgcctgacaaatctttcgaacagttttatgcaacgcccgctgaaacaagagcggcctttcaaaaactcggctggaagacgattgtcggctttcaaaccaggaaccctgttcacagagcgcatgaatacattcaaaaaacagcgttagaaacggtcgacggtctgctgcttcacccacttgtcggagaaacaaagtcagacgatatccccagcgatatcagaatggagagctaccaggctttgcttaatcactattatccaaaggatcgtgtcatgttatcggttttccctgccgccatgcgttatgcaggtccgcgggaagcgattttccatgcgctcgtccgaaaaaattacggctgtacccattttattgtaggccgtgatcacgcgggtgtcggcagctactatggaacatacgacgcccaaaatatttttcaatcattcacagaggaagagctgggcatcaagccgctgttttttgagcacagcttttattgccgaaaatgcggaaacatgggcacctccaaaacatgtccgcacagcccgagagaccacatccacttatcaggcacaaaagtgagagagcttctccgccaaggcaaaaagccgcctaaagaattcagccggcctgaggtcgcagccgtgctgatcaagggacttcaccaacagcctgttgccatcaagcaaaacagcggggaattgcaatgacacacaatccgaacatcatttggcatcccgctgccatctcaaagtctgacagacagtccttaaacggacacaaaagctgcgtcctttggtttacaggtttgtccggctccggaaaatcggtgctggccaatgctgtcgatgaaaagctttaccgcaagggcattcagagctacgtgcttgacggtgataatatccgccacggcttaaacaaagatcttggatttcagactggtgacaggattgaaaacatccgccggatcggagaagtggcgaagctgtttgtcgacagcgggcaaatgattttaacggcttttatttctccattcagagaggatcgggacatggttagagcgctctttcctaaaggtgagttcttcgaaatttatgtgaagtgcccgctgcatgtttgtgaacagcgcgatccaaaagggctttataaaaaagcgcgaaacggagagatcaaacatttcaccgggatcgattctccgtatgaagcgccgctttcacccgatttcatcattgagtctgaccagacctctatttccgatggagctgatctcatcattaacgcactgcaaaacagaggaattatataaaaaacccgatcaatgtcgggttttttcttatgagttggagaactgcgcaatcaaactgttgatcttctctttttcctcataaaatgctccgtgcccgctgtttgcaaacggaaccaattccgactgtttgatgccgcgcttcaattctttcgcaaaatcaaacggcgcaattctatcctttctcccgtgcaggatcagcgtcggcaccttgattgcagcaagttcctttctgagatcttcgtctcttaatgcgatgcccgagtggatcgtcccgtaggaggaagcctccagcatcagattgagaaaccactgcctaagctctggagacacttttttctcaaaaaactgtttccctaaatcagccagtgttttgggccgatcagctttgaacaattcaatcatatcgtcaatatcctgcttcctcatcccgtacggataacccgggcgttttgtaaacgcgggggccgccgcagacagtaaaatcagcttatcaacatcggctccttcatgccttgccatataacggattgcaattgcgccgcccattgaaaaaccggcaagaatcgcattctcaagctgcagcgtataaatgactgctttcacatcatcggccatcgtgtcataatcgtagccttcccaagggcggtcagattgcccatatccccgcaaatcaacgccgataaaacgaaatccccttttcggaagctcattcatttgatattcaaacatcttatgattcaacggccacccgtgcaaaaagatgatcggccttccatgtccgatatcctctacaaacagtgtcacatgctcctcggttttgatgtaatgccccattccgcattcctcctgttccctttggctttttcggcctgtaaacgccttgacgtataggaagctttccatttatgcttacaaaacaagcgggctgctgtaccaagaaaaggctcttcacgatttactatatgtatcaatttccttaacgatctattaaattgaacccggaagcctctgtttttcgggcagcaaaggatgtcatcacatgaataaaatcgcaattcaaaaaccgaacataccggaaaacctgcaaaccgcagattttcatgatgccgtgacacaggatgatgtaatcagcatgcatttgtttgaagattgcaccatctgcggcgaagatatcgaaagactatgtgttgaaaaaacggtattcagaaatgtcgtctttatcgatgtgtcttttcggcatattgaactgaccgatgtgatctttgaaaaatgcgatttatcaaacgccgatttcagcggggctgtcattcacagaacttcagttaagcagtcaaaaatggttggaatgaatgtggcggaagcaacgctgcggaatgtttcattcgaggaatgccacggacatttcagctcattttcgtactcaaatatgaaacaagttcgatttgatcactgtgctcttatgcaaagtgaatgcagcgatacggtgctccagcagacacactttgacggatgcgaattggaaggcgccagctttaccggcacgtcccttcaaaacatggacatcagcacgtgccgttttgaacagcttcatgtctccctcgacaaattgaaaggctgcaaaatcgcacctgagcacgcgattgccttcgccagggcactgggagctgtcatcgtataaccaaagcctaggacatcatcaggcggcgtgctgtttcagctgccgctttaatgccagtttccaaatctccaagagatgcataggaatatgacagcctgatgctgtttcggtcttcaccgtcataaatatagccgggattcacaagcacctgccgtttcagcaattcataaaagaaacggctgacaggcaggtttttgtgaaatgtcacccaaatataaaagccgcctgcgggaatccgccacgtggcaatgtccccggcataccgctcgagaaaatgaacggcggcgtctctcctttctttaagcttcctgcgtacccaagtcagatgctcttcataatatccctgtgacagccactcggcagccgcccactgggacaggccgcttgatccgtagtctgtctgcattttaatgtccgccagcctttcaataaccggctccggaccggcaagccagccgattcgcagaccggggctaaccgtttttgaaaacgcgcccagatacagaatattgccctcatgatccattgctttcaacggctgcggcggtttttcttcaaaccataaatcaccgtacgcatcatcctcaatgatgggcatctgctctttttttgacaggctgatgatctctttccttcgctgctctgacatgactgtgcctgtcggattatgaaacgacggaatcgtgtaaagcagctgtcctccatattgttttcgattagaagaaacaagccccgctttgaccccttcatcatccatcggcaagccgcgaagccgcatcccagctgattgaaatacatgcaaggattgaaggtaggacggcttctccgtcaaaatgacagaatctcgttttaaaagtccaattgagatgagctgaagtgcctgaagtgcaccggacacaattaaaattgcagacggtgacacatggatcttctttccttttaaatggtcggccactgcctcccgcagctgacggtttcctttcggctgctcatatcctaaagacaggacgcccggattgatttgctgaaacatccgtccaattgtgtcagcaggcacaagatccggtgaaagttctccagttcctaatctgatgatatccgctcttggttcgttctgattaatagcttgaatgatggaagaattggcgcgatgaatgcccgaacggacgtaatcgctccaatcaagcggaggctcagccgtcagcacgctccaagtactgtttacaaccttcgtaccgccgccttttcttccctctaacaagccttgagacgtgagttcatctatggctgctgtgactgtgctgcggttgacttgaaacatgtcggccagcgttctctgtgaggggattttcgtccctacagcccactctccgtgaagaatcttgtctttcatatattgttcgatctgccgatgcagcggaacatccgactttcggcttggctgccattgcgacaaggtcatgccccccttttttacacattatacatttggctggttcctaacccaaccaaatggctggagactttagtgacaatctctcttatgattgaaaaaaaatgtgaaaggagctttttcagcatgaatgcaatcattcacggaattgtgctcgcgtttggcttaattttgccgctgggagtgcagaatgtgtttatttttcagcaaggcgcgttgcaaaagcatatttggcgggctctcccagctgtcatcagtgcttcagtctgcgataccttgttaattgtattagccgttgcgggcgtgtctgtcattgtgcaggagctgcctgtgtttgagacagtcatgatggccggcggatttttatttttgctttatatgggctgggtgacttggaacatccgtccgaacacaagccaaaatgagaaacatacgttcacaccaaaaaagcaagctgcgtttgcggccgctgtttctcttttaaacccgcatgccattctggacacgatcggcgtcatcggcacgagctctcttcaatattcggggcttgagaaatggctctttatggccgcctgcatcgctgtgtcttggatttggttcatcagccttgcaatagcgggccggttgtttcagacgatagatacgagcggcaggcttatgctgatcgtaaacaaatgctctgcagcggtaatgtgggcagcggcaggatattttggggtgtcactcttttgcaattgaaggagaaacagatgaaaaaaacgaatttcttagaaaagggggcatgctgatgactgatgcaaaacagttttatgactatcattcttgggcaaacaagaaaatatttacccatatcgaaaacctgccggaggaaactgcctatcaagaagtaaagagcgtatttccttctgtcagcgacgtgctgcttcatatgtgcagggctgactacatttggctgaatgttctttcgggagtggcctaccaagagattatagacagcgcaggcaaattacagtccgcgcaaggtaatatggcagcgattaaacagcacgctgccgagctggagtcacagtatcatgatttcttcagccgccagacggacttagaacagaccttcacaatgcagcatccgaaactaggtacactggaatcaacctatgcagacaccatcctgcatgtcgtcaatcacggcacttaccacagagggaacgtaaccgccatgctgagacagctggaccattcaggcgtacctactgattatatgtactatttatatgagaaaagagaaagcaagggctaaaatgcccttgctttttttgcggaaagcctcaaatgcaacatacttagcttttacatacctgtataagcgcgcttcacatctagctgtaccggcatgccgtttcgaaaggaattggttgcggcgatacccacttctaaattgatcgtcgcatcaatatcagtcacaatcggtgtttttccattccggacacactcggcgaaatgctgaagctccaagcagtaggcttcatgaaaacgagtttgaaagtctggaatgatatcaaaactgctccctttagccgataggatggtcacatgttgatgtctcaatgtccctatgaaaatactgccctctgtcccgatcacctccgcccggatgtcatgtccgtatggagaggttctgcttgcctcgacgtcccccgctgcgcccgagtcaaattcaatatacgtcagcgcctgatccacatcgccatactgctccataaacggattgttcagaatcctgccgtgtcctgaaacagaagtgatttccgcccctagcaaataacgggcaatatcatagtcatggatggaacagtcgataaaaattccaccgctgtgtttgataaattctgcgggaggcgcgccttggtcgcgcgtaaagcctttataatagataggtttgccgatttctccagcgtcgatccgccgtttggcatctgcgtatgcgggatcgaaccgtctcataaagccgacttggcagatgacacctgtctccttaactttttcagaagctgcttttgattcctcaaggcttaatgtcagcggtttttcaacaaagatctgtttgccgttctcggctgctttgatgatcatatcaccatgtgtgcttgtcggcgttacgataatgacagcatcaatgccgggatcttctaacacttcatacgggtcctctgaccatttttcgataccgagttctctggcaacctgctccgctctcccttttaacggatcaccgacacaaaccagctttgcccccggcacactggtgacgagatttttcgcatgataataaccgagccttcctaatcccaatactgcacatcttacttgatgttccacgtcccatcctctcctttatctcatttcgggctcgctttgagaaagcgttttctcttaacagctaaaaaaacagcggttctatccgctctgccattttgcgcaagcgctttctcaaaagatggttatattttacaccgcctttggtttacacgcaatatgtttttttggcttcaactgtcataatgaaaaaacccgctcattagcgggctcatgtgttgagcggtgatgtagaatgtctgactacaagctcaggcgggagcactattttttgtttcgcctttcgttttccctctattgcttctgccagcagttcgatgacgctccgccccatctcttttatcggctgggctacggttgtcaggggcggagccgccatttctgcgagtatcgtattatcaaaaccaatgatagaaagatcatccggcacttttatgcctcttattctcgcagcttgtatggcggcacaagccaatacgtcgttgaaggcaaaaatagcagtcggagcatttctgtcgagcaattttcccgcttcttccttgccgctttccaaggaaaaccgcgtctggatgataagtgattcatcaatgggcacgcccgcttcctccatcgcctgacggaagcctttgattctatttttttcgcctgtcgttgacccgtctccgataatgcaggcgatgttcgtgtggccgagtgacagaagatgcttggcagcctcatatccgccacgaacgtcgtctatcacaacaatatccatcggaagaagcggcttatcctgagaaatcatggcaatcggaatttgttcactggcgatttcctccaaagcagacatactgtcatggctttcaatccctgttgcaaaaataatgccatccacctttttctgtttcagcacagaaaaatactttgtttcttttttcggatcgtaatcggtgctgcaaatcaacatttgaaaaccgagctcatccgctctttcctcaatgcttttggccagttcgccgtaaaacggatttgaaatatcaggcgccacgagagcgatcatattcgttcgttttcccgttaacgccgcggcgtggacattgggcgtgtatgccatttcattcatgacattcatgaccttctgccgtgttttatcgctgattctccccgtattgtttatcacacgggacacagttgtgatcgaaacacccgccgcctttgccacatcgtaaattgttgttttcatgttcatccctcgtctggttattgaactttccggctgacaattttccggtattcaattggtgaaatgccttctatctgcttaaagagttttgaaaagtatgtcggatcttccattccgaccgtttccgcaataacgcccattttatcatttgtagaggataaaagacgcttcgcttccgtcattctcacccggttcgtgtattgtgccggagttacgccgagcacctgctgcatgcagcggctcacataatcctgatgatagtgaagggcgagcgacagatccttgattgtcgtcttttccttatagtgctcctgtaaataccgggccgcctcccaggctacccgctctttcgcagacggtatttggaacgcttctttttgaagatgcagcatcagctcctcaaataaaatttgctttctgagcggcaaatcagagttttccgcggagtaatcgatcagcttttcaaactgctgcgccataaactgcgggcgctgcaccttgccttttctcggcaaggccaatccgtagcgggccggctcttcgaagctccctttttcctgctgaagctcagaccagttgctgcctccctttgccgtaaattcatatcgatgttcatcgaagtgaagccaatagtaggaggttgcttcatcactgcccttcgtcccgtagtgttcaagaccgggagaaagcaagatgtactcgccgccttcaacagaaaacgatgtttcattttccgttatatataacgttccctgtttgacatatatcagatcaaacacggagaatacacgtttcacatgggtttctccttttttaaaaaaccccttccccagctgcgataaataccggaaaaggcgggactgtaaacaggatgcgaggcatttgaatcatcctcctttttaagtcggatttttacaagaagtatcgtttctatccctttttattataaggaaatggaggtacactttaaaacgttgattttatttacgaaaggggttagacacgatgaaacaagctgtcttcaaatcaactgctttgaaaaaacccgctgacaaaacgttctcattattttcgcttacttggccgatctttattgaggtctcattatatatgtttatgggtaatgccgatacactgatgctcagccaatactcggataacagcgtggcagcagtcggcgtcagcaaccagattttaaatttaattatcgtgatgttcagctttatcgcaacaggaacgaccgttatcatttcacaatttctaggctcacggcaaaagaaagaagccatggaagtcgcttatgtgtcaatcggcgccaacttcttcatcagcctggccatcagcgccgtcgtctttttcgcggctgtccctctgcttcatatgatgggattatcagacgcactgatgcctgatgcgaaagtctttttacaagttgtcggaggtctgtcctttattcaggctttaatcatgacattcagcgcgatcttaaaaagctacggctacacaaaagatacaatgtttgtcactatcggcatgaacattttaaacattgccggaaactttgttgtgattttcggtttgttcggctttcctgttctcggtgttgccggtgtggccatgtccacatctatcgcccgcgtcatcggattaatcgcgatgattgtgattgtcaacaaacgcatccagctgaagatgtcgctgaaaaaagtctttcatatgcataaagagcatttgcgcaagctgctgaaaatcggcattccttctgcgggagagcagctttcatacaacctgtcgcaaatgatagtcacgtattttatcgccatcatgggcgcgcaggcgttgacaacaaaagtgtatacgcaaaatattacgatgtttattttgctgttcggcactgcgatcagccagggtacacaaatcttaatcggccgttatatcggcggcaaacaatttgatgccgcttatgagcgctgcatgaagagcttatattgggcactcggaattgctgcggctacctctgttttgatgacgatcttttcaaaagacctgatcggactcttcacacaaagccctgacattatagcaactgcaagcctattgattgccatgaccattatccttgaaccaggccgctcgtttaatgtcattatcattaactctctgcgggccgcgggggatgcgaaattcccggtttacatggcaatgatttcaatgtggggcattggcctcccgcttgcttatcttttcggcatccacctcggtttcggtcttgccggcatttggatttcttttatcgcggatgaatgggtccggggaatcttaatgtacagaagatggcgctcacgtatctggattcaaaaaggtatggcgtaacacccggctcaatcaaggccgggtgttttttagatatcagacagaatctgcttcacttcggtctctgtgagagcgaagtgatattgaaatacatcgtgctgcttcgcccggattttttctaaaacagcccggtgcaaatgaagagcggctttcaccgttttttgagaatactgcggaaatagcggcaaggcatcctgacactcttcaaggtaggcttctgcttcaaaagcgatatactcccacgtcattgtgaacgctttatttacggtgcctttttggagatcagcctctgtatagccgaattgctgcattacctgacggggaatgcggtttttttgctgatctgtgccaagatcacttaagaagcgaaccagctgtatggccaagccgagagagacggctgcttgtttgagctgatcttgttttcggcgtgtcagtatcggcagcagcatcaatccggcagcaccgcccgtccgatatgcgtacatgagcagttcatcaaggtcatcatacggcttggcgtcttctttttgtgcggcaataaactcccgaaaaggttcgctttccaatgtaaaggtccgatacgcatgatcaaaagccttccatagatgttgtttaccgttatttgtcctttggtaaacatgatcagctttagcttcaaatgcgggcaataccttttcgtctgcactggccgccgtgtggcaaaacgacaatactgcccaagaggcttgtctttgctttagcgggagatatgataatgctttgaaacaggctggcgcgtattcgccaacaatctgtccgcattgctggtaagcttcttttatctctttcattttctcactcctatgtatcactgcttcttcaagtctagtatgttttttcctaattgtatatgaagaaaatgccgattcttactttgtaaaagtaacaagacgcacagcatcatcgacgagatatgcattattatttttaatgccatacaacaggtagaatgtaaacatttctcaatcatcacttcattaatagaggaatcacggaaaaaagggctaattgttatgatacatgatagtattggagtgagtttagtgatgaaattttttgaatataactggcaggttagagatcaatggtttacttggtgtcatcaactaaccactgaagaattacttaaaaatcgtcttggcggagtagagaatattttatataccctttttcatattattgatgtggaatatagttggattcgtgctatccaaggaaaagaagatatcgctgttcagttcgctgattatcaaacactcaataaagtgaaatctctctcaaatacattccgaactgaaataattgatgttttacaaacacattcagatcaaataaaagatgaacttgtaagcgttccttgggagacaggtgttttatatacgcgagatgaaatattacaccatatcatcgctcacgaaattcaccatattggtcaactttctgtatgggctagggaattaaagttaagcccggtatcagctagttttatcggcagaacattaaaacctattcattcttattgaaggaatgcgggggcaattcgatagtgctgttgtacaaaaaaggatagatagagcatatatttccctgctcatctatccttcttatttaaatctatacatctctggcttttaatcacatttgtattgaacctacctctcgtcaatatcaatgcgatacgcttcaaaccatgtatgaatttgagcaagatgggcgatcagctgaggccccttcatgagctgcccgaaccacgggaccttgaaggaggagccttccgtttctaaaagctgatctaattgttttctgtccagtaaggtatggagcacggagtccttttggcttctgatcgttttcagccactcgctgacgccttttgtatattccggatgatgtgttttcggatatgggctttttttgcgatacaaaatgtcatcaggcaaaatgccctcaagcgctttgcgcaaaatgcctttttcccgattatcatgcattttcatttcccacggaatattccaaacatattccacaagccggtgatcggcgaacggcacccgcacttccaggctcgcccccatgctcatgcgatccttccgatccaaaaggttcgtcataaaccaaagcatatttaaatagaacagctgtcttcttgctttatccacacccgtttctccgtctaataatggcgtttctgccaaggtttcttcatatttggcatttacgtattctttcagattcaattttttctgccatgagtcagaaagcagcttgatccgctcctccgttgatctcatccatggaaagccagactcaacatctgccgtatggaaccacgggtacccgccgaaaatctcatccgcgcattctcccgataggctgacgacaaagtcctttttgatttcccggcaaaaccacagcagggatgagtcgacatctgccattcccggcaagtctttgaccagtacagcttcctccaaatgatcaacgaggtctttttggctgatgacgcatttgtggtgcgttgtgccgaaagcctctgtcattttttcaatccatggtccgtcatcattcggctgaaaagcgcttgcttgaaaatatttatcgttctcttcgtaatcaatcgaataagtatgaagcggtgcttttccttccttttcaaaatggcccgccgcaatcgctgtaatcgcgcttgagtccagaccgcctgataggaatgtgcaaacaggcacatccgacacaagctgccgcgtcaccgcgtcctgaaataacgatctgacattggcaaccgtgtcatcaaaactgtccgtatgtttttcgctttcaacattccaataacgccaaatattaagtccgtctttggaaaatgtcagcgcgtgagccgggcggatttcttttatgcctttaaatatgccagtgcccggggttctggacggtccaagaccgaaaatttcagaaagtcccgttctgtccactcgcgcttttatatcagggtgcgcgaggattgctttgatttccgacccgaagagaaatgaagagccttccttcgtgtaaaaaaacggctttacaccgagacggtctctcgcggcaaacaacagattacgcttttcatcccacacagcgaaagcgaatatgccattgagatggtcgacacagtcttcctgccactcgatgtagctgtgcagaagcacctcggtatctgacgtacgctcgaattgatggccccgcgcccgcaattctttgcgcaaatcttccgtgttataaagctcgccattgtaaataatggtgtacgtatcgcctttataggtacacgccatcggctggcgtccgccttcaatatcaacaaccgcaagtcttttatgtccgaataaaacatggtgctccccccaaacgtttgaatcatcaggccctcgtttggaaagagtgtctgtcattctgtccatcgtttgtttttcctggacgagctgctttttaaaatcgacccaacccgtaattccacacatgtgacatcagctccaatcccgtttctttcgtaacaatttcgtttctttcagcaccttagtaagtttatgcatctataggcagatagttgatttgtccataaaagagttgtatgggacaggcttgaattggaaagaaaagagaggaatgaagaaaaaggagacagcatggatgaaacggaaacaattgttatatacagaggaacgaaagtgggaatacggcaccatcctcattgaagacggcatctgcttaatcgaaaacggtgaaggcgatatactgctggcggacagtctccaacacagcccaatctggatccatcataaaggaaagtgggagcaagccggctttcaggacaagttggttttggcatgcggtgcagaaaacatctccctttccggcggagaacgcatccgctatgagaaatcagtcaagcggccgctcatggcgcttttggattcgcttgacgacgaaacctttctcgcatttctgcagcacttgcacagcttcggcttatcggtattcgattgcgtcttttcttataataaaggagtcttttcgaatacttcggcggggcagggtgtgtccttttatcacttttcaaatgacaccgcacaatgcgcgatgcagcatcactacaactacagcagcgaagggacaggagaccgttttgaatggacggcttcaaacggaaagcgatccattatgtacacagcagtccaacgggggcgcaaataaaaaagcggtgcatcgagcaccgctttttggttacttttcaacaacaacttttgcttccttgctttcttttttatctgtatccacagccgtgacgtacagcaccgttccggctttttgttttttgattttcaccgaaaacgttccttttgcgtcagctttggcagaagcaatgactttctttgatttgtttttcactctgatcatcgctttgctgtttgccttcccttttactgccgtatccttcgttttcaccgcgtttactttcggtgtgccggaaggttttcctttgacgacaacaactttatacgatgttttcgcatcgccttttgttgctttcagatacagtacttgatcctgtttttgagtcgcgatattcaccttgaacgcattgtcttttccggctttggcgctgccgagtttctttttgccgttcatcacctcgataagggtgccttccttcgcgcttcctctgacagctgtttgagtgctttccagcttgttgaccttaagctgtaaatcagctgcgctgacagccttcatgacattcagccgcccgtagcctgaatgccagtctacaccaggtgtcttcggaatttcaatcggatcgccataatcgtcatacaactcttcttctccgccatcgacactttcaaaggaaatatcatctgccgtctttttcaacatatcctcaacttctgttctttttagcttaggattttgagcaaacagcagtcccgcagcggcggcagcatatggcgtcgccatagacgttccgctcatgtacgtgacatttccgttcggcactaagctcgggatatcagaccctggagcagagatgtccagaccttttccatagttagagaaatcagcggtcatatccatgcgattcgttgcgccgactgacatcacatatttagaagatgcaggataagataaggcattttctccatcattcccgctggctgcggcaatcaagacatttttgtcagctgcgtacttcaaagcaaattcaagcacgcggctgtagcctccgcctaaacttaaattaatcacctttgctcctttgtcagcagcatatttgatgccgagagcaatttgttcagtatctccggaacctgcggaatcaagcacttttacagggatgatttttgctttggcattcaatccagtcattgaatagccgttatcgctttgggctgcaataatgcctgcgacatgcgtcccatgcccctgatcatccattgcattgttatttcgtccgacaaaattgtgtccgagatctgttcttacttttccttttaaatcggcaagcgtgctgtctacgcctgtgtctactactgcaatgagtgtatcgttaagcttgcgtttggacagcaatgtgttggcaggctcatatttcacatccgcatttttgacaccgccgttttcaccgttgtttttaagcggccattgataagggtactgaatatcgtttgccaagcttttgtattcctgtacgggttccgcaaactctacattggacatcttggatagtgtcgcagcagcgcttttgacccttttggcgcttgccgtatatgcgccgttctgtttctcgtctttcggaagttcaaatgaatacagattgtcaaacagtttctttgcctttttcacattagatatgtcttttttcgattgcgcgcttgcagaaaagcccttcatttcattatgtacggatgagaggcttttattgtccttcaccttgaaaataacctttgttgtctgaacttcactttttgctgcaatattgttttctgttaaaatggctcctgctgttttgccttgcagctgcttcatatttagtcggtccgcttgtttctttatctcctctttaaggaatgacgggactgattgtaaagctttatcatatagccggttgatcgctttttgatccttttcagtgaccttatacgaagatgatgctccgttttctgacacatcgtcaaataacggctttaatgtcacaagatcctgatagatttcatttcttgctgttttattgagtgcgagctttgcaacgataaacggtgctgctttgtaataaaggcttgtcagttctttgccttctgctgtttggctcagctgctcatcacgaatcgatctcaacttatccaggatgccttttcctgatttcttctgatcgacactcatttcaaccggacaagcttcttcctcttctaaatctgacggctgttttttggtgcctttatacccaatcgtatacttggcttctgcagctgcttctgccgttccgccgtcctctggttcttcttctccgaggtattcaacttttacatagtaagggccgctccacgcgtatggaaaaatgacttcgctttttccatcctccgctgtgaaagaacggtacatctcaaacgtctcatctttaagcgctttttccttacttggatatacagatacattcagtactgaatcactctttacggtcagtgccatatgtgagtttttctgaatatccgttgctcccggggtcactttgtaccatttcacctgttccggctccttcatggcgcctgtctgctctttgccgttttccagagcagccgcctgatcgatcgcgccggccgctgcagctttggttcccggagaaaaaaggctgaaaatcagtgcaaaaataagcactgccgccacaaccgagctgaattttctgcgtttcatgttatccctcctgcaaaataatgaatctccttgaaggtatcataatttcataggacgagataccgcttacagggaattttaaggttattttaaatgatttggaatatgaggggataaatataaaaaaaccagctctatcaaagagccgggttcataggtttttctattaaaacaattgaaaaccaattggcaaatgcagaccgagcagcactgtcagcaaaaggacaatgacgaagccgacccacaggcctcctgttgatttttcttttttcttgcggatgaggagcatttccatcaggccgatggtgataatgcccagaatcattttgccggcgtattctccgttccagttggcgaaacggacaaacagctcagctcctgtcaaaataataaggatatagaataaccgcagaatcatatgagtgatttttgcgccctttgcacttcctgacgaatacagcgagtagctgacgaaaagcagaatcagcgctaccacccatgtcgtaatatgtaggtgtgtcatatatgttccccctatcagataaattaccccacttatagtaccatgaacttgtcctctgtcacaaagatgattatcagaaaaaacgggcgggtccgggtccgccctccagttttattcagccaatttggtttgacagcgttccgatcggatcaattgtaatatcaattttgtcacctgaccgcaagaattttggaggcgtaaaccccttgccgacaccagacggcgtaccggtggcaataatgtcgcccgcttcaagcgtcatcccctttgagagggtttcaattaattccggaatggaaaagatcatatcgcttgccgaaccggattggcgcagctcgccgttgactcttgtttcaaccttgaggcgctctggctcctgaatagatgatttatgtacaagcacgggccccatcggacatgtcgtatccaagctttttccgataaaaaactgcttatgccttttttgcagatcacgcgccgtgatatcattcacaatcgtatatccgaaaacatggtcatatgcatcttcttttgaaatgcgagtcccgctttttccgatcacgacagcaagttctccctcataatcaagctgagaggtaacctcttcatggctctttacgatatcaccatgccccgtaaccgttaccggcgattttgtaaataccatcggatgctccggaatatcagcctcgctccccatttcaatcgcgtgatcccggtagtttttgccgatgcagatgatattttttgatggcttcggaatgggtgcatggagcttcacctcagataatgaatacataaatgatcccagctcatcattcggtttctttgcccactcggccagctgccttgcatgcgcaacgaatttatccccttctgcgatacattcaatcagcgatcccggaatcgtctcaagttcaaacagttttttttcagccttctgcaaatccataattttctcatcgtcaatgatcaggccgacaaacattcggttgtaaagttcccctgtcgcaaatttcatgttattcctccatcatcttttaaatcagaatgctccttcatgtattctctgtcgaatgctgaaatccctttttctcaattccgttttcatttcgtttcaggacgggcttgctctacatatcatacaaatgtcgttttgagaaggaggaaagaatatggagcgcgtgcatttattttttcatcgggagcagctgaaaaggaaaggtacagccaaggggcttttcgtaacagatcgatctgtttctcccattcttctcacacagcgtgacagagcggaaaaggcatcctatgaaatcagctgggaaaagtctctgcttggtgaaaggacactttttttgaatgcagaacaggatgatccgtccctgatgcggcgcagactcgcctattgtttttttgaccagatcggcgtacctgctcccgttgcctcgtacagctttctgaccatcaatggccagcctgaaggcatttatttgaacatcaagaaccatcagccagccggtaaaaggagttacggagtgaagacggccgatccaagggttccattgtccctttttaacaatgattcctcggcattcttacatgaatttttcatactgatccgcacagccggagatgacgaattggctgaaaggattaaattgtatctggatgtcaagctgttttttttgtggctgatcggcaacacctgcaccaatcaaggcttttactacacattttgtttaaacgaatccggtcggctttacgtttccccgatggagacaagatcgcttgccgtacaagaatggtatgaagaagacccgcttctgacaaaaggaaagacgctttcgtcaaggcttctatccattcccgccttcaggtcgcaatatcacaccttaatgaaaaacgtgctgaagcggtcgtttactattgaacgattatctcctctcatcaacgaatggcaccttgacatttgtcaaagtgctgctgatgatccttttaatcaaaaaaagcccctttcaaatcgaaaaggagcagaccaacatacttagagaaattgaggaacggcaggactttttgcaagcacacttagcaagactttagtcctttctccattaaaaaaggccgcagcaaaaattgtcgcttttttagtcaaattgacgaaaggcaaccttttgagccaaaataggttatactaacgatatcctgtatttatatcaaaataaaatctagaattggagatagcgtaatgaacagtaaaattgaagaaatgaggatcacactaattgaaaccgcacaaaaatacggcatgaattcaaaagaaacgattcaatgcagccaagagctggatatcctgctgaatacccggattaaagaagaaatgatttttgggagatatcttgaaaactcccgtatgtaaatcattttctataacaattagaatacaccacatttaactccgatttttgctcagcacttctgagatatacctcagggcgagaatgtgcccgcccaaaaatcgaataccgcagcacgacatactccaaaaagcattctacacgcaaaaacaccaaagaaataaacaaaaatcaccataggcggatagcggcatccttcgccgcatttccgctcaatttatacccaacatcctcttttgccatgtttaaacataacggcccgaaaaaataaaacgctttcacaaagagccgatatgtccccttaaaatttctctcacacatatgtgcgtttgtcataagctatcgtgaatagcccaattgaaatcggaattgtcatttcactttacctgtcttttttaatttttcaacaaaggatgtgctcgtatgccggccattgtcggagcgtttaaaattaatgcgattggtacgagcggagtcgttcacatcggggactgcattacgatttctcctcaggctcaggtcagaacgtttgccggtgctggcagctttaataccggcgacagcctcaaggtgatgaattatcaaaacgcgacgaatgtgtatgacaatgatgcggttgatcagccgatcgtggccaatgcgtaaaaggagtgaggctcatgaacttctatattaatcaaaccattcaaatcaactatctccggctggaatcaatcagcaactcctccattctgcaaatcgggagcgccggatcaatcaagtcactgtcaaatttgtataatacaggaagctatgtagagccggcaccagaagtttctggctcagggcaaccgctccagctgcaggagcccgacacaggttcattggtcccgctccagcctcctggccgttaatcatatgaaagaggtgaagaacatgtatgatcaatctgtttcctcttacctgcaaaacttgaattccttcgttcagcagcaggcgattcacattcagcagctcgaacgtcagctgaaagagattcaaactgaaatgaatacgatgaaacagcggccggccactaccattgagcgtgtggagtataaatttgatcagctgaaaatcgaaaggctcgacgggactttgaatatcggtttaaatccgactgacccgaacagcgtccaaaactttgacgtcagccagtcgacaccgcaaatcgggatgatgcagcaggaagagagcgctcagctcatgcagcagatccgccagaatgtcgacatgtacttaaccgaggaaatcccagatattttggaacagcttgaaaatcaatatgacagcagacttgacgatacaaacagacatcatgttattgaagacatcagaaaacaaatggacagcaggattcactattatatgtcccatatcaaaaaagaagaaaatacaccgcctgcacaatatgcagaacatatcgctgagcatgtgaagcgtgatgtcatccgcgctgtagaacactttctggagcatattccatcagaaatgaaaggagatgagcaagcatgatctttacagtcatcaaccgcagcttggaagtcggggatattcggatgaacggtgtgtccagttcctccgttttccacatcggagacactgaatccatctacctgtcttctatttttgatacaccgcctgaatctcttattattgggccgtttgctccgcttgcgccagaataatgcttaaacgcatatcgcgcatcagactagttaagtttaattctctcgggatcgcaagtgtgtttcaagttggcgacacaaatgaaatcgatatgagtgtaaaagtatttgctgtgcagcgttctctgtccacgttttaccataatgaaggctcatttaacaaaaaggagtatcagatctttcagcagcaggccgtgaagccgctccccgaaacaggtgtacaaagcgcgttttgccacgaggtgccggctatttatgttcgcagcatcaaaattcaaggggtctcagcctcttctgttttacatgccggatcagcttcgcttattcgcggtgatgcgagactcaaacatatcagacagattcagtctccgcgctcacaatcgcccgccaagaacatataataaacagagacttcgataaagggtgtcgtttatgccagcaattgtcgggcctatagctatcaattccatatcgggcggagtcgtaaactttggtgattccttttacctttctccgaaaagctcttcaaaatctgcgctcggttcgggagcaggaaacacgggagatttccttctattaaataatgcagtcaacgcgacaaattatatagaccccgatgtcaacgatcaggatatggttggaaacggataaaagcagccgctctgcaaagagagggctgctttttagtcattttttcttttttcgttcatttgatttcttagttttgatcagcttctcaggcggctgttttctgatccatttgacaaaccgggcaagctctggatcgcttctgagttcagccattccatttaaacgtacagcgagctcttgattggtatataaggcatgaatctgtttatgacaaggaatacagagcatcgctgtcggcaaaaacgttccgccttcctctttcggtgtaagatgatgctctgtcagctggacatcgctccggccgcacagctcacatattccggcaatctgctttgccatatccgctcctcccttacatcaactcaagtgatacccgcgtaccgcggccgctcggttcagccggatggacgatcagctttttcggaagccgtgcacgcagttcctgcacatggctgatgacaccgacagccaggttgtctgactgaagtttttccaaggccgttacaaccgtatcaagcagatcttgatccagtgtgccgaagccttcatctaagaaaaagaactgcagcgggtattccccccgaagctgaatctgcgcagacagcgcaagagcaagtgaaagcgaggtgaggaaggtctctcctccagacaaactggaaaccgggcgtcgtacgcctccattcgcgtcatcccgcatcacgaagccgccctcagaatctacttcgatggcatagcgctgtcttgtcagcatactgagtcttgctgaggcgtccctcgcaacgctttcaagctgctcctcagctaaaaattcgacgaaggtattgcctttaaacacagcttgcagcttgtccagcctgtcgatatgcatctgccattttttcagttcagcttcaatttcattaaaccgtttatgatggtcgcgaatgacagccagtgcttttgcggccgcgcctttttcctctatagcagcgccaaatgcgtcctcagcttcttgtaatgctgcaacggtttcgttccattcgctctctgataatgctctgccggcaagtatctctgctactcgttttaagtttgcagcattttgcttcagtttatccataaactggtctatgccggttttcatcttttcaagttcatcagctgggatgagactttgttcaacctcctcagtccgggtaatggaggtgttttttgtatgctcaagccaagcagcttttgctttttccaatctgcccttcgcctcttgaagagtgagctcgcttgcagaagcgcggcttttcgcttggttgagcttcatttgggcgctttgcagttcttcatataaagattgttctttttcctttaacagctttagatcctgctggacagagcggagtttgatttgaatcgaatctccttttgcataatctccgagttcgtgctcataatcagctatcacgctcttgatgcgttcagccgcataatgaagctccagcttttcccgctcaagccggtgtcccgattcccgcagtttttccttttgtgcttcatgctcagcaagaaacgcgatactcttctcaattcgtttttcacattcttctgcagcccggtccttttcttcaatggcttgctgccatttttctgcttcgtccacagattgattctgaaatgcttctttaaacatgttcagactgctgtccattgaggattgaagctcactgatgatgctttcaatacggtcggcttctcttttttcaaaaccgattttttcattaagctgctcggccttttttaaagactcctgataggcgccaatcatttgtgccattcgtgtcttaacagaaagaatgtcctgcttgattcgtttccattcaaatttggcagtttcaaatgcttcatacaccggctgatgttcgaaggaagctgccgcttcaaggttctgtgcttgaattgtctgcaaaaacggacactgttcaataaagcgcgcggactgttcttcaagcataattttggctgaaagaatctcctggctgagagctgcagcttccgtcaataacacatctgtccgtttgatgtcctcttcaagatggctgtcggcttcatacgtttcatgtaccgaggcagatggatcatgatcggttgaaccgcataccgggcaaggctttccggcagtcagcttttgggctaactcttttgtcagcagtgccacccttgctttttcacgctgtaagtgaagcgtgtgttgactctttctagcctcttccgtcatacgtgttaatgagcgttccgtttcgcacaccaaatggtacacagtttgaactgcctcatatgcctgaatgatgttgttttcttccgcttccgtcttttgaacgagtgtattcttctcttcattcatcttctgcagcacgaggttcaattcttcacttcgttttttctcttttttgatttgttcctcggtttgtctgatgcgcaatgccatctctgcggcctgctggcagctttttcgctcatcggatgtcacctgcagggatttgagctgctgcttcaattctgtctgtctgttttgccctcgtgtcaggcggtctgttacggtctctaattcattcatgacagattgaagagcctcttctttctgccggaggtcagcctttttgcgctcttcctcttgcttggcctcactcagtttgatttcgatttcctgcaagcgtgaaagctgttcctgtttggctaaaagctcaggctctttctcgcttttatgctggcgccacgcttcatactcttcatgtttttgctgaaagaaagctgtccggtctgctaaatccttttgggctagcgtttgttccttttcagcttgctcctcatgctggatcgcttctgcgtaccggtccgcatagggcttaagggctgctgctgtttctgcttccagcaggcgtttttgcatgctgtctatatgcggctgttcttctgcgagacgtttttcctcttcttcataagtggatttttccttttggacattccatatctcctgatgctctgtaaaccgctccttcgcctgatcacggttcttcctcatcgcttccagccgggcttcagcttgttcgagaaccttttcagcctgctccactgcctctgagctcgcctcaccgagaccggactgttcagcaagcatttcattttttctcgcattggcttcctgcgcctgccgtctcagctttttcacaagcctgtctccatattgctccaaattaaataaacgctgaagcatatgcctgcgctctgccccttttaaagacagaaattcagcaaatttcccttggggcagcaccaccgctctcgtaaaatcgtcgatcgtcagccctaagagctcctccactcttttattcacttcgctggctttatcagccagcaccgtatgctcgtccttgatttcgatgaagcggcaaagtgccgtttttaccttcatttcatccgttctcttaaacacacgctcgactttgtatgagatttggtgattcgtctgaagcgcaaaggtaaaggacacagacagcgtatcttcggcgtgatttaagattccgtgcgtattattcgccgcccgttccacctttccgtataaagcaagcgtcattgcgtcgagtatagaggatttaccgcttcctgtcgggccgaaaatgccgaaaacaccggcaccggaaaggccttcaaaatctatcgtctgctcctctctaaagctgtggagccccttaatgcttaaggcgatcggcttcatttcgcatcctcctcttcaacgcctgatgcaagctctaaaaacagcttcaccatttcttcatccggcaccgcaccgccagtttgtttttcataaaatttcttaaagcggtcctcgattgagacatgtttaacctcgatccgttcccggtctttgttctgttcttcaaaaaccggcctgatatggataaagcccgggtgcgccttccgcagcctgtgaatctcttcaagtgacagctggtccgcgacacggatttccaagtcaatccaagcattctgatctctgccttcatccagccagctgtacacctcacttaatccatttgccgctttccacttcacaagtggcttgccgcttgataataacacctcttgccaagtggcctcttccccaggctttgcgtccacaatcgtcactgatttagcgtagcccgcttcagaaaagctgtaggcgagcggagatcctgaataacgcgcaagcgtccgcgcccgcttgatcgtttgcgggcgatgcaaatggccgagcgcaacgtaagcggcatctgccggcaggctttcagcagccaccgtgtatgcaccgccgacttcaatcggccgctctgaatcggtttggtttccgcctgccacataaatatggctggcggcaatcttcactgcatcggtccggaaccggcttgtcatatgctcaaacgcctgcctgattttcacatcatagtgatcacggagcagcttttcatcaaacgtatcggatagcacttcatttaaccgcgcttcagatgggtacgccagcgctccaaccgccaaaagctctcctgctgaaggcacttcaatatgaatcggctctgttgtcggataaccgattaaatgaatgccgttttcatgtgtcagcggtgaagcggcggacaaacggtcaggattatcgtgatttccggcaatgacgacgatcgggcgctttcctctgtcgctaagcgcagacaggctttcataaaacagctgctcggctaaagctggcgggtttacggtgtcaaatgcatcccccgccattacaatggcatcgatctgctcatcctttacaatcgtattcagttcatccagcacatcggcctgttcactcagcctgcttcttccttcaagcgtttttccaagatgccagtcagccgtatgtaaaatccgcaaatgctttcacctctcttttatatagaaaacgagacccgctccgcctgaaattccggagcttatggatctcgctataatgtcagaatgtgccctccgtcaaagaaataaagcgcacatccctttacctttgtttttgcaatttgctccactgccttcgtgtacagctgaatttgcgtttcatatcgtttcttcaagatcggggccgctccttcaaatccatgctggaatttgccctcaatccggtccgacttataatccaatagatataatccgtcctcagtttcatagagacagtcaataataccctgcactaaaagcggctcatctgcctcgtgtgcatcaggatagatctccttggccggaagcgctaagctgaatggtatttcccggtccttccacttagcaccgatcagctgtccgccgatttctgtatggaaaaattgcacgatttcttctatatcaatagcgtctttttgttcttcagtgagaagctctttttcataaagcctgtgaaccgtctgctcagcttcttctatcgacggcacatgtgacagcgggatatgctgcataaccgtatgcatggcagtccctttctctgccgctgtcaggccttttttcatcataaaagcgggacgtctgtacagaatgcttccatcagccggttttacaggggccctgccgctgtattcatcctcgtactctctttttctcttgatctcagaaactgattgctttgtccgaatttgcgtcacttcttgatgcgggtaggtccagctcagctgctcgcgggctttttcatcaaacgcaaacgagccgggaactggttcacctcggcggatcgcttctaggcgctcgcttttttcttccattctttcttccagatcatcatcaagcaaatcataggaatggatcatttgaacggcaaaacgagccgggtgacctgagatgtcagcgtgtgctggcacaccagccaaatcccccaagtctctgtgcctggcaagagccggcccaatgaaatctagatacgttctcgcctgatagcggtcaaattccggcagaagccaatcagtttgggacgcggatgcctgccattttgcaagctgtttctgatgatccttacatgagccaatcagaaacagcttttccttcgctctcgttaatgcaacatagagcacacgcaattcctctgacagcagctccctgcgcatttttttcttcatcgcaatgagcggaagtgtcggatagctgatgcgtaattgcggatgaatatacttcgtgccaaatccgagctccttatccagcaggtacgatttgttcaaatccatcatgttgaaattccggccgagacctgctacaaacacgactggaaattcgagccctttgctgctgtggatcgtcattaagcggacaacatcctcctgctcgctgagcgctctcgccgtaccaagatcatcgccccgctcctgcatgcgttcgataaaccgcaggaaacggaacaagccgcgaaatgccgttgattcatattgacgcgccctgtcataaagaacacgcaaattggcctggcgctgttttccgcccggcatgccgccgacataatccatatatttggtgtcgcggtacacttcccaaatcagctcagatactgagtggtttttcgaaaacgcgcgccatttttgcagatgtccgtaaaacgtatttaacttttgataaagctcatcgctccggtcaccagcagccaggtagtctttcatcgcctcatagtacggcgcttttttattttcaagccggatcaaagacagctcgttttcatctgctccgacaatcggtgagcgcagcacagaggcaagcggtatatcctgatacggattatcaatcaccttcagcacagaaagcgcgacggcgacttcgaccgcttcaaaatagcctgacgttaaattggcgtaaaccggtatgccctgtgctctcagctcctccatgatttgcggagcccacggcatcgaacggagcaaaatcacgatatctcggtattgaatattgcgatgtgttttcttttttccgtcatacaccttaaacggcgatgaaatcagcttacgaatttccttagcgatggcttttgcctcaaactgcaccgtttcaagctcttctgcttcctcgcttgcatccgtatcttctgcgttgtcgatcagcagcagctctgtttccgtctcgtcattgtccggatacgctgcaccaagcttcagctcagcctgctcgtcataatcgacctcaccgattttgccgcccatcagctgtttaaataaaaagtttgtgctgtctaaaatatcagcccggcttcggaaatttttatttaaatcgattttccgccccgtgccttctccgctctctgtaaaccgtttgtatttagagaggaaaagaagcggctccgcaagcctgaatcgataaatcgactgtttgacatctcctaccataaacaggttaccagtctcctccggaccgcttgtgacgagctgcagaatcgattcctgcacgaggttggtatcctgatattcgtcaacgagcacctcatgaaactgttcctgataaaaccttgcagcctcgctcggctcacgttcacctttgtcattctcagctgtcaaaatcgctaaacagtaatgctccaaatccgaaaaatcgatgattgatttttcctgtttcgcagcttcgaatcgttttccatagctgatgacaagctgtacgagcgtttcaatgacaggcttcatctcggctaggcttttcaagtgctgttcaggacttcgcgtgaagtagtcggttttgagcttttcaagcagtttttttgcgccgttcctcaaatctgtcgcctcatcaaggagcgctggatcgaactcatccccttttactgctttggcacgcttaaaagagacggcgggcacccgcttatatagttcactgaaatcgtcctgatgctgaatcagttcatcaatctgagcaagatcatcaagaaaattgtcagcacgcggcgccgggccgcccggcgctttcgtcagctcaagcgcgcgcaagagcttttccttcgcccccgttaagcaccattgcaatatcttctttgacatattgataaaacggcagctcctcgatggcgctcttttctgatacatcatacaaatgaacaaagctttccagccacgcctccgggttgggatgggatcgggaatactcgtacacctgtttaacgagaaattgcagatccagatcatgccggtctgtcgtatagcggtcaacaagctcaaaaaacgccttttcgccctttgcgtattcgtcttcaaacagctcgtcaagcacttcatccccgatcagctcgccttccgtctgatcagctatccgaaagcccggatcaagatcgatcaagtagtaatatttcttcagcacttgcaggcaaaaggaatggagcgtcgaaatgctggcccggtttaaaagagacagctggcgtctaatatgcagcgagccggggcgctgtacaagctctttttccaaggcttctgcgattcggtgcttcatctctgccgctgaggcgtttgtaaatgtcacaacgagaagacggtctacatctattgggttttcctccgcggtgattttccgaatcattcgttcaacgagcacagcggttttaccagagcccgcagccgctgccacaagaatatcctggccggttgaaacaatggcattccattggtcatctgtccatgtgctgtctgccggtttaggaatgttcattgccatccgcctccttttttatccactcaagtattgtcttgtccttttcagcctttaatgggcgatactcgttttcttccagtgattcatcaaattggcatactgatttgaacgcacagtatgtgcacggcgtcttgttcttcattttgtacggctcaatggatacgcgcccgtcggtgatttgttcgcccgcttcttggaaggtgcggcgcacatgctttgtcaaaagatcaaattccttttcaccgactgctgctgagtctgatctgagagagccgtcttttttcaagccggcgtttatgatatttgaacgtccctcttgaagggttgtatccatgaggcgaaccacttcctgatcaccgaggagcaagcccttcattttaaatttcttaaagatctcctgttcaatctcgtcaagcccaagcgggagattagattgaatcatcgggtcatgaatatggaaatacagcactccggcaggcgtcgccctcatcccgagccagtcagctgaatgtgtaatcgataaatcaaggtacgtcagcatttgcagtgccaatccgtaatatacttccgctaagtcaaggcctttgtcgcttgatttataatcgacaatcctgaggagcaggccttttgagctttcagccttatcaacacggtcaattcgcccgacgagttccatcgtacagccgtttttcagttgaaaggtcagcggcggaagcggcccttttcctccaaagcccagttcaagcccgatcggtacgaatccgctcgctttcgcatgctcgcttaaaatgccggacacacgtgtcacaattttttgcagtttttccttcacataataatgccggtttgagctgagcagaatttccttttgcagtttcggtgccagccgctctaccgcatcataggaaaacagctcgcactgctccttcgttaaatcgcgccaatccagcttttgctcacgcagcctgtccgaaatcagctttaagctggaatgaaacagctggccgatatccggtgcttcaagcttgaagaattgccgttccttcaaatgcagcccgtgtgacgcaaaatgggaaaacgggcatgcgttaaaggtttccattctcgatacactgccctgaatacgttcaccatagagctgtctcgacacgctgcgttcaagctgcttcacttcattccggaaaaacaggcttgagaacagctttttcgattgcagcctgtcctgctcactcatcagcacattgtacgtgctccaccagacgtcgctgatgtcgtattcccgagtccataacctgagctggctcgcggtaaaggactgtgccacgcttttattcacaacatacatcagctgttcctcatcgctgacctgttcaggttcatttgttaacaggcgctccttatgatgcggaaacagttcttccagccgcttaacgatcatcgacggcaaaagcgtttttccttccgcatcagcaatcggatacgatacgtaaagccggtcagacggacttgaaaacgccatgtagatgaggaagtgctcatcaagcaaacgctctcgtccgcctgaggatagctcaaccccaatcgttttcagccattcccggtcatcatccgacaggaccccgttttcatcagggcgtgccggcagaacgccgtcgtttgccccgagcacaaaggtgcaggaggtgccatacattctggacaaatccatattgccgacaaacacctggtcaagcgcaggcggaattagagaaaatgtaagcgactccgcgccggcttctatcatttgctgaaacaaatcaagagaaatctcatcatctcccatcatttcaacaaactcctcaagcagctgaatgactgcgtcccacgcctgctgatgctgctgcgcttcaatgattctgccgtcatcctcagcacgctgcctttcctgatccagcttcagcggcacatccgtctcttctaaataacgatagagcgcctccgccttctcttgaaccgtcttcgcttttttcatgcgtttttgaagctgaaaaagcggcggaacaatccaatcgcgggtgtcattcaacatgttttccatttcgatttcctgatcagtctgcgcaaaatcatcatccaatgacacaaaacgcctgtattggaaccgatcgccctttgtccagcggtcgcctttaataccataggcgatacagtaattttcgagctgatcgacctgttctctcactttggccttcggttcattgagcgggaatagcagttcggttttcacgcagcgaaacaccgcttcataacgccaattccctttcagaacatcaaggctcgaccggataaattcaattaacggatggttcagcatagatgcttttccgtcaatgaaataaggaatctcgtaatctgcgaaaacttccttcaccatatccttgtagtcttccggctggcgcgcaagaattgctacatccttatagcgatatcccttctctctgactagggcgtgaatttcccgagcaatgccttccagctcagctcgtctgtttgcggcctgcatcacagtaagggcttcttgtttttctgcgtatggaatggccggacgcgcttcatactgtgcctctagatgcgccaattccggcgtctttgtatgccgctcagtcccgctcagctctttatacgtaatgtccaaattcagttccttcgccttctgatgcaggcggtaataggttttccccgtcattctgaacaattccagttcatgcggctcccgctcatatgacggcttgtccgctgtgagcgaaaacgtgatatgctccgcatgaaccataagctgctccaacaccctgaattcctgcggggtaaactgataaaagccatccacatagatatgggcgccttttatatcttccgcaagcgggatatgctctgccagcaatgtcaaataatcctcagagtgaagatattgatctgcgaggcttttttccatttgctgatacagaattgataagtcatggagcttttcagataaaacacgttctccgcgatactcggaagccgttccgctttccgccatccggcggatatcctccggttccagacaatagcgcttaaactctgtcagcatccgctcaacctgtgcggtaaacccgcttttgtcactcgctttttgatagactttgaactcctgtttatgctcctcaatgagcttccgcaggagcatttgtacgccggtgctcgtcagaaacggcctgctcattcctcccgtatgctggaggacgcgccaggccaatcgtgaaaaactgaacacttgagcgcgtatcatcccgcccatatctggcgttttagcaagctcgtattccattaaaaacgtcatttgatccgggactagaaaaatgatcggcttcccgaatggagcccggcgcaattcatcctgaatgctgttgatgatcagcttcgtttttccactcccggacctgcctactaaaaactctgctcccaaattagaagacccctctctttttatctctctatattttatcgaatgttgacgaaaatgaccaatctgatctattggtaaaaacggccttttcacatataaaaagctgattatctccgcacatctctccctgcccaacatatacttttacagaagcccaattcctaagaatggagttgaatccccttgcattacagctactatccctatccggtgccataccgggaagatcctgttttgattcggaatttgcagaaggccatcaacggagaattcagtgctattcaatgctaccgcaagcttgccgaactcgcccacagcgatgaggtcagaaaacagattgaagaaatcaggcgtgacgagattcgccacctccgtgaattttccacactgtatggttcaattaccggcaaacacatcatgccgaaacaaacggaagaatgcccggacaatttcacaagaggactggacgccgcttttaaagatgaacaagaaaccgtcgacttttacttgcgtgcggccgaggaaacgtcaaacttaaaagcgaaaggcgtctttacgcgcgcagcacgtgatgaacaaaatcacgctgtctggttcctatactatctgatggaacgttagatatacccattcagggtatatgtacatatccccttagctaaaaacacactcccctgtttttttcaaatgcagccgtgaaacataaaaccatatactgtcatacagggggaatcaaccatggagcaatattctgaggcttgtattgaggcttgcatcgattgcatgaaggcttgcaatcattgtttcactaaatgcttggaagaaagcgtgcagcatcatctcagcggatgcatccggcttgacagggaatgcgcggatatttgcgcgctggcggtcaaagccatgcaaacggacagcccgtttatgaaagaaatttgtgcactttgcgccgatatttgtgaagcatgcggcactgaatgcggaaagcacgatcatgatcattgccaagcatgtgcgaaagcctgcttcacctgtgctgaacaatgccgcagcatggcagcgtaaaaaagagggttcaaaaaagaaccctctttttatttggacagccatacggagtacaaatcaatccatccctcttcatcaagcaccaggccttttacatttttacttgatgtcacctggagcacattttgatacagcgggatcgcgttcagctcctgtatcatctgccggtcaatgtcacgcaggatgttgattctcgaacagcggtcaggcatggaaaacatccgctctgtcattcctgagcaaatctgtgtcagcttttcagatagatgctgatacaagaaactgttctccgacagcagcaaatgcagaaaaccaaactcgctgtcttgataaaacgtcgcactgtcatgaatgatatccgccatctgcacgatttccggccgtcgcagatcagcagcatcacagaattgaagtgtaagcctgataccgtgctgggcgcaaatattttgaatccattcggcgtcctcacgatgatccgtttccgaaaaggtataaagcacgattgtttcgccctcgtatccgctttttttcaacaattcagatggcgaaacgccctcccactcaaaaggactcggatgcaaaaaggacgtaaccggaattcttcggtgccctcccgcttcacgaacgagccgttcagaggaaatcagcagccggagcgcttttctaaagcttcggtgctgaagaggccccttctttttcagattaagcgacaaatactgaacatgccgctcatcaaagacagtttgctgctcaggacatgtttgtttttcttgaatggtaaaaccgttcatctctccggcttgctcagaaaacacaaactcaacgcgatccaaataggggcgtcccttgaagtagcgctcattggcttcaagcacaagcatcccgctatgttgctgattcatctgaaaaggccctgttccatttttcccgccgccctgttctgccggcagtatggacagccgttcatcacaaagagcatacggcaaaagcgcattcggcttatcgagtatgagctccacacaataagggcccttttctaagacttgtttcactccgtgcagaagccatttatacgggttgtcagccagttccaaaaagcgctgaaatgtaaacgcaacgtcccgcgatgtcagcggctgtccattatgaaataacacaccttttcgaagaaaaaatctccattgtttttttccgacctcttcccatccatgaaccaaatgaggcttcggctcctgcatatccgaatcaaacgtgaagagtgtatcaaatatctgtttgacgaaatggccctcagaccgcaaaaatatttggcatggatccaaactgctgacagattcaggcgtgatgaacagccgcaggacatccttcgccccattctcgcctgtctccgtcacaaatccgaatacctctgatagccacatgttatattcgttttgaagccctggaaacgcggactgatactgctgaagcagctcctttgcctttttaagctttcctgacatggtatattcctttgcagtttgaagaagcagttcctcaggcctccgaagaaacgcgattttagatttgcggccgcgccccgccccgctttcccggataatccaattgctgttctccagcttatgtaaaatgagctttgcatttctttctgtacaaaataaacagtcggcaatctcagtgagcgtcatttcgttcatttgcccatactcggcgcagcctgtttttacaagcgccacgtagtgctctatcagcttcaatccccgcacctcccgacaaaaggggaacttttatctcttcttttcttcactttttgggccgccgccccttctatacactactactatatcaaacagcgaaaggcggcgatcacatgttgaccagttttcactctataaaatcgagatataccgctcccgttcggctccgctttttcggcgaattgctgacaagcctgacaggtgcaatgatgggaccttttatggtgctgtatctgcatgaacaattaaacggcagtatcatgatgccaatgctgatcatcagccttcagccatttgctgatattttcctgacgctcgctgcaggacgggtgacggatcggcttgggcggcgcacagcgattttgaccgcattgcttcttcaatcagcggcaatgacagggtttgtatttgctgagcatgcgtatgttttcgctattctctatgtcatgaatggcatcggaagatcgttgtacattcccgcttcccgcgcccaaatcgctgaaagcacgccggaaagcagacgttcggaagtgtttgcggtcatcaatgcgatctattcgacgggtctgacggcaggaccgctagtggggatgctgctgtacaatcataaccccgtgtggatattcgcattagatgctgcagcattgtttatctactttctgatcgctgcactgaaactgcctgagacaaagccgctacacccagctgttaccccgaaaatgtccgcgagctttacaatatacaggcctgtcctgcttcttttgctgctttctctccccatcagcatgttatatgcacaaacagaaacaacatacaggctgttcagcaaaaacatgttttctgattatctgtccatgctgaccatctattcagcagcaaaagctttattcagctgtgttctccaagtacctcttgtcaaagggaccgaaaagctttcaatgaaaacgatcctcttcattacttatatttgctactcccttgcggcagccggctttgcatgctcaacctctctgacaatgcttttagtgacggcagcggtgatgacggttggtgaaagcatcgggctaacccacatccagaccttcatatcgaaattggcgccgcctcatttgctgggccggttttatgctgtctatggtctgcattgggatatatcccgctcaatcggaccgctggcaggcgggctgatcctgacatcatttggcggagaagtgattttttacgctcttgccgtgtgtctgctgacagcgggtttatctctgacttacacaatagaaaagctcgaacacaaggtcataagaaaagtgaatcgcttatagaaaataattcataatttctttatcaacaaaaatatactatagtaataaatacattcactacgtgaacaattggagtgttacgtgaaaaaggaagaagggttttacattgaagaaagacgaaaatctcctcaaagatctatggtttatcgcaatcagtgcagccggggggtttattctttcattaaccggaatatcaattggatggatgatcggaacactgattgtcgcctgctgcctcgccatgatacggccggcatggctgatgatggcaccagaccaaaaaggaattaaccgacgatggctcgccctcgggcagatgatcctcggcatcgaattgggccaaaagctgaatttatccgttctctctgttctcaaagaccattggttttcagtcggcgttatgctgatattgtctatcctgctggccatgctgtcaggatatgtgctttggcgtttcagcaaaacggatatgatgactagctttgtcggcaccgctcccggcggactttccgccatgccgagcatcgcacaggaagtaggcgccaataccgctatagtcagcctcgttcaaatgatgcgtgtgctgctcgtggtgctttccattccgtttttagtcattctgatctatacaaaacaagatcgtaccgcaagtgccgcagcagagacgatttcttctgcaacgacagattttaggctcgctcccgttttgtggaccgtcattcttattctcgctgcctggggagcttgcaaagctgcgaaatttttaaaatttccagctccatggctgctcggcagcatgctcggtgtagcaattgtacatgttggcggagctgcggtgacagggcacgacatgacggcatggtggttgtcacaagctaaccatgtatcacaagtatttctcggggcaacgatcggctctaagatgtacaaaagcatgtttgccggcgtcacccgtattatcatcgtcgggtttgtctcgtccgtcggtttaatcgcagcaatgtttttgagcgccgtgatcgtttccgagctgacaggaatttcgctcatcacttctgttctggcatttgcgcccggcgggattgcagagatggcgacgacgtcagttaccttacatgctgattccacctttgtcgttgcggttcaggtcattcgcgtcattctggttattgccctgctgccgccgttttatcgcctgcttcaccatcttcatggtgaaaaaaaagacaaaaagagctcaatcagcggcagtagtgcctagttgaaaaaagggttcaagaacttttaattcgcaaaccatcgagatgaggaaatataagcggatatttcgttgttaatggatcagatttgaagtgagtgctgccagagggtgaaatgaaagaaataattgacgacttacgattgaaaaagaggttaaaatgaataacctctttttcttatataaagatataaaatgttaaagggaaatctatcgttacgttgattctcttataataagctttgttggcagtttaataattcttctgtttaaagaggcattacccgaaatggactcgatgattttcaacacagcctgttggcctaattctattacggggatatcaattgttgttatggtcggagtaacgacttggcaaatcaattggttgtcaaaaccaattacagctaagtcttctggaactttaaagccatttttcatcgcctgtttaataatccctgcggcgacttgatcatttcctgtaaatattgctgagggtctgtcctttagatcctttatcttatgaaaaacacgaaagccatcctcgatattaaacatttcgccgaatatccattcgcttctatgatgtaaattgtaatcttgtaaagctttcaaataaccctctttcctctgacattgagcttcgctatatggagtatcaaaacaaaacccaatttttttatgccctctttcaattaaatgtactacccccatgtatgcggcttcaaattcatcatacccaattatcgtgatgtccgctgagtgatgatattcattacataataagataggaccatactttaagaaaggggatatctgatcccattcattttctaaagtcccaagaataatgccatccacttctttatgcttcaataactctagtaattctagctccgtctgtttgtcataaaaggtctgaaatacaattaccttgtaattcttaaacagtgcttcatgagagaccccttttattaattgagcaaaaaatggatggtcgatactcggaaccgataaagctatcgtttgtgtcttatttctcctaaaattccgagctaaataattgggagtgtagtcaagttcgttaatagcctttaagatcatatctcttttttctttcgacacataaggatgattattcaatactcttgacactgtggttttagacacattgcataattttgctatttcatcaattgtaggcatattttcccttccttaaaaaagttgttgacatgttaccgatttcagaaactaggataaatttgtaataaatttttagattataaaatcattggaggtactgttcatgcaaaaacaggttaagatttcaggtaaaagcaaagaaaacatgtcactattaaaacacttaaaaggtgacgtacaaggaaaagaacttgttattgaagacagtattgtaaacgagcggtggaaacaagtattaaaagaaaagatagatattgaacatgaccttttcaactatcaaaaaaatcgtgaaatcagtaaagtcccttttttgcctgtagacagattaataaccaatgatgaagtggaagatatcttaaatacattaactgaagttttgccaactggaaaatttacgagtggtccctatttagagcaattcgaaaaagttttatctacatatttacataaaaggtatgtaattgcaaccagcagtggaaccgatgctattatgataggtttattggctttagggttaaacccaggggatgaagttatcatgccggctaatagcttttcagctactgaaaatgctgtgttagcttcgggaggcgttcctatctatgtagatattaacccacaaacattctgcatcgatcctgacaaaattgaagaagcaataactccttatacaaagtttattctacctgtgcatttatacggaaaacattcagacatgcagcatatccgtcaaatcgcaaatcgttataaattaaaagtaattgaagatgcctgccaaggaattggactgacagacttaggaaagtatgcagacatcactacattaagttttaatccctataagaattttggtgtatgtggcaaggctggggcaatagcaactgataatgaataactcgctaaaaaatgcattcaatttagttatcacggttttgaagtaaatgtaaaaaataagaaagtcatcaattttggatttaattcaaaaatggacaatttacaggcagcaattggtttagagagaatgaagtacctttcattaaacaacttcaaaagattgttcttggcggatagatacattacccaattagcagagttgcagaataaaggctatattgaattaccagaattaagtgaagatcatgtatggcatctgtttcctattaaggtaagaacagaagatagggcagatatcatgactaaattaaatgaagattttggtgttcaaacagatgtatattatccaatactttctcatatgcaaaaaactcctttagtacaggacaagtatgcaggactccaattggttcatacggaaaaggctcatagtcaggtactgcatttgcctttatatccgtcatttactttagaagaacaagacagagtaatggagggactgtttcatgttattaagcaagaaatcggagtataaaacgttatccacggttgaacatcctcaatatattgttttttgtgattttgatgaaacgtattttccgcatacaatcgacgaacaaaagcaacaagacatctatgaactcgaagactatctagaacaaaaaagtaaagatggggagctaataatcggatgggttactgggagcagtatagaatctattctcgataaaatgggacgaggaaaatttagatattttccgcattttatagctagtgatcttggaactgaaattacgtacttttcagagcataacttcggtcagcaagataacaagtggaacagtcgcataaatgaagggtttagtaaagaaaaggttgaaaaacttgtgaaacagctgcatgaaaatcataacattcttttgaatcctcaaacccaattaggaaagtcacggtataagcataacttctactatcaggaacaagatgaaataaacgacaagaaaaacctattagctattgaaaaaatctgcgaagaatacggcgtttcagtaaatataaatcggtgtaatcccttagcaggcgatccagaagacagctatgatgtagattttatccccatagggacaggaaagaatgaaattgtaacgtttatgttagagaaatacaacctaaataccgaaagagctatcgcatttggggatagtggaaatgatgttcgtatgttacagacagtagggaatggatatctgctaaaaaatgcaacacaggaagccaaaaacttgcacaaccttataactgatagtgagtactcaaaaggaattactaataccttaaaaaattaattggatcatgaggaggaaataaaaatgaagaagataggcatcataggtgcaggtggtattgcaagagcgcatgcaactgctttatctacaataaaaaatgcagagttagtaggggtatatgacataaatcaacaaaatgcggaaagctttgtgaaaactttcggcgggaagtcatttgaaaacgtagatgaactaattgatgcctcagaaggtttaattgtagcatcaccaaacttttgccataaagaacatgctttgcaagcattaggaaaacataagcatgtattatgtgaaaagcctatggctatttctcttgaagaagcaagcataatgaaagatactgctgaaaggttgagcgtaagagccagtatgggatttaattatagatatttatcttacgtaaatatcttaaaaagcttaattatcaataatgaactaggtaacatactgtccataaaagtacacttcaagaaaaatagtgcacttagacgtaagaagtttacttggagagatgacgctaatagtaagaagacgagtggatcattgggggatctgggtattcaccttattgacatggtatggtatttgttcgagagtgatttcatcacagaatcagtaagggcaaagatgaacacaaatgtaaaaacaaaagaggataaacaggtacttgtagatgactatgcagaaatttatggccagctgaagaacaaggtatttgtaaatatcatcacatcaaagtgttctgtacctgaagactgtggttttagcattgaggtagttggacacaaaaaagagtttaaataccacacaggtaatcctcacgtttacaagctcatagatggcttgaacgtggtagactgcccagtaccgcaaagcctattaaacgatccgccaaacgagttttatggatgggctgattcttttagaagcgagttaatcaattggattgcatcaactcagaatgattgggttgagatcccttcttttagtgatggttttagatctcaggaagtattagaaatgttctttgagaaagacagcaactctcaacccatgtctgtttcagcagtcaactagtatttcaaagagagaagttactaaaaaagcaggaatttactttcctgctttttcatataggggtgtaatgaatgttaagagggacatatttatttggatatgctttcttttttacagtaggtattatccatatatcaacagggagtttgacaccatttttattagaggcttttaacaagacaacagatgatatttcggtcataatcttcttccagtttaccggatttctaagcggagtattaatcgcacctttaatgattaagaaatacagtcattttaggacacttactttagctttgacaataatgcttgtagcgttaagtatcttttttctaaccaaggattggtattatattattgtaatggcttttctcttaggatatggagcaggcacattagaaacgacagttggttcatttgttattgctaatttcgaaagtaatgcagaaaaaatgagtaagctggaagttctctttggattaggcgctttatctttcccattattaattaattccttcatagatatcaataactggtttttaccatattactgtatattcacctttttattcgtcctattcgtagggtggttaattttcttgtctaagaaccgagagtacgctaagaatgctaaccaacaagtgacctttccagatggaggagcatttcaatactttataggagatagaaaaaaatcaaagcaattaggcttttttgtatttttcgctttcctatatgctggaattgaaacaaattttgccaactttttaccttcaatcatgataaaccaagacaatgaacaaattagtcttataagtgtctcctttttctgggtagggatcatcataggaagaatattgattggtttcgtaagtagaaggcttgatttttccaaataccttctttttagctgtagttgtttaattgttttgttgattgccttctcttatataagtaacccaatacttcaattgagtggtacatttttgattggcctaagtatagcggggatatttcccattgctttaacactagcatcaatcattattcagaagtacgttgacgaagttacaagtttatttattgcctcggcaagtttcggaggagcgatcatctctttcttaattggatggagtttaaaccaggatacgatcttattaaccatgggaatatttacaactatggcggtcattctagtaggtatttctgtaaagattaggagaactaaaacagaagaccctatttcacttgaaaacaaagcatcaaaaacacagtagaaaacgtataaaataaagatactaatagacatatcgtataagcagtgcaaattcctgaacatcttgaatttcattcttcaagaggaaatctgatttacgttacagccttgaaaaagatagaaacaaagcgaaaaacacgcaccgcagtgcgtgttttttatttaaaaatgctaggaagccccccttcaatttcttctgacgacggataccattttgtcaccagatcccgaaacagccgttccgcaaaaagaatctcttcctcggtatagcggtcaaaaaatgacagaaaacgctgttcagccttctgatgataatatttgtgcaaactgtgcagcttttttccagcaggcgtcaatcggaagtagacctcctttttattatcgctgagctgtgttctgtgaaggaagcctgcgccgagcaattttgtgctgatgcgtgatacagtcgcttttgtcgtattcattttttctgctatcgacgtgacattaattggttcattgtccccgacacaggatagaacatgaatttctgtcatcgtcaattgagatttactcccgtgctctacatccagcttcctcaattcgtcagataaaaaggctttaataagcccctcccatttctcctgctgatgaatgagctccgcatacaattcaaaaagattgcgtttcgtatgatctgtgttcatcgggttttccatcctttttcattcgattgtttcttctatcataccgttttgttacagatgaaacaatcgaattgaattatactcggctggtgacggaaaaccagcggctgatccctttttgaatcacctcggaacaatcgggcgctgatgcatccaccgcccaggctacatgtccatcgggacgaatcaatatggtatgcacattccgcaacttttcattcggttctgcaagcgaggcggttaccgtacgtaagccttttacttcgatatgatcatcagcttcctgcctcaatgacagcaaaacgaatgtcccgttttggagaaagctgtacagccgttccgaattgccgtcggaaagaatcagcttcatgtcagggagccttgccccgttcaaacgattcggcggcatggtacgatcagcttcatatctgacatcgagcgcagaaatttgccccgctacatatcgattcacatcagggaaggccagcagctccgacatcatgcttcgcaaatggaggcctgcttgagtgaaatcgatcagctttgtctgtgcctccgtgtttctgaggagcccttccgctgccggatgccgctcatcatggtagctgtccaaaagccaagaaggcgcagagcctttgatggccgccgccagtttccacccgaggttcattgcatcctgaaggccgacattcagtccttgcccgcccgccggaaaatgaatatgcgcggcatcacccgcaagaaagattctgccgtcccgataccgtttcgcttggcgcgcggcgttcccaaaccgcgacatccacgaagggtcggttaaaccgaagtcagttccgcaaattcgcaggaggtcagctttcagctcttcctcagtcacaggcacatctttcggcgtttgtgtgcgataagggctgatcacaacgacacggtatcggtctggagataacggaacaatcataacaccgccctcttttgtgcaaagggacagcacacctgacggcggcggagaaaggagcaccacatccccaagcgcagcggtgacagtgctgtctgttcccggaaactcaattttcgcctgtttccggacggtactcccggcgccatctgccccaacggcaaacttgcttgtgatcgtccgtacactgccgtcccgatccttaaaaattgtttggaccgcttccccgttttgcgtaaccgccagcgcctcggcaccccgaaacacctctgttcccaggcttcgtgcatgatcttcaagaagcttttctgttttggactgcgggagcaaaagcgtgtaaggacagctcgtatccaagcctgaaaaatccagacgggtatccagcattgaaaaatgtccggtaggtatcttgcttcccttggatacgaaccgctctaaaatccctctcatctcaagaagctccagcgttcgggggtgcagcgtcaacgccttggaatgcggaacaggtttttcaagccgttcaatcacacatgttcccactccggctattgcaagctcagaagccagcataaatccaaccggccctcctcctataatcactgcttcatatttcatcatcattcaccactccttttgtttcatgaaaaacgaacaaaaaccaataaaaacggccctccagtcaaaaaaatatataaattttgttacacaggtaacaattttgattatagctccttacaaatttttcttcaacacatttttccaaacggcatacaaaaagacgcctcttcaattagcgtctttttattcggcatcagaaatcacaccgacaatatttttttctcttatcggaccaaaatgccggctgtcgaagctgtatatgcgattatctccaacgacaaaatattttcctttcggcaccttgcttgttcccgtcacatctttcaaagaaaaatcacccgttacatggctgccggcagaaacagatttcaaatgcttcaaaaatggctcagcaacctgctttccgttcacatacagctgatcatctttatatttgatcgtttcaccgggcaagccgattacccgtttaatcagcactttatgatcagggcctttaaaaaggacgatgtcaaaacgatggatggttttaaatcgatgcgaaaatttattgaccaacaattcgtttccttcctggaaggtcgggttcatactgacgccttctaccttgtaatcaataaagacagcatttttaacctgaatggcgagaacaacggacactacaccggcaagaaaccaaaaccgttttttcatgttactgtctccctccatcatgctcacgctgactggctcttacatgcagataccgctccacctttttgccgacataccataagacagtgatcaccaatacggcgatgaccgttcgaatcggctgtgtaatcagcgcgtgcagatcatatccgatgaagctgatcataaaaatcatgacaagcttccccgaggctgccgccaaaataaacggccgcgttccgatccttgacaaaccggcaacaacattcaccgcggctgacggtgtaaatggaaaacaaagcagaagaaacatgggaccgaagccgtgtctttccacccataacatcagctttctgacagacggatgactgcggataaatccaagcaattttctctgtccgtattgacggacaatcaaaaagacgagaatggaaccagcagttgatcccgcccaggataggatgaatccttcccacaagccaaacgagttcgtattcgccaccacaaacacgatcagcggcaaaaacgggagaaatgcttcaattaaaggcagcagcacagcaatgagcggaccgaaagccctatagctttgaaataattcagttaaatgttcttgtgtcaaataggataaaaaatgctccaacatttatactccttaccgggtttgtctatccttattctacacattatcagcagaaaactaaaaagttttggtgattttttctgtcttgaaacatttcaccagccgatatagaatacaaatagaacaaacgttcccttagaaagaaggagtcaatatgccaaatctgcaggaggaaatatacgatttaattgaacgggctctctttttgcccatggccattacgatttttaaccgtgatctcgccggaattgaagaaagcacattaaaattgaagcatccttataaacagcttatcagcgaatcattaaaaatagcacaaaaggatttgatggaggtcagaaaagaactgaggaaaagaaaaattgcaatccgcgagacggaacgcgatgaggcctttacactctatacatttgtcatcgacggttatgaagaaaaccatcgctattttaatccgcgaatccgtgagcaggtcagcgaattattaacatactatctatttgccccagacagactctgagccttttgaatcatactgcccgttccctcttcgggcgattcagagcattaatttcagacaattcacactatacaaacaaaataaatttatttataattcgaaccacagcctttcactccaaaaaatgacatgtgctgcgatatctgcgacatcattttcagtacgcttaggcttgtacacctcaatcctaaatagaaggaggattctatgaaactgattcacgttcttgccgctttaccctttatcggaatcttactcggcatcccttttgcaaataaggtgaccccctatgtgttcggcatgccgtttattcttgcctatattgtgatgtgggctcttttgacctctgcgctgatggcgattgtgtatgtcctcgacaaggaaaataaaaaggaggaagcagaatgaatgcagctctcatcatcatcttcggtgtcctgctcttgagtatttttctcggtatacgcgcccaaaaaggaaaagacatgaacctggagcagtggacggtcggagggcgcggcttcggaactgttttcgtcttccttttgatggcaggcgaaatttatactacttttacgtttctcggcggcagcggctgggcctacggaaaaggcggtccagccttttatatcatcgcctacggatgtctggcctacatcctttcttactggcttcttccagcagtttggacgtacgcgaaacagcataaactgatgtcgcagtctgattttttcacaaaaaaatacaacagtccgctgcttggcattctcgtttcactggtcggcatcgccgcactcattccctatcttgtactgcagctgaaaggcctcgggctgattgtatcggaaacctcgtacggcaaaatcaccccgaccgctgccatctggatcggcgctgtttccatcacggtttatgttatggtttcaggcattcacgggtctgcctggatatcggttgtgaaggacatcatgattctggttgtcgttctgtttttaggtgtgtatttgccaattcattactacggcggatttcaagacatgtttcagcagattgaaacggcaaagcctggctttcttacgctccccgaatcgggacaaagtgtggcctggttcagttcaaccgtactcttgacagcgcttggtttttacatgtggcctcacacgttttccgcttcgtattcagccgaaaacccaaaagtgtttcgtaaaaacgccatcatcatgcctttgtaccagctggtcctgctcttcgtccttttcgtcggctttgcggctatcctgcaagttccagatctgaatggcgcagacggggatttgtcgcttttgagactgtctctgcaagcatttgacccttggtttgtcggaattatcggtgctgccggactgctgacagcacttgtgccagggtctatgatcttaatgtccgcctccacactgtttgcaaaaaatgtgtacaaggtaatcgcgccccgcacgacagaacagcaagtatcggcgcttgctaagtttttagtgccggtgattgcgctgatttcggtgtattttaccttcaaaggcgggaataccatcgttacgctgcttttgatgggctacagccttgtcacacagctattccccgcccttttgttcagcctgctcaagcataatatggtgacaaagcaaggagctttcgccggcattattgcaggtgtcggagcagttacttatattacaatgacggaaacgacgatcggcactttatttccggctctgccgcaagccgcaaaagacttgaatgtcggcatcgtcgccctgcttttgaatatcacggtcatgatggcagtcagccttatgacaaggaaggcgaaaagcgctgcggccgatcaggcggcctaagcataaaaaaagcaatctggacaccagattgctttttcttatttaccgttcacaggcgataagatctttatcgcggtctttgtttttattggcatcgtaaagtgccttagaaacgtaaggcttgtacttcgtttttccgcctttgtttttcaccttcgatgtgcgggccactccgcctttgtatactttgtttagctccttgcagttcttatagaccttcacctttgttttggcttccgccacatggccagctccgtatgaaaaaccgaaaacgagaccgagtgacagcaaaaccgccgccgcttttttcatgacgattcactctcccaacacccaatatttagttgatttatagctcgaatttatcataattcatatagtcttatttgacaagataaatatggaagaaggctttgtttttcttgttttctttttccttcactattcaaactgccaaaacatgtttttctgcttatgctcaggggtacacatacgaatgtacaccaaacagaaaaggagcgttgctgatgtctgattcaaatcttacgaatcctataaaagcattttttcatgatgaatttcccgaacaatatcaagaaccgccaggcctgcaaaagaacatgaagcctgtccctgattgcggagaaaaaagctacaaaggatcaggtaaactaacgggtcgaaaagcgcttgtcacgggcggcgattccggtatcggccgcgctgccgcaattgcttacgccagagaaggtgccgatgtggctattaactacttgcccgaggaacagccagatgctgaagaggtaaaagagctgattgaagcagaaggccgaaaagcagtgctgatccccggagacttgagcgacgaatccttttgccaagatctagtcaaacagtcgcatcacgaactcggcggacttgatgtgctagcgctcgttgcaggcaaacagcaagcggtcgaaaacatcgaagatctgcctactgaacaaatctataaaacatttgaagtgaacgtcttttccctttactgggttgtaaaagcggcgcttccgtatttgccggagggagcttcaattatcacaactacctcagttgaaggctataatccaagcccgatgctgttagattacgcagcaacgaaaaacgccattatcggctttaccgtcggactgggaaaacagcttgcttccaaaggcatcagagtaaattcagttgcgcccggaccaatttggacaccgctgcaaatttccggcggacagccgacggaaaacatcccgaaattcggacaaggcacgccgccagctccattaaatcgcgctgggcagccagtggaattggccgatgtttatgtatttctagcttcagagaattcaagctatgtgacatctcaggtatatggcatcaccggaggaattccgacggcatagctttatgaaaggagctgccctgttcggtcagctccttcctatttttctaataccgttccccgagctcacgcaaaataaaatcataaatcatcttcgtccgctcttctttcgggtacagcataaattcctgtcttttcggcacgcggtggtcgattctgtcttggaatttggttctgagccacgctgttcggtatacctggttctcgaacgaattataagagatcggcagctccatcgttttcccattggaaaacgtcacttccgtatcgtcgaattcagtcgctttgaattcttttacatgcacatgggaaatccagccgcattggggtcttgtcgaagaaagtgtagggaataaaaagatttggttcgaagggtccaccatgatcggcggcttgtgtgaaatttttgtcacttcataagttcctgcttttcttcccgcatagcttgatccaaaaaatcggcagcttctgtcgacaatttgcagcggcttcatgtttacataaaacacgcaatctttttcaataattttggaacagattttgccgtctatttcttctggcagcacggcaattgttgcgccgttcacttcatacgattctaaaggtgcgtctgttttctgactcatattatggcctccatcctttttctgcaaaatttatactaataatctatcatctgtttttgtaaaacgacaggtttttttaacatttaagataaaatcatcttttaatgatatttaatggtactaaatgactagtaataaaccgattttactttcataagacttgccggtttacggcattttgcaggatatgtcgatagattgccaagtattagttgtctaaaaattataaaaatttattgattttttcgaccgttatccatatactataaaaaaggcattggggggattctttatgaaagagaaaaaatcgtacactgagctcatgaagtcccgcaacacgcaaaaaacaaaagaattcgatgtcacaatgacggatatttacattcaaatggtgctcgatgaatccttgtataaccgtcggcttgccatgctgacggaccaaattaacaaagccttggacgaaaaagataaagatgcgtttcttacgctctctaaagaatatgcagcgctcaagcagagcgaataagccaatccttcaaggattggctttttattatccgttcacaattgttccgccattgacgtgaatcgtctgccctgtgacgtatgtggaatcgtcgctggcaaggtatagatagcttggcgccacttcgaccggctgccccgggcgttccatcggcacgtctgaaccaaacacttccacgtcttttgcggcaaagctggccgggataagcggtgtccaaatgggacccggtgccactgcattgacccgtatgccctgctgaacaagcgactgggaaagggaccttgtaaacgtaacgatcgcgccttttgtcgctgaataatcgatcagcgttttattgcctttataggcggtaattgaagcggtattaataatagagctccctttttttaaatgaggcagcactgcctttgttaagtaaaacatggaaaaaatgtttgtttggaaggttctgatcagctggtggctggtgattttttcaatgctgggctggacatgctgctcagctgcattgttaaccaatatatcaatggatggaaacacttggcttgcctgcccgaccacatcattgcaaaacgcttcatccccgacatctcctgcaatcagcaggcattttaccccttccttttctacatactgctttgtttcctcggcgtcctgatgttcattcaaatacacaatgaccacattagccccttcttttgcgaataacaccgagacagcgcgtccaatcccgctgtctcctccagtaataatagcggttttgccctctaattttttcgctttcttcggcttatcaaaaaccggacgcgggtccatcagatattcaaaaccaggctgctggttctggtgctgaggcggtaatgttttctttttttgattcgccaatgaaatcactccttttcaaccttattatgttatgaacaatgcctgcttcctatgtatgaaaagatagaatatggaaaaattaagaataaatctgattggaggtataacggcttggctaatcaacattttgcaaaggaagcacctgaaacatactggaaaacatcaactgacctgccttcttttcctgcgcttcaagaggacactgaatgtgacgtcaccattatcggaggcgggattacgggaatcacaacggcatatgaacttacgaagagaggcttccgtgtcgttttgattgaagcaaatcaggttcttaacggaaccactgcgcatacaactgctaaagttaccgcacagcatgacatgatatacgacgaatttatccgccatttcggattaaaccatgcgaggctttattatgaagcaaaccaaaacgcaattgattacataaaaggcattgtggatgaacatcaaattgattgtgaatggatcgagcaagacgcatatctttatacggcaaatgaaaacgctgttcaaaaaatccacaccgagcatgaggcatacacaaagctcggaattgaaagagaccttatcaaggatcttccaattcccttaggttctaagctggcgcttgtcatgaagaatcaagctcaatttcatccgcttcaatacttaaaagcgcttctggagcaaattgttcaaaaaggcggccgaatttatgaagagaccgttgcgcttgatatcaaaaaaggcgaaaggcccgaagtggtaacaaaaagccggcacgccattaagagccgctttatcatatgctgttcccacttccctttttatgacggaggcggattatatgctgcgagaatgtactccgacagatcttatgtccttgccatcaagccgaagatcgagtatcccgagggcatgtatttgagtatcgatcagccgtcagtggcgctccgctatacggttgtaaacggtgaaaagctgattctcttcagcggagtaagccataaaacaggccagggaaaagccatgtctacacattatgaaacactgagacaactggccgaaagcaccatcggcatcgaaagcattccatattattggtccacccaagatctagtgacgatcgacaaaatcccgtttatcgggccgatgtcggaaaatgaggacaatattctagtagcgaccgggttcaaaaaatggggcatgacgtcctcagcagtcgcagccactttattgtcagaccttgtggagaaaaaagaaaacccatacgaaagcattttcacgccgtcccgtttccatctgaatcccgggttgcagaaagtgatttcctacaatgcagatgtcgccaagcatttgataaaaggaaagcttgaaaagcctgatgtccaatttgaagacatttcgccaggagaagggaaagccgtcaccataaacggcaggcgagcgggagcatttcgtgatgagacaggctgcctccatctcgttgatacgacttgtacccatttaggctgcgaggtcgagtggaacgacagtgagcatacgtgggattgtccgtgccacggatcacgctttaagccatctggcgaagttgtagagggtccggccattaaaccattaaaacaaatagatctcgattaaaccgttcattttaatgaacgttttttcaaatatttttcatctgcagcttcattcatgtttcccttggccgataaaaagaaaaaggcttaaaaagccaaaaagtaaaaattatatttttcccaagggggatcattgtattgttatttaaaaaagacagaaaacaagaaacagcttacttttcagattcaaacggacaacaaaaaaaccgcattcagctcacaaacaaacatgcagatgtcaaaaaacagctcaaaatggtcaggttgggagatgctgagctttatgtgttagagcagcttcagccactcattcaagaaaatatcgtaaatatcgtcgatgcgttttataaaaaccttgaccatgaaagctcattgatggatatcattaatgatcacagctcagttgaccgcttaaaacaaacgttaaaacggcatattcaggaaatgtttgcaggcgttatcgatgatgaatttattgaaaagcgtaaccgaatcgcctccatccatttaagaatcggccttttgccaaaatggtatatgggtgcgtttcaagagctccttttgtcaatgattgacatttatgaagcgtccattacaaatcagcaagaactgctaaaagccattaaagcaacaacaaaaatcttgaacttagaacagcagcttgtccttgaagcgtttcaaagcgagtacaaccagacccgtgatgaacaagaagaaaagaaaaaccttcttcatcagaaaattcaagaaacctctggatcgattgccaatctgttttcagaaacaagcagatcagttcaagagcttgtggacaaatctgaaggcatttctcaagcatccaaagccggcactgtaacatccagcactgttgaagaaaagtcgatcggcggaaaaaaagagctagaagtccagcaaaaacagatgaacaaaattgacacaagccttgtccaaatcgaaaaagaaatggtcaagctggatgaaatcgcgcagcaaattgaaaaaatcttcggcatcgtcacaggcatagctgaacaaacaaaccttctctcgctcaatgcatctattgaatccgcccgcgccggagaacacggcaaaggctttgctgtcgtggcaaatgaagtgcggaagctttctgaggatacgaaaaaaaccgtctctactgtttctgagcttgtgaacaatacgaatacacaaatcaacattgtatccaagcatatcaaagacgtgaatgagctagtcagcgaaagtaaagaaaaaatgacgcaaattaaccgcttattcgatgaaatcgtccacagcatgaaaatcagcaaagagcaatcaggcaaaatcgacgtcgatctgcaagcctttcttggagggcttcaggaagtcagccgcgccgtttcccatgtggccgcttccgttgattcgcttgtcatcctgacagaagaataaccatcaaaaaccggtctgccatacggccggtttttttgcgttcattatgtaaacttaaattaaaaatcagttgacataataattacctgcatttattgtataaccatatttgattactttttggaggatttcacatgctgaaattaatcgacatgatgcatattgcgattttcaccgcgctgatggcagtgctcggctttatgccccctctcttcttatcctttacacccgttccgattacattgcaaacgcttggtgtcatgttggcaggcagcattctcaggccaaagtctgctttcttaagccagcttgtctttttgctgctcgtcgccttcggagcgccgctgttgcccggcggacgaggcggttttggtgtgtttttcggaccgagcgcaggctttttgattgcttatcccctcgcttcatggctgatcagtttagccgctaacaggctgcggaaggtgacagtattgcgtctctttttcactcatatcgtattcggcatcatctttatttatctgcttggtataccggtacaagcttttatcatgcatattgatttgtcacaggccgccttcatgagccttgcatatgtgcctggtgatttgataaaagcggctgtatctgcatttctggcgataaaaatcactcaagccttgtctctttctgatacgatgtttacaaaaggaggatgacaatacatgacaattactcatacctattcatctactgccgaaacatcgcccggccgtgtagcgatccagactgaatcggagcaaatcacgtaccatgattgggatcggcttgtctctcaaaccgcaaattggctgcggtcacagccgagcatgccgaatcgtgtggcgatcctgctcccaaatagtctcgcgtttttacagctgtttgccggagccgcagcggctggatgtacggccattcccatcgacacacgctggagcccggctgaatgtaaggagcggctgtccataagcaatgcggatcttgtggttactttagcctttttcaaaaacaaactgacagatagccagacacctgttgtattgctggataactgtatggcagatatttctgaggcagccgctgatcccttgcctaccattgatccggagcaccctttttatatgggatttacgtcgggctcgacaggaaaaccgaaggcctttacgcgacctcaccgctcatggatggagagctttacctgtacagaaacagatttttcgatttcatcagatgataaggttctgattcccggagcgttaatgtcctctcacttcctatatggggctgtcagcactttgtttctcggaggaaccgtttgtttgctgaaaaagttttctcctgccaaagcgaaggaatggctgtgccgtgaatccatcagtgttctctataccgtaccgacgatgacagacgccctcgcaaggattgagggttttcccgacagtcccgtcaaaatcatttcatccggcgcagactggccggcagaatccaagaagaagcttgccgctgcatggcctcatctcaagctgtacgatttttacggcacatcagagcttagttttgtgacgttttcttcaccggaagacagcaaacggaagccgcattcagcgggccgcccttttcataatgtccggatcgaaatccgcaacgctggaggagaacgctgccagccaggagaaatcggaaaaatatttgtcaaaagcccgatgaggttttccggctatgtgaacggcagcacaccagatgaatggatgacagtagatgatatgggctacgttgatgaagagggctttctatacatatcaggaagagaaaacgggatgatcgtgtacggaggattaaatattttcccagaagaaattgaacgtgtgcttctcgcctgcccagaggttgaaagcgcggctgtcgttggcattcccgacgagtattggggagaaatcgctgtagctgtcattcttggaaacgctaatgccagaacactgaaagcctggtgtaaacagaaattagcctcctataaaattccgaaaaaatgggtgtttgcagacagcttgccggaaacgagcagcggaaaaattgcccgttccagagtgaaaaaatggctggaagagagtgtacagtataaatgaatgcggttattgttgatgcaaaacgaacgatctttggaaatcaaaacggactgctgaagcccttcctgccggaggatttggcggctcccatcatccgctgtctcagccgaaagctagaggatcaagttgacgaggtcattctcggaaacgctactggcagaggcggcaacctggccagactgtcagcccttcaagccggactgcctttatcggttcccggaatgacaattgacagacagtgcggctccggccttgaagctgtgcgctatgcctgcagccttattcaagcgggagccggcacgatgtatatcgcgggcggctcagaaagcagcagccaatcccctttttcagaacgggctcgcttttctccagatgcgatcggcgatccagacatgggcattgcggcagaatatacggctgcacgctattccatcagcagaagcatgcaggatgagtacgcgcttctcagccatcaacgcagcaggaacgcgcatgatgaaggattttaccgtgaagaagttgttgctctcggggaattggagacggacgaagcatttttgaaaacgcggccaatagaagcgattattccccgtgcaaagccggttttcgacaccagctccggaacagtcacagcagccaacagcagtggcatagcagacggagcagccgctcttttggtaatggaagaagaaaaagcagcagccctgggacttaagcctgtgcttcggtttatcggcagcgctgtcagcggcattcaccccaactttccgcccgcggcaccggttgtcgcgattcgtcagctcttacatacacacgatgtaacacctgatgatatcgatttatttgaaatcaatgaagcctttgccgtcaaaatttgtgtctgctcgcaagaactcggcattcccttttcaaaaatcaatgtgcgcggcggcgccttagctcttggccatccgtacggtgcatcaggtgcagctctggtaaccagattgttttatgaagcgaaaagacggccagactgtcaatatgctgttgcagccatcggaagcggcggcggaatcggactggctttattatttgaagttcttgcataggctttttcataggacacacgctttcgatttagtataatagcgatatgaataaagtcaggaaggggattttatgacagccgtttgtttagtaagacatggagaaaccgattggaacctgcagcaaaaatgccaaggcaaaaccgatatcccgctaaacgcaacaggtgaacgccaagcaagagaaaccggagaatatgtaaaggacttttcttgggatattattgtgacgagcccgctgaaaagagcgaaaagaaccgcggaaattattaatgaatatctgcatcttccgatagtcgagatggatgattttaaggaacgcgattacggcgacgcggagggcatgccgctggaggaacggacaaagcgctatccagataacatctatccgaatatggaaaccttagaagaactcactgacaggctgatgggcggtttggcaaaagtgaatcaggcgtatccaaacaagaaggtgctgatcgtggcgcacggtgcggcaattcacgccctgctgacagaaatatccggcggtgacccggagcttcaaagcacccgtctcgtcaacgcctgcctcagcaacattgaatttgcagaagaaaaatggcggataaaagactataatatcaacagccacttatccggctttatcaaataagaaaaagacaggcgtttgcctgtcttttcttttatttcttagcagccggcatctctttttgaagctcgtccaaaatggcattcgccccgtctacactgcggcgcagagaccacaccgcacgatccacgtggtatacatgcccgtttttcactgccttcagttttttccaaaggacattcttttcgatcgggcgtttaccgtcggcgtcgaggtcatctgtttttcctgtcatcaggatgatcacatccggatctgttttcagcagctgctccagtgtcattttcatattcacagagtcgccgccattgcttgaatcgctattgcctgacgtactgattgcatatcggtagccgacctgtgttaaaagtctcgatgtaaagaagttttcatccctggccataatggtatcatttgtatttccgatcaaaagcacggactggctgttcgcgctgattttctgctttgtctcgctaagcttttcttcatgcgccgtcagctttttctccatttccttctccttgccgactgcttttgcaatcgtaagcgaagcgtcaattgtatcctgataatcagcatttaaattattaagtgcaatcgtcggcgctatttttttcagctgatcgtacaccttcttatgccgggtcgtgtcagcaataattaaatcgggttttaatgaagcgattttttccatgcttggctgtgagcgagtgccgacagatgtgtagccgtcaattttcttcagcacatccttgttgatcagctgcttcgctttgttgtcatcggcaaccccgacaggcgtaatgccgagatcaagcagtgtatcaataaaacctagctcaagaacaacaacccgcttcggatgctcaggcacatttgtcttccctaaatcatgtgttaccgccactttatgttctttactgttttgattgccgcttgaagacgagcaagcagccgttaagacagaaagaagtaaaactgtaagaataatcagtgtttttttcatatgttccagtctctcctgttggtagtttctatggttaagatgtccaagagtagtataacacggaatgagaatcattatcaccaattatttttaaaatgagaagagaaagttcggcttacaggaaaatcttgtttcgcgacacagcagttcagcagctgatcatcctgtccacaaaaaagcttgcagaaaaataacattctctgcaagctgatcctgttaaagcttcacaatcactcttccttgaatgcgattttgcaaaatatcttttaacgcacccggcgtttcttccaatgatacttccctgtccacgatggtcagcagctgatcaggcttgagatcagaagacatgcgctcccaaacagcggctctgacgtccatcggacaatatactgaatcgattccgagcaggcttactccgcgaagaataaaaggatacacggttgccggaacttctcctccgccggttaagccgctcactgcgacagatccgccgtattgaattttgcttaaaagcgaggcaagctgttttccgccgactggatcaaccgctccctgccattgctgcttggacagcgccttaagcgttccgtcatagacatcttccctgctgattacttcgcttgcaccaagctgtttcaaataatcagccgcctcccggtttccggtacttgccaccacatcataaccccgcttgttcagcatcgataccgcaattccgccgacaccgccggttgctcctgtgactagcacgctgcctttttccggagacagaccgttctgttcaagccgatgcactgataacgccgcagtaaatcccgccgttccgtacaccatcgcttcttttaacgaaagattctgtggcaaaggcaccagccagtcaccaggcaccgaagcgtattcacttaatccgccatcacgtgagacaccgagctcatagcttgtcgcgatcacctcatccccctccgcaaaacgcggatcattggaagagacgaccgtacccgcagcatcaatgcctaaaataagcggatactctctgacgatattgcctcctgcttttccggccagaccatctttgtaattaatgccggaataagcaactttaatcaggacaccatccttcggcaaatcctctgttgatatggttttcacatggactgaaacatcatcggcatttttttctgcctgcaaggcttgaaataacgttgacattcggcacactccttttcatttatatcgtaaccgaagaacgttcaaaaaaccaaatcatcaagccgccattttcacttcgccggcacattgagacaataatggacaaatccggtatcctcttcatagccgttttgctcatacaagcttcttgccttccggttgtggtgctcagtctgaagtgttaaacattttgccccgttttgccctgcataatcctttgcggcagaaagcagccggccgccggctccctttgtacgcgcatgaggaacgacaaataagtcatttaatatgtatatccttttcattgacacagaagaaaacgttggatagagctgggtaaagcctatgaattctccattttcttctgctatcaaaataacagactcgtgattttccaaacgagctttcaaaaaagcctctgccccttgcaaatcggatgcctgtctataaaattcccgatattggttaaacagcggcgcaatggcggccgcatctgatgtctttgcttggcgaatgttcatcttatttcttcctccctctcaataattttttcattctatcccttttctgtaaagtttatttttcagaatacttttatcatcatgctttgaaaaaatatcacgataatatccattgttctcacggaagcacacgcaggtcatttgaacgaattttttcgacaggaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaatttttttaaaaggagagggtaaagagtgagaagcaaaaaattgtggatcagcttgttgtttgcgttaacgttaatctttacgatggcgttcagcaacatgtctgcgcaggctgccggaaaaagcagtacagaaaagaaatacattgtcggatttaaacagacaatgagtgccatgagttccgccaagaaaaaggatgttatttctgaaaaaggcggaaaggttcaaaagcaatttaagtatgttaacgcggccgcagcaacattggatgaaaaagctgtaaaagaattgaaaaaagatccgagcgttgcatatgtggaagaagatcatattgcacatgaatatgcgcaatctgttccttatggcatttctcaaattaaagcgccggctcttcactctcaaggctacacaggctctaacgtaaaagtagctgttatcgacagcggaattgactcttctcatcctgacttaaacgtcagaggcggagcaagcttcgtaccttctgaaacaaacccataccaggacggcagttctcacggtacgcatgtagccggtacgattgccgctcttaataactcaatcggtgttctgggcgtagcgccaagcgcatcattatatgcagtaaaagtgcttgattcaacaggaagcggccaatatagctggattattaacggcattgagtgggccatttccaacaatatggatgttatcaacatgagccttggcggacctactggttctacagcgctgaaaacagtcgttgacaaagccgtttccagcggtatcgtcgttgctgccgcagccggaaacgaaggttcatccggaagcacaagcacagtcggctaccctgcaaaatatccttctactattgcagtaggtgcggtaaacagcagcaaccaaagagcttcattctccagcgcaggttctgagcttgatgtgatggctcctggcgtgtccatccaaagcacacttcctggaggcacttacggcgcttataacggaacgtccatggcgactcctcacgttgccggagcagcagcgttaattctttctaagcacccgacttggacaaacgcgcaagtccgtgatcgtttagaaagcactgcaacatatcttggaaactctttctactatggaaaagggttaatcaacgtacaagcagctgcacaataatagtaaaaagaagcaggttcctccatacctgcttctttttatttgtcagcatcctgatgttccggcgcattctcttctttctccgcatgttgaatccgttccatgatcgacggatggctgcctctgaaaatcttcacaagcaccggaggatcaacctggctcagccccgtcacggccaaatcctgaaacgttttaacagcggcttctctgttctctgtcaactcgatcccatactggtcagccttattctcctgataacgcgagacagcattagaaaaaggcgtaaccgcaaagctcaaaacagaaaacaaaagcaataacagcggaagtgccgcaagatcatgccgcccttctaaatgaaacatgctgcgggttaggcgaaccgtccgcttgtaaagcttatcaatgacataaaatccggcgagcgacacgagcaaatagccagccagaccgatgtaaacgtgcttcatgacataatggcccatttcgtggcccataataaacagaatttctgaatcgtcaagtttgttcagcgtcgtatcccacaatacaatccgtttattggccccaattcctgtaacataggcattcagcgcatttgttttttctgacatgttcacttcatatacatggtcagccggaatattggcttcatctgccagctctaaaattttgctttcaagctctttgtttttcagcggataaaaatcattgtataaaggatcgataatgaccggctgaataaaaaacagaaacagcgaaaacggcactgttaacagccaggcgtataaccaccattttttttcatgccttttgatcagccaataaaaaacgagaacgcaaagcgtaaagattggaaagctgatccaaaagctgataacctgatccttagcccagctggccgttgtctgtgtggaaatgttatagtcaagcgatacttgatagcctatccaatctaaaggcagcgtcaccaatgttgtaatcagcgaaagcacaaacacaaaaccaacggtctgcaaaaaccgaaaaggcacggccgcttcgatccatttcttgattttctttgaaacaccgctgacaagcagaacaaaaaacagaaaccaatcaagtggtaccccgataaaaaataaaaaattcttgacattcgaatactgctcggccactgccaactcagacggcttcatgaaagaagccggatcagcctgcgtccctttcacggcttccggtattgcggaatcacccgacaggaaaaaataccaataaaaaaacagcccgtacagcacgtaagcaagtcctgctgccgcaatccacttgcgcataacgcctcactcctcacatcaacccgttacttctattgtaatcataaattcaaattcttagaaccaagctgtgttccgcacttttccacccttttaagcatggaaaccccgatcgctgggaaaactaacaatgtttggagtgatgcaaatgaaaaaaatagtggcagccatcgtggtaatcggtcttgtgtttatcgcatttttttatctttacagccgatcaggcgatgtgtatcaatcggtagacgcggatttgatcacactgtcttcaagcggccaggaagatatcgagattgaaaaaagacagcacgtcaaagatatgctggatattatgaatcagggaaaacaggtgaagacagaaaaaacatcagcccctgattacgaagggacaatcaagtttcataaagaccggtatgactcattcagactatggattgacggcagccagcaagccgtttttttgaaggatggcacatactacaaattaagcaaaaatgatacaaaggcgctgctaaatattattaaaaaagaagcaaaggattgaaaatgaaaaagcgaagctaaccgcttcgctttttcattttattggggcaaaatatctctcagtgcccgtctgagcattttccccgtcgcatttttcggaatatcgtcaagaaacgtaatggcggcaggccgcttgtattttgccagatgcttttcgcagtgctgcatgatgtcctcctctgttaccccagagcgtttcggcaccacatatccctttaccgcttccccgctttgggggtccggcacgccgatgacaaccgcctccttgacgtccggatggctgtacagcacctcctccacctcccgcggatacacattgtatcctcctacaatgatcatgtcttttttccggtcaacaatgtaaaaatagccgtcctcatcccgtcttgccaagtcccccgtataaagccacccgtcttttaatgcatgctctgtttccatcggcattttataatagcccttcatcacattggggcctttcacgatcaattcgccgacctggtgagcgggcagctcgcgtccgagcggatctacgaccttgttttcgacatgtaagatacttgtcccgatggagcccggctttctgcccctgtcaaacgggttaaagcacgtgacgggtgatgcttccgagagcccgtagccttccaaaatggtaacaccgaatttttcttcaaacgccgtcagcaacgcgactggcatggacgcgcctcccgaaatgcacagccggatcgaagaaaaatcatctttctttccgttttcatgctgaaacaagtagttatacattgtaggcacaccggcaaaaatggtcgcctgctgctgcttaacaagcttaaaaacagatgccggactgaattgaggctcaatcaatacagttgcgccgctcatcagcggtgcattcatacagacggttaaacaaaacacgtgaaacatgggaagagcgcagaccacattgtccctctcatccattcccaaatagcctgcgacatcgttggcattgctgtacaaattctgatgtgtcagcatcgcgcctttcggttttccagtcgttcctgacgtatataaaataaccgcggtatcatcaggtacaggttcttggttttgtttagcggcagatgtcggccgcaatatttttgcaaacgttgtcattttcatcctgacctctgggtccgcagcttccggctcggcctcccccgtctggcataaaatgacgagctcaacctttggcagcgattcatgcatgctctcataaagcggcaaaagctggctaacgcccacgattgcctttacatcgccatttgtcagcatataaccaatttctgtcggcgtgtacaacggattgatgggaacaactacgatcccagcttttaaagcgccaaaaaacgcgatgataaaatcaggcgaattgccaagcagcaaagctaaatggtcccctttctccataccggcttcctgaaggccgtccgcaaatcgctgaatatattcattcagctcttgatacgtcatcatgtgatctttaaacctgcatgcgatgctgtcgggcttctcagatgctgtttcttccaattttgaaacaagattcattctcccaccccttaagtgaatgaatagtcattcattattgaagccaagctttcttctccattatagagaaacagaaaaaaacactcaagagcaaaaagccctgagtgtcagtactgtcatagtttcttcaatgcttcggcaatcggcgtatctccttctgtcagatcaaaggcccgattttccgtattcttctcatctaaagaggcaatgaccgtttttgcaacgtcatcacgggaaataaatccccgctccagatccttcgctgctgaaacagttcccgttccaggctcattgcgaaggcctcccggacggataatcgtataggttaaaccgctcgcttccagaattttatcagcataatgcttggccacataataaggcttgagtgcctcattccaattttcacggttatgggcttgcagggcgctgaccataataaaccgtttgattccggcaatggccgcagcttcaatggcttttgccgctccatcaagatccaccagcagcgttttatcatagcctgtgctgccgccggaaccggctgtgaaaatgatcgcgtcacaaccttttgccgcagcggcgatttcttccgggctgccctccagattcgcaagcacagcttctgcaccggcagcttcaagagacgctttctgttcttcttttctgaccatcgctctgatggaatgatcaggattatcttggaataaagagacgagtctttgcccgatttgtccgttcgctccgattaaaaacactttcatgtgaatccctcctgcctccattatttcaaaaacacaaccgctctttcaaacgatgtgttttgccttagtaaatcagatcaaggaaatcctctttcgtaatgttcccaaagtaatgcttgagattcacaccttcgagcacatcagcgatgacgctgcgttcgtattgttttccgaccagcaggttttcaatttcagatacatcaccgacaccgaagaaatctccgaagattttgcagtcctcgattttgcctttcttgacttccaggtgcaaatcgatcgatccaaccggataacgcttcgaatgattaaggttaaattttggtgagcggccgtagttccaatcccaattctgatagcgctctttcgaaatttgatgaatggtctcccaatctttttccgtcagcttatactccggcacgtttccaacgtcgtttgtgttaaaaatatggcgaagcaaatggctgcggaattcttcggtggtcattttatcatcgagaaactcactgatgtttgccactcggcttctgatcgatttgatgccttttgattcaattttatcctttttcacctttaatgctgatacaacatgatcaatggctgaatcaaacatgagggtgccgtggctgaaaatacggcctttcgttgcaaactgagcgtttccggatattttccggccatctactacaatgtcgttccggccgcttaattcggcttcaaccccaagctgatgtaacgcctgaatcactggctcagtgaattttttaaagttatgaaagctgtccccgtcatccttggtaataaagctgaagttcaagttccccagatcatggtacacagcgcccccgcctgataaacggcggacgacgataatcccgttttcctcaacatattttgtattgatttcttctattgtattttggtttttcccaatgataatagacggttgattcacataaaagagcaaatattgctgttcagggtctaaatgctttacacagtactcctcgatagcaagattgatccgcggatcattgatattttgattgtctataaataacatggtgctcctcctttatccttcccacacaaaacctgatttcgcaatattcacttctccgttaaaaacggttttcgcttctttgcgaaggttgtcatgcacgccaaaatgcggcaaatgtgtcagcagcagttctcccgctccggcttcttttgcaatgcgcccagcttccaggctgttcatatggcctgcacttgttccgtcttgatcggcataaaaattgcattctgagatcaataaatcagcatctttcgaaaacggtataaatgaatcctgatagctggaatcagcagtataaacgacagtgtggctgccgtcagtaatccgcatggcatagcacgtcaccgggtgaatcgtttttaaaaaggtgatcgtaaacggaccggcagtcagcggctgatccggctgataggcgatcccttttgtatgtgttttatatgtaagcttttgaaactgttctatatcagcatcatgtccgtaaatcggaagcgtatgctctcctttgccgagaaacgaaccgacttgcttggcaaattgcagcggtccgatatcagcgatatggtcatggtgataatgagacagaacgaccgcatccagcttttccgccggcacatatccgaacagcttagacaatacggcactgccgcaatcaacaagcagagagtaatcacctgactgaaacaaatagcctgacgtcgcttcatttgcggccggaaaaccgccatagcatccgataactgtaactttcataatgtcctcctatcttttcaaaaaaattggtcctccttcaatatacccatttttcttgaaaaaagcatgttttaaacattgtatcaaaacagttattgatttttgtaatctgttatattacaatgaaatcactacaaaggggaaagagggattggttatgctggggaaaatcacagaattttttagaaacctgccttcgaaaaagtgtgcggaatgcggaaaaaagatagaagagcagcatgagtgttatggtaatatctgcaatgactgtataaaagtaaacgatttgtaatgagcgaaaatcccgcgccttacgcgtgggattttcttattttttcacatatctcttaattttgaaataatagtcaggttaggtcaaagctcacctgtttttagataattctggtgattatcataatgtcattgaatattctttattttcgaaatataatttactatagacgaattgatttcttatctattataatttgatctaatagtgagattaaatatatgtctattcatgatatatgttgatactttgttttttgggaggtaatctatgaaaagaattaagtttggattagccacacaaatattcgttggacttattctaggtgtcattgttggcgtcatttggtatggcaacccagcattgcctacttacctgcagccaatcggggatctctttttacgcttaatcaaaatgatagtgattcctattgttgtctccagcttaatcatcggtgtagccggtgcaggaaatggaaagcaagtcggtaaattaggcttcagaacgattctgtacttcgagatcatcacgacttttgccattattctcggactagcccttgcaaacatcttccatccgggtacaggagttaatatacacgaagctcaaaaatcggacatcagtcaatatgttgaaactgaaaaagaacaaagtaataaatcagtggcggaaacgttcctccatattgtgccgacaaacttcttccagtcattggtcgaaggggatcttctagccatcatctgctttacagtactatttgcattgggtatttccgcgatcggtgaaagaggcaagcctgtattagccttttttgaaggtgtatcccatgccatgttccacgttgtaaaccttgtgatgaaagtggcgccattcggcgttttcgctcttatcggagtgactgtgtctaaattcggactcggttctcttatctctctcggaaagctcgtcggattggtttatgtcgcgcttgctttcttcttaattgttattttcgggattgtcgcaaaaattgccggcatcagcatcttcaagttccttgcttacatgaaggacgaaatcttactggcgttcagtacgtccagctctgaaacggttcttccgcgtatcatggaaaaaatggagaaaatcggatgtccaaaaggcattgtttcatttgtcattccgatcggttacacgtttaacttagacggttccgttctctatcaatctattgccgcactctttttagcacaggtatatggcattgatttgacgatttggcaccaaattacgcttgtgctcgtcttaatggtgacatccaaagggatggctgccgtacctggtacttcttttgttgtcttgcttgcaacgcttggcaccatcggcgttccggctgaaggacttgcctttattgccggcgtagaccgcatcatggatatggcacgtacagttgtcaacctgactggtaacgcgcttgctgccgttgtgatgtctaaatgggaaggcatgtttaatcctgcgaaagcagaaactgttatgtcccaatcgaaaacagaacaaaacgcaaccatttctggttaatgaaaagcctgcggggttcttgccccgcaggcttttttaatctttaacaagcacaaacaactctgtaatcaaaacagtatcctcattcagctccagttcaccgcttttgatcagttccgcccatgccatccgatgatcctcttgaaactcctcaattcggtctccattgccctctcctttgactaacctcatatcaggcgcaccaaaggtggtttcaaagacatctgttacttttatattgcatcttggattgtcatgtttatcataaacggtaacaagctgacccgctgtttgataaacgtccctcaattcatcttttgaatacaatgatttcggcgcgcacgtggcgcttttttctccggcaaggatctgctgaatcagctgttctcccaacccgtcatcaccttcccaaccgaatgtgcttttcagcttataaatcttcattggtcctcccccttataccattggtgactgtacatagtaatacagaagcttagcggtatggcgaagagatgatttatgggtgcgttcaaatgcatgggaagcgtcaattcccggccctatgaggccatgcacaatatcatgcccggatttgatcgctgctgacgcatcagacccgtagtacggatatatatcaagcttatagtcaatatgatgcttctcggctaattgaactaaatgctttctgagctgataatgatacggcccgctcgcatccttcacacagattgatactgaatattcatccgtcgcctgcccgtcaccgatagcgcccatatcaaccgccaaatattcaactgtttcaggaggaatattcgaattcccgccgtaaccgatttcttcattattggaaataagaaaatgggttgtatacggcagctcaatgtcttctgtttgaatttcatgaattaagcggagcaataaggcgacgcttgctttgtcatccaaatggcgcgatttaataaatccgcttgatgtgatctcgacacgtggatcaaacgacacaaagtctccgacgccaatgccaagctcctccgtatctttccggcagtgaacaggttcatctaggcggatctccatattctcttgattccgctcagcctttcccgcgtctttgtatacgtgcacagacgtttgatgcattaagattgtgcctgtgtacatttttcccgaggcggtttcaatttggcaatactccccctcaatcgagttgtagcggaacccgccgattaagtcgattttcagccggccgtccgctttaatttccttcaccatagcgccgagggtgtcaacgtgcgctgtcagcatgcgatgccgggatgtgtcgcgtcctggaagcgttgcaattaagccgcccttgtggttccgaaccgtttctaccttccattcttttaaaaggctttcaatataattgatcacctcatatgtatttcctgtcgggcttgggatcgatacaagttctttaatgagctccatcgttttacgtacggacgtcatagggcattcctccttttattttctacttaaaatatactcttttcccgagggacccgtccaatcttttcctatcaatctctcatatgctgtagagagcatgggaagaggagggatttctatgtgctgtcgtcattcacatgaacagaaatgtcgttgtcacgattggttcgatgatttttggttctttgacgagtggttcgataaagatttccacgaccattgcaagaaaaagaaagaatgccatgacccttgcgagaagaagaaaaagaaacaccattgtttctcttgtaaaaaacacagacattcttgctgtcattgctaaagactgaatcagaaatattctgatgacccatgcttaatgaatatttccattcacatttttccaagcgggcattgctgctgcttggaccttttattgaaacaccctttttgcttttacaatccaataaactgataaagccgctataagagcaacaatgatttcaacagctgcagcatgctctatgattcctctttgatataaaaccgccgggacattaaacagtgcatgtaaaagaatagaatacagcaaaaacagcggccggcggtttttaaccgcgtacaaaacaagcagagacagaccaatctggacggcaatggcactgattctttctattccgcccagcatccattcatacgaaggagtatgcagcagctgctcctgtatcggcaaaagcgcctgtttgacgtcgccattgaccaaaagctgttcaaacgtcccgctattgattgcaaatgcgtatacaataagtgagatagaggacaagcctgtaatcaggatggcttcaagcccgccatggcctgccccgaaagccagaccatctgcccaagtatgatggcgcttcataaaaaatcgcatcatcaaataccttccgcactcctcaaaaatgccggccatcaagcagccgtaaatgccataccataatggatgctgcatcgcttctttcgtcatttcattcacttgcagtacataaacatgaacgccgccttccagcagctgagcgaagacaaaaaacgtgagagcgccaataaaaaacactttaagcgaggcaccatactttcgcttaaaccatacaatcagcccgattggcaacagaaacgcaatagccccggataatgccaaaaagactactgcttcttgactgaccatttttcagcctcctttttctttttcatagattcctatctacacttctctttttttgtaaaaaaaccttctttttagtaccagatactaatatctagtgttataatctgaccataaggagtgattcatatgtcaaaagcaaaaattacagctatcggcacctatgcgccgagcagacgtttaaccaatgcagatttagaaaagatcgttgatacctctgatgaatggatcgttcagcgcacaggaatgagagaacgccggattgcggatgaacatcaatttacctctgatttatgcatagaagcggtgaagaatctcaagagccgttataaaggaacgcttgatgatgtcgatatgatcctcgttgccacaaccacatccgattacgcctttccgagtacggcatgccgcgtacaggaatatttcggctgggaaagcaccggcgcgctggatattaatgcgacatgcgccgggctgacatacggcctccatttggcaaatggattgatcacatctggccttcatcaaaaaattctcgtcatcgccggagagacgttatcaaaggtaaccgattataccgatcgaacgacatgcgtactgttcggcgatgccgcgggtgcgctgttagtagaacgagatgaagagacgccgggatttcttgcgtctgtacaaggaacaagcgggaacggcggcgatattttgtatcgtgccggactgcgaaatgaaataaacggtgtgcagcttgtcggttccggaaaaatggtgcaaaacggacgcgaggtatataaatgggccgcaagaaccgtccctggcgaatttgaacggcttttacataaagcaggactcagctccgatgatctcgattggtttgttcctcacagcgccaacttgcgcatgatcgagtcaatttgtgaaaaaacaccgttcccgattgaaaaaacgctcactagtgttgagcactacggaaacacgtcttcggtttcaattgttttggcgctcgatctcgcagtgaaagccgggaagctgaaaaaagatcaaatcgttttgcttttcgggtttggcggcggattaacctatacaggattgcttattaaatgggggatgtaacaaaaaaagaacttgtttccaaggaaacaagttctttttctttatgaagccggctgttcttctgatgtttcttccttccggcttaacattgtaaagtaagtaatgcttagtgcaatcatgacgagggcaatgccgattaagacgccggccatctgccacatgtagccaaagtcaccgtttgaaatgactgctctgaatccgttaatgctgtaggtcatcggcaatgcgccgtggatgacctgatagaaattcggaagcaattccagcgggaaggttcctccgctcgctcccagctgcagcactaaaataatgactgcgataaatcgccccgggttgcccatcgttgtagccaaaaattgaattatcgccaggaaagcgagactcgtaatgatcgtaaacacgtaaaatctccacgtgctctctacctcaagaccaattcccaatagaagaaccgtcgccacaatcaatgattgaatgattcctacaagcatcatgacattgaatttgctgaagaaccactcaaaaccgtttctcggacgtcctgacgcttccttcagcgggaagacaaccgtcagcatgatgccgccgacatacaagcccattgacaggatataaggtgtcagccctgttccatagttaggaacggaatgaatggcatcatctttggttttaaccggatccgcaaacatgccgtatgtttgatcatcagcatcgatatctcctgtttggtcagccgcatccttcagcttactagacagctctcctgtgccgtccaatagcttgcctaaacctgtatcaagtgatgcagatccgtctgcaagttttgatgatccgctttggacctgtttagacccgtctaacagcttaaacaatccgccggatacttggctgcttcctgtcaccaattgctctgagcccgcttttgcttttgcgaactgcttattatattcaccgatgcccgctgtcagtttagtttggccatctgtcagcttctgagaaccgttgtatatcttatcagctccctcagttaatctgtcaatcgcatcttggattgtttttgcgccgttataaagcttagatgtagcttccggcatggctttcacctgcgccacctgcgctttcacgtcttcaagagagctttttatcgttgcgatgtcaggcagctgatcagctgtaggtagctggcttaatatttgatcaaaatcaggcgcatcaacttgcggaagctttttctcaacagaattaatcagctggcttttttgctccgctgttaagaagtcactcgaattgatgacatttttaaatgcctgatcacggtttttcaaactgttttcaaagtcagtcagctgttttttgaattccttcatcgcagtttctgacttttccagattgtttacagcagtttcaagcttcgttaaatcgagcgcattaatgatcttttccgcttttgccgctttctcagaaccttcttggactttactgttgagctgatccaacccgttagtaagattaggcgtacccttctgcacattttgaagtccggcaagaagttcattcatcttgcttgtcagctcgcctgatcctgctgcaagctgactagatttatcataaatctggttgctgctgtcctggaatttaccgagcgagctgtcaagtgattggatgccgctcgtcacctgagccgctccatctgcaagctgcgctgttttgtcactgatggtagcggtgctttccttcagcttcgccagattttctttcagctgggcgcttccgtttttcgcatcctttgtgccgtcatcaatttttttcgcgccgctgctcgcgtcgctcaaaccttttgcgatatctttaaagttatcaaaaataactttcgtatattgctcggtcacttcttttgaaacagaggctttcagtttatcaatcgctttttcgccgatcgttgcccctacatagttagaacctgcatttgtatggtatttcagatccaattttttcggatttttgtctaatacagtgctggcattcttagaaaaatcctcaggaatctcgacaactaaataatatttttgattcaataagtcctttaacgattggtcgagatcattggaaaaatgccaatcaaagttgttattatcctttaattctttgaccagatcatcaccgatttgaagtttttctccttcatacgttgctcccttgtcttggttgacgacaacgacaggcagctggtcaactgtgccgtacgggtcccaataagcctttaagaatacgccgctgtaaataagcgggacaaacaaaatggcgatgatgggaatcaataattttttacttgttacgatgtctttccactgacttcgtattgtgttcatcctgatgcctccattctaaaactgactcatcataaaaaatggtcattttcttgcaaagagaaaggattatctagttcgctgacaatcctttgacaacatacaattcaagcagtcccgcaattgtctctttatcaagcggggggtgttgtttttcccagtcaaaaatgagcgcgatataaagcttcagcatcacaaaggctgtcagctcagggtcgcacggcttgattgcgccgcttttgatcccgtcttcaatcttgcttttgatataagacaggatggatcgctccattttctggatcacttcctgaactgccattgtaccaatctcggcattctcttggaaaattttaatcgtcagctgatgtgttttcctgaactccagaatggcaaacagcgctctgtgcacattttcatggaacggaaggctcggctccatcgcttcatccgctttttgcttcatttcctttaataaagtagtgaaaatctcgtcaaacagctcttctttgtttttgaaaaaagtataaatggttcccttccccacgttcgcaagttttgcgacaagatccattgtcgtcgctttatacccgaactgcgtgaaagactttgtagccgcctccaaaatgagcttttttcgatctattgacattgtattcacctcgaaactgaccgtttgaacattttagtcattaagtacatatgcaaatgtatcataacctgctgttcaattcaatcattttttacacaatattgccattgcacatcaaaaaaacctccgcgataaagcggaggttttagctgaataaataggtaagcgcgtcagacacggcagcttttccttgatcaatgcagtcgggaatgccgacaccttcgaaagaagcgcctgtcatataaacacccggatacgcagatgcaagtgcttcacgcagctccttgatacgctgcttatggccgacatggtactgcggcatgctttcatgccatcgggttacacatgtcatttccggctcgccgtttatgttcatgactttctttaagtcttctaacacaatgttgataatgtcattatctgatagatcgacaatggattcgtctccggcttttccgacatatgcccgaagcagcgttttgccttccggcgctgcgtgcggccattttttattcgtccacgtacaggctgtgatcgcaaagtcactgtttcttgaaatgacaaaacccgtgccctcatgctccatttggacggagccttcagggaaacctaaagcgacgtttgccacggatgtggagtgcatatttttcaaatgagaaatggcaggaagctcagaaagcattcccgcagccgctttatgcggagcagtcacaattactgaatcagcatcaagtgtgacgccgttatccagttcgagcgaatagcaagagccgctatggctaagtttggtcacttttgtgcctttatacaccttcgtcagctttaactgcttttcgatctcttctacaagggtctgcaaaccggttgacagagtttggaactgcccttgtttttttgccgtcagctgctggcctgagccttgaggccttgtttttttcatgccgagaatcaggcttctatgcttttgttccgtctgataaaattgcggaaatgtcgacatcaggctgagcttgtcaatgtcgcctgcgtagatccctgatagtagcggctcgattaagttctcgaccacttcatctccgacacgtctgcggaagaattctcccaatgactgatcatcctttgttttgcttgcaggcaggatgaaatccatagcagctctcgccttcccggacaaggaaaacagacccgtagaaacaaacggcgcaatttttgtcggtatccccattacagcgcccttcggcattggatgcagggtgcggtttacaagcacataggattgcccggtcgcattgttgacaagcaaatgctcaagacctaagtctttaacaagctgcggggcgcttttctttcgttccagaaatgagtctggccctctttcgatgatatagccgtctttcttgacagtctggattttcccgccgactctcggacttgcctcaacaagtgtcagctcaagcggcagattcttttctttgatttctttttccatatagaaggcggcggctaaaccggtaatgccgccgccgatgatgactacatgttttttgccgtcactcatgttcatcgccttctttaacgtcctaatttttttaatacgactgttgccaaagcatcaataaattcaggcttggcatttggcatttccggccggtaatagcttgcgccgatatcgtcagtaaccactttgcattcataatcattatcataaagcacttctaagtgatccgcgacaaacccaacaggaacatatacaaatgcttgatagcctttttgttcgaataaatcacgtgttaaatcctgaacatcgggtccgagccaaggatcaggcgtgttcccttcactttgccagccgacagcatattcggaaacgcctgcgccttcagcaattaatttcgccgattcatgaagctggtccgggtacgggtctccaaattctttgattttttccggcaggctgtgtgcggatacgatgagcattgcgttttctctttcatcctcaggcattgacgcatatgtttccttcactcggtcaacccaatatgtcacgaacttcggttcatcgtaccagctttcaactgacgtaatcgttaagccgccgagtttttcagcctcttctttggcgcgtttgttgtaggactgaacgctgaacgtggagaaatgcggcgccagcacgatgctgactgcttctgtaatgccatccttatgcatctctgctacggcgtcttcaataaacggctcgatatgcttcagtccgatatacgctttaaacgtaatctcatcctgaatttcattcaagtgctgttccagattatgcgcctgctgttctgtgatttgggcaagcggtgaaatgccgccaatcgcttcgtatctgtctttcaaatcttgaagcatttcaggttcaggctttctgcctcttctgatatgtgtataataacgttcaatatcttcttccttataaggcgtgccgtacgccatcacgagaagccccattttctttctactcactgtttacaccctctttaatgatctgatacaaacattttgacaggatatcattaagataccaaaagatatgcttaggaatattgacccatttttttgttttgtgaatattcatggacaaatgctgtcagttttttcaaaacctcgggactgacatcaggaaataccccatggccaagattgaaaatgaagccgtctgactccataccctgatcaagtatttccttcgttttctgctcaatgacttcccatggcgcaagcaaaatggacgggtccaggttgccctgcactgttttagtaattccttttgatctggcttcatcaatgccgagtctccagtcaagcccgacaacatcgagaggaaggtcatgccaatcacctgcaagatggcttgcgccaacgccaaacatgatcagcggcacattctcctttgcgagctctgaaaagatccggttcatcacgggtttgatgtatgttctgtaatctgcctgattcaatgcgccgacccacgaatcaaagatttgaatcgcttttgcgcctgcctcaatctgcgctttcacgtacacgatgatcatgtcggcaagcttggacatcagcagattccatgcatctggcatgctgtacatgaaggcttttgttttattgtagtttttcgacgggccgccttcgatcatatagcttgcaagcgtaaaaggcgcacctgagaaaccgatgagcgggacgttcagctgctcattgacaagcagtttaatcgtctcaagcacgtacggcacgtcctgttccggatcaatctggccgagtttttcaatgtccgccagagaccggattggctgatcaatcacaggaccgatcccgtttttgatttcaacatccacaccgattgacggcagcggcgtcatgatatctttataaaggattgcagcatcgactccgtattgctcaaccggcagtcttgtgacatacgcacaaagttcgggctgatgtgtgatctcaaacaatccgtacttttccttcagcttgcggtattccggctgtgagcgccctgcttgcctcatataccacacaggcgtgtgatccgctttttctccccgcgcagcttttaaaaacgtctcgttaaacgtttctcgtttactcatctgatttccacctttcatacggcaaccatacgttcgtatttcttgacttattacactataccttgttttaggcaaatggtatagaaatgtagctcaaagttcaaaaaatcgccgaattccattaagaggaaaacaattttggctgaacgtaatcggttccttccccttctctttttgtctgtgtattataaggcacaattttataagacgcgcccgaaaataagttggcataaggaatttcatagcttcccttcccttcaaccgaatcaagaagcgtctcctcgccgtccttgtttacataaattctgtatacggcccgatcatcctcttgagcgtcccactttaattcaatagtaaagagccccgctgctttaaatgtgtaatcggctgtgagtgttttgaccggcttcagctcaatcgggctttccagttctttaacgtttttaggctttgtgaacacatgaccggtttctcctgcctgtgtcaaaatatccttaaacagccgcgtcgggtatgagctcccggctttcaaataatggttttgatccgttttgtcatagcccatccagactgccccggttattttcggcgtatagcctgcaaaccaggcgtcctttgtcgcgccggagacgcctgtataagatgttgaacctgtttttcccgccaggtcgccgtgataggtgccggacgtggccgttccctttttgactacctgctgcagcattctcgtcatattccaagacgtctgcttgctgaatacccgctttccttcttctttatgatcggctattgtttctccgtcttcatctattatgctcgagataaagaagggttcagtatacgttccattcgcggcaaatgtatgaaacgcgccggcaagctggagcggtgaaacgcctttttccaagccgcctagagcaagagcaaggccttcatcagggatatcaatgccgtttgctttcaaataagatttccctgtttcgacgccgatctcattcagcgtccagacagccggcgcgtttttgctgtacgtaatggcgtcagacatagtgacttcgccctcataccggctgtcgtagtttttcggcgtataatctccgtaggactgcaactcatccttcaatagagaatatggcttaaatttcttttcctgcatcgccggtccgtatacagcaagcggcttaaatgtggaacccggctggcggacagctgtgacacggttatatcctttggatgtgtaatcccttccgccgatggccgcttctacaccgcctgtcttgttattaataaagaccgcgcttccctcggcattctgatctgttccgggataatagcttccctctttcatcacctggtaagccgtcttctgcagcttcgaatcgagcggcaccttgatcgtgtatccgccttgaagaagctgctctccggaaatggaatacttgtcttccgcctctttgatcacaaggtcaatgtagctgtcaaaccaaggtgtttccgactgtttcttcacatgcagtccaagcgtccggccctgtgcggtgacagcctctttcgcactgatatagccttggtcattcatcatacctagaattgtatcacgccgctccttatttttatcagggtgcaaaattggagagtacgtagaaggcgccttcggaatagcggccaaaacagcgccttcagatacagtcaaatcttttacttctttattaaaataatagtgggacgccgcttgtatgccgtaaaccccgtgtccgaagtaaagctggtttaaatacatttcaagcagcttgtccttgctgtaatcccgttcaagattaatcgcaatgatcacttcttttgtttttcttagaaatgttttgtcatgtgtcagaaaaatatttttggcaagctgctgggtgatcgtgcttccgccttccacctttccgcctgctaatatatcgcggtacactgcccttccaacggattttgcatcaatgccgtgatgctcatagaaccttttatcctcaacagcgataaacgcttctctgacctgcttaggaatctcattgatcgagaccggctcgcgattttctgtatacaggcttgcaacctcatctccgttttgatcaacaatttttgaagaagcatgaagaataagctttttttcatctatgacataatggccgagaaaaataattgaaatatatcctattaaagcgagaaaagcagttaacactaaaataatgataggtataaaaagtttctttttctttatcttaaacatgaactcacctcgcctttctaaaggtagtatgggaaaaattgtttggaattatgttcgaagcactcgccaatagaaacttataccattgttttgatatactagcaagcaggaggtggctgatatgaaggtttatattacatatgggacagccgattttttaaaaacgatcgtacagaagcatccctcagaaaatatccttttgatgcaggggcaggaaaacgccattttaattcatgaaacaaacggagataccgttttccaggcaccacacgcttatgaagtcattgaccaagtcggagagatcaaacatcccggttttgcagtattgaacaatattgccgttactcaggaagggcgtccgctgtttgaaaacagatttaaaaacagagcgggaaaagtcgaaaacgagcctggctttgaagcaattcgagtgctccgtccgcttgacagtgacacctatgtcattctgaccttgtgggaaacggaaagcgcctttcaagactggcagcagtccggttcttacaaagaagcccacaaaaaacgcgatacatctgccggaattgacacaacgtcgatcttctcccggccttcctatgtcaccacatatttcgctgtcgaatagctgccggcatgtccggcagcttattttattgggaggaaagcaaaatgaagcatacttgcccagtctgcgggtttaagggattggctgaaccgccatatgatcatgaaggcaatcattctcatgaaatctgcccgtgctgcggttttcagttcggatttgatgagtacgagatgcagcacgaggataactcatatagagccatcggaaagcatcatcgcctatagaaaaaactggcttgctgaagggtgcgtcattttttctcctgaatgcttcccaaaacatctgcaaaaagcgaatagaggattaaggcatcatctgattgagcagctgaaacagatcaatgttcatcttccatcataaccctcccctctgtcccggcaccttccgcccgcctatgaataatctgtaagcagaaggagtgatcgatgatggaagtcgggattttgcctgtccatgttctgtatgtgttttttatcggtgcaattatcctatttatgctgctgagaaaagacacgacatttatttctctattcggcatttttatcatatcgctatgggccagccattcactttcagcttctgtcagcagtttattccacagctttatctatgcggccggcgaactgctgcccacgattttcatcatttgctttatcgtttcaatgagtgatttgttaacaaaaacagggataaatgaagcgatgatttctccctttgcaagccttgtgagagggcctgtgactgcctattggctgattggaggcctgatgttcgccatttctctattcttctggccttctccgggtgtcgctttgatcggcgccgtcctgctccccgcagccgcacgtgccggtttgacgcctcttgccgcggccatggccatgaacttattcggacacggttttgccctgtcaggagactttgtcattcaggcggcgccaaagctgactgcggatgcagcaggcattccagtcggtgatgtcgtctcggccagtattccgcttgtgctgattatgggtgtgacaacaacaactgctgcctttatcatgattcagcgcgaacgcaaaaaacaggagcatcccacttctttttcccccgttctttccggcgaacaagacaactcgctgtacttgccaaaacgcctgcggtccatactggcttttttgattccgcttgcctttcttgcagatatcgcctgcatgctcttgtttaacctacaaggaaatgatgcaaccgcgttaattggcgggtctgcaatttgtatcctctttaccgttcattttttcgtgtataagcataaagggcttgaaaaaatcaccggctattttattgacggatttaagttcggttttaaggttttcggccccgtcatcccgattgccgctttcttttatcttggcgactcaggctatgaaagcatactgggcacttcactccctaaaggttcccacggcattgtcaacgatcttggcattgctttatcccatatgatgcctatgtcaaaggagcttgccgccactgcattaactgccgctggagccataacaggccttgacggctcaggattttctggcatttctctcgccggctccatcgcaaagctcttttcgtccgctctccatgccgatcccgctattctgaccgcgctcggacaaatctctgccatctgggtgggcggaggaacactggtcccatgggctttgattcccgccgcggccatttgcaaagttgatccttttgagcttgccagaaaaaacttcattcccgtcgcgattggccttttggtgacaaccctcgcagctgtgatgatgctttaaaacagcatgagttgaaatattcagactttttctatacaatcatggaaaagcatagaaaagggggaagcggctttgtccatatccacactgcagaaagagataaacaaacagctcgacggctgttttgaagaaatggttgagatcaggcgccattttcatatgtatcctgagctctcatttcaagaagaaaaaaccgccgcatttattgcttcctattatgaatcgttaggagtcccaatccgcacaaacgttggcggtagaggggttttagcaaatatagaaggaagcgaacccggccctacagtcgctttgagggccgactttgacgctctccccattcaagatgaaaaagatgtcccttacgcctccaaagtgcctggtgtcatgcatgcatgcggccacgacggccacaccgcagctcttctcgcagtggccaaggtccttcaccaaaacagacatgaactgaagggaacatttgtgatgatccaccagcatgcagaagaatattatcctggaggcgcaaagccaatgattgatgacggatgtctcgaaaacacggatgtgatattcggcactcatctttgggcaactgagccgctcggaactattctctgccgccccggcgccgtaatggcggcggcagaccgatttacgattaaagtcttcggaaagggcggccacggcgctcatccgcatgatactaaagacgccgtcctaatcggttcgcaaatcgtttcctctttgcagcacattgtcagccgcaaagtcaatccgattcaatccgccgtcatttcgacaggctccttcatcgccgacaatccgtttaatgtcatcgcagaccaagcagtactcatcggcacagcgcgttcttttgatgaaaatgtccgggacattctggagaaagaaattgaagcggttgtaaaaggaatatgcagcatgcacggcgcgtcctatgagtacacctatgaacagggttatccagcggttgtgaaccatcctgcagaaacgaaccacttggtgagcaccgcaaagaataccgagggcgttcagcaggtcattgacggtgaaccacaaatgggcggcgaggattttgcttattacttacaaaacgtgaagggcacttttttctttacaggcgccgctcccgaacagccagagcgagtctattcccaccaccatccgaaatttgatatcaacgaaaaagccatgctgacagcggccaaggtccttgccggcgctgcgatcacctatcatcagctataaaaaaacagccggagtgtttattctccggctgtttcctttaatatcctcagatgaaaaacatgtcttgccgtttctccaagctgagcaagcagcttataattggcaattccgccgactgccgctcctacgcccggcaaaagctgaaaaagcttcacgacgtcgatataatcgcgatattcctgctggaacactctccagtcgatgctctttttctccgtctcccaattttcgatgacagaaaaaagcgacttacggccatcatcactcgaaaacgcaagctgaaacacgagcagcaaaaatatcctttcttgtgcatccttgacatcaaagccgtaaatggaagacaaggtaaataaacacttcatcttaattgaaagcagcagcggaaaatcagcaatgcttaaaaaaatgccgcccgctccggtgccgactccctcagcagctgccactttttgataagaaacaatcgtttttttcgccaattcgtttttttcactgagcgacagtgcacttgtatcctttttataggtgatgatattagagccggccattgtcgcttctaccatttttttcacactctcggtgacgaccgtatggattttttcaggaatccgttcattcaccttcgtctggacacgcttcgaaaagcgttcaaacatggaatcctttcgcaaaaaatgcattttccattccaaagcttcctgcatcagcagctgattatctgtcatttgattacctcttttcagttcacagctttccgtgctttttcagcctggtcgtcatataagcaggcaaaacaacaaaaatcagaacggcagaaccgatcagcgcgtacagaaaaccggtcaagccggctgcataggcagatgcaacagacatcagcagcgcttgaatactaagtgcagtttttaatagagagaaatagcttttcagctttgtttctttttgcacagggtacagctcttgaagcgccagatggtcaaagtgaccgaagagcggcagaagctgaatgcccgtaatgaaaatggcaaacacagtcaaaaccgcggcaatcagcgggctggctgagacatacataatgatcagcgcgaaaacgatcgttaatctgacaagaatgcccaaataatcgctcgaacgcaaaaaggcgcgggtgaacatataggcaaatgttttgcgctgttcaaacggcacaagccgcagcaaaaagtcgagataagctctgcgtttggcttgctttcgcaaatgcggcacatcagtaaacaggttggcaatccgatagaaacgctgctttcgtctcaattcggactcaatatggctctcccatttaaatgttttccgttttgctgcggaagacatatacagataaagaacagccataatgacatagacgagaagcgcatacatataaacagattggaaaacaaaataaagaacgagtgtattcgccgcaaagcgaatgatgacgtccatccgtttcatgctgcggtcgttttggaaagtcgttcgccattccattacctgattccacgctttcagcagcaacagttggacaaagaccgcggcatacgatacgagcgaagctcccggagtgactgcgaaataaagcggcatcgcaacgatgctcagcgcaatcagcggaaacagctgagacacatagctgtagacaaacgcctgcttcaagtaaggctccatttttgcttcaagaggcaataagaaaacaaggtcagcctccttcaaaagcgttcgcacataagagcttgtcaatacgagcgaaaacagcacggccatcacccaaaaggacggaaagtgagcgggaatgtcccgtatccatttgctgtaccagcttgcagcgcccgctagaaaaaaaatcaaaacaatgacgaggtgatcgttgagcatatatttcatgtatgttcttgtttctttgatatgctcctgcagccgcgactgccaaatatcaagcatattattcatggccagcgtcttcctttgtaagctcaagatacaaatcgtccagcgccgcgtccttcattccaaactgctctctgagctctgacagcgtgccgcgcgcccgcacctcgccgttatgtaaaataataaacgaatcgcaatagcgttctgccgttgccaaaatgtgtgttgacatcagcacgctcgccccgccttttttcgcttcattcatccgttcaagcagcgcgttaatggcaagcggatcaagccctagaaaaggctcatcaataatgtagagcgcaggctctgccaaaaatgcgcacataatcataaccttctgcttcattcctttagaaaaatgggccgggaaccacttcagcctcttttccattcggaattcctttagtagcggaggcagccttttctccatcgtttcttttgacagtccatatgccatggctgttagttcaagatgctccatcagcgtcaattcttcgtataaaacaggtgtttcaggtatataggtaaattgtgaacggtagccttccggatcctcagcaaacgttttaccgtttaattcgattgaacctttatgcgggtccatcagcccgatgatgtgtctgattgttgtacttttaccagcaccattcagcccgattaagccgacaatttgattcggttcaagggtgaatgatacgttttttaaaaccggattccttgtatatccgccggtcaagtcttttaccgatagcagagacatagtttctccccttatagtgtttttcttcatagtaccaaaaacaaggcctgatttgaaacaattcccttttaacaaatgatgaatttgctgtcataaagagacagggttctggacatcataaaagttgtagaggaaaagcatatcaactgaaaaatgaggtgtttgtcaaagacgtcttagaaacagttggatagaaaataaacatgtccaatgctcaaaccatttctcttcactgaattgatgaattcttcatgtatgaagcaaattgtcaaatgaggtgtttatcgcaggaatcgttaggcattaaacaagtcttcattttattgacaaatgaggtgcttaccaaaggcataacacattttcttcatataagctcttcctctgcattcagggtgaacgctcgccgttcatcctgttttctattttctgcatttctgtggtacgatgaatgtatacatactaaacaatttcataaggaggaaccctcatgcattgtgcagagaattgtatcttttgtaaaattattgccggcgacattccatcagcgaaggtgtatgaagatgaacatgtacttgcctttcttgatatcagccaagtgacaaaaggccatacgcttgtcattccgaaaacacatattgagaatgtatatgaatttacagatgaattagcaaaacaatatttccatgctgttccaaaaatcgcccgcgctatccgggatgaatttgaaccgatcggcttaaatacgctgaacaataacggcgaaaaagctggacaatctgtgttccactaccatatgcatattatccctcgctacggaaaaggagatggattcggagcggtttggaaaacgcatgctgatgattataaaccggaggatctgcagaacatctcttcctctatcgcaaaacgcctggcctcatcataagatgaggttattttattttgtgaacatttcgcaaacatccgtcaatttcttttgataattctaattttttatcaaaaaactgaatttttgtgataggataattgtattattttatacattaacgtggaaaacagggagagatcataatggaacgtacaacgaattttaacgcaggtcctgcagcgctgccactggaagttctgcaaaaagcacagaaagaatttattgattttaacgaatccggcatgtctgttatggagctttcccaccgcagcaaagagtatgaagcggtgcaccaaaaagcgaaaagcctcttaatcgaactgatgggcattccggaagattacgatatcttgtttcttcaaggcggggcaagccttcaattctcaatgcttccgatgaactttttaacacctgaaaaaaccgcacattttgtgatgaccggcgcttggtctgaaaaagcactggcagaaacgaaactgttcgggaacacgtctatcaccgctacaagtgaaacagacaattacagttatattccagaggttgaccttacggatgtaaaagacggcgcatatttacatatcacatccaacaatacaattttcggcactcagtggcaggagtttccgaattctccaattccgctcgtagccgacatgtccagcgatattttaagcagaaaaatcgatgtgtccaaatttgatgtgatctacggaggcgcccaaaagaacctcggcccttccggcgtgactgtagtcatcatgaaaaaaagctggctgcaaaatgaaaatgcgaacgtcccaaaaatcttgaaatattccacgcatgtcaaagcggattcactctacaacactccgccgacatttgcgatttatatgctgagcctcgttctggaatggctcaaggaaaacggcggtgtggaagctgttgaacagcgcaatgaacaaaaagcgcaggttctctacagctgtattgatgaaagcaacggcttctataaaggacatgccagaaaagacagccgctcacgcatgaatgtcacattcacgcttcgggatgacgaattaacgaaaacattcgttcagaaagcaaaagatgcgaagatgatcggccttggcggacaccgttcggtgggaggctgccgcgcttctatttataacgcggtctctctcgaagactgtgaaaaattagctgcgttcatgaagaaattccagcaggaaaatgagtaaaaagtctggctatgcaaaccgtccgtttggtatactgtttgcataacacattctgtaaagccttcgcaataaatgatgagcatattattggagggcaaaaagcttagcagaggagagcatagttatgaaaacaaaagagttagtcattatggctctgtttgccgcaatcggcgcagcgcttcattccattattccgccctttttaggcggcatgaaaccagatatgatgctgatcatgatgttcatgggcattctgctgttcccgcgggtgcaaaatgtactcgtcatcgggatcgtgaccggaatcatttccgcgcttacaaccgcgtttccagccggacagatccctaacatcattgataaacccgtatcagcgtttctgttcttctccctgtttctcttgttcagaaagagccggaaaacaggtgcagccgctgtgctgacagtgatcgggaccatcttatcaggaattgtgtttctatcgtcagctttattgatcgtcggtttaccgggcggtttcgccgcattgttcgcggctgttgttctgccggccgctgtgctgaatacaatctcaatgatcattatttatccgattgtgcaaaccattttaaggcgttcaagctttatggaagctgctaaataattgtcacacaaaacctcttccgcttccgggagaggtttttttgaacagagcgcccgcagcatgtcagcatgttttaagcgaggagttttgtgaaaaagataagacatagtgtaaaggcggttccggttgaacaaacaagcgctttctgccggataaccctcttgggcggataagaagcagcctggctgagaagtttgatatagtaaacagcgcctgaagcgaaggcaagggtgatgcaggataatacaatcaaaaagacagacaaccttctccctccttttcacttaaaaaatatgctaaaataaagcaagctatgtatagaagttcaggctttcaacaaaaatgaaaaatgctgaatgaatcctattttgaagaaaaagacggggtgattgtaatggcgagcggacgttctctattaacaggactattcgtaggcggcatcatcggaggagcagcggttcttcttactgcaccttcctcaggaaagcagctgcgtgaaaaaatgaaaaccaattatgattcttttgaagaaacaatcaaacgcttaaagtcagacgggcttgcattaaaagaccagctgatcaaagcggcaaaagaaagcacggatgttattaaagacgtgggcggcgagctccaaacatcaattaaaaaatggcaggaagagatcaagcctcaccagcaggatctgcaaaaagaaattgccgatatcgaagagaaaatcagacagctggagaaaaccttacaaaactaatatcctattcaaaagaaaaaatgcgggccaaaattggacccgtattttttttggccgaaaaaccctttcgtcgcaatggtttgtgaatttattaaaaaattcttacattttcatctttattaatctttattttattggcataatagagaaaaagaaaaagagaagcaggtgacgtaatgaatcgagtggaaccgccctatgatgtgaaagaagctctggttttcacccagaaaatggctcagcttagcaaggctctttggaaatcgatcgagaaggattggcagcaatggctcaaaccgtatgacctgaatattaatgagcatcatattttatggattgcgtatcaattgaatggagcttccatttctgaaatcgcgaaattcggggtcatgcacgtatcaaccgcattcaacttttcaaaaaagctggaagaacggggatatttaaggttctccaaacggctgaatgataaacggaacacatatgtccaattgactgaggaaggtaccgaggtattctggagcttgcttgaggaatttgatccgacacgcaacgctgtttttaaagggtcacagcctttatatcatttattcggaaaatttcctgaagtggcagaaatgatgtgtatgatacgccatatctacggcgatgattttatggaaattttcgaaacgtcactcaccaatattgacaatgactttgaaagcgtaaacggaaaattgaagaaaaaagcaaaggacagtgcggcggatgaaccggctgaagagctcgaacctgtaaacagttaatcaaaatgcttcatgatgtcgataaagacttccatcagctcttgataaagcccctgctcatacagggcaaaaattgtttcatgaacatctaatttttcattcagctgtccggcaaaaagcgcaaggagcttatcaaaggttacaaatccttgcgctttttgtgttgccagctcttccgacaattcgtcgcatatcctcataaccgcttccccttcttccttgctcagccctttatcaatgagaagcgcatagaaggggtacctgtccatatctactgttttcactaataattgtatgtaatattctaatcgctcaatgcgatgatccatcgaatccatccacaccacttctttctatctttaatcttattttagctgataattcactgagaagaaagttctaaccccatatttcgcagtttgtttgcttgtttcaaaaaaatacctgccggatgatattttttcttaaaaaagcattgattttttctcttgggaggagtaaattattttgagattctattcaagatgtatggaaggatgactttgatgaattgctggaagaccataaatctcatgaaggattatggcgccgttcgcataatattaactgctgtatgttttatgattttggtttttatatctacctttttagcttttgagctgctgcggcctggcacaagcttaagcgatgaatatgtatctttattcggcggtttgctcgtcgttattttatttgtacataaagtcatccatgtcctgccaatcatctgcaaaaaaagaaaaatagaaaaaaagttttacatattgcgcatgcgcacatggaaacgtataccaaaaacaacaatgctgatttcactcgtcagcccgttcttgctgattacaccggtattgttttacgcagcactggcatttccgaatcacgctcattatttttgcatgatctcgggcattcacgccggctactgtctgcctgatttcctgctggctctcaagctgataaaagcaccgaaaaccgcttttattgatcaggaagctgacggcttggatattcttgttgaaaagtagtcaaaccctggtgctggtggcgatttttcaatttgcattctatcttttttaataaatatttggtaatgtaatatgggacagttcagagagagggggaatctcccatcattttattctattttatcgtggctgccgtgtttattttatatttcataaacaggctcaccaatacattatgccttgtcagagagattcctgaagagcggcaagataaggtattccgatttattaatgtatctatattaattttactgatctcttcgtttgtggagatctcctttacagtgtaaatacgaaagaaagcatagctgctgattaagcagctatgcttttttatgttgattagtacagccaagaagcgccgatgataatcaataaaataaataacacaaccaataaagcgaatccgcctgcaaatacttcacccatcttaaatagcacctcctgtaataagctttatttaccaattacatgttatgcaattcatgtttgaaacgattaggcgctagtgaaaataaaggatcgcttatgttgcaagcgatcctcgggctgcttagtagatgtaagctgcacctacgatgataagcaaaatgaacagtactacgagcaacgcgaatccgttagagtatcctccgctcatgttacatacctccttttcttgatcaatatataagtatgtcatcagcaaaagtttgactagacgaatgccctttatttaaaatctttttacagaaagccacaatatgttatgatacgcataggtaatttaatttggaatgattaggagtgtttgaaaacaatgaagaaaatcgcaatagcagctatcactgctacaagcatcctcgctctcagtgcttgcagcagcggcgacaaagaagttatcgcaaaaacagacgcaggcgatgtcacaaaaggcgagctttacacaaacatgaagaaaacagctggcgcaagcgtactgacacagctagtgcaagaaaaagtattggacaagaagtataaagtttcggataaagaaattgacaacaagctgaaagaatacaaaacgcagcttggcgatcaatatactgccctcgaaaagcaatatggcaaagattacctgaaagaacaagtaaaatatgaattgctgacacaaaaagcggctaaagataacatcaaagtaacagacgccgatatcaaagagtactgggaaggcttaaaaggcaaaatccgtgcaagccacatccttgttgctgataaaaagacagctgaagaagtagagaaaaagctgaaaaaaggcgagaagtttgaagaccttgcgaaagaatactcaacagacagctctgcttcaaaaggcggggatcttggctggttcgcaaaagaaggccaaatggacgaaacattcagcaaagctgcattcaaattaaaaacaggtgaagtcagtgatcctgtcaaaacgcaatacggctaccatatcattaaaaagacagaagaacgcggcaaatatgatgatatgaaaaaagaactgaaatctgaagtgcttgaacaaaaattaaatgacaacgcagctgttcaggaagctgttcaaaaagtcatgaagaaggctgacatcgaagtaaaagataaagatctgaaagacacatttaatacatcttcaacaagcaacagcacttcttcatcttcaagcaattctaaataataaaaaaagctgtgcggctcattgagccgcacagcgtttttttatgcgatggaatggttttgattttcttcttcatgctgctgagaactgcggcgttctcgctccttttccatcctctccatataaatctgtccttctttttcaataaaagcctggtctactttttcttcctctttggctgccgccacaagtttatatgcgctgaaaatgatgcctacaatacaaagatacacccaccacggaaaaaataacacgggctcctccccctttgcatagattctttattcttaaccatatgcgggaatgagacgagttatgtgcgggaaagacgcatcaaaaaggactgagctgaatatgtcagcatcagtcctttttaagttatttatgaaatgtcggtttataaaaggaacggttttccagtgcaaatacacgttcagtatactcgcccggcttcacgcgctcaagcgctctgtccatcatattcatttttgcatccagattgtctatatagtgaagaatttccgcttctttcaccataggcggtttcgggctgccccattctgctttgccgtggtgactcaaaatcaaatgctgaagaattaacacctcttcagaatcgatttgaagctcctcagccgcttttgaaagctctgtcaccatgatggaaatatggccgagcaaattgccttcaaccgtatatgaagtggaaacagggccggacagctccttcacttttccaagatcatgcaggataacaccggcgtaaagcagatcacgatcaagagaaggatataaatctgctattgctttcgccaggttcagcatagagacaacatgatacgccaaacctgagacaaactcatggtggtttttcgtagccgccggataatccataaactcagcttcgtgttttttaaccaaaaaccttgtgattcgctggatattcggatttttcatttcaaatatatattgagtgatggtatccatcatttcatttttcggaatcggcgcggtttctaaaaaatcatcaatattgacgttttcttgctcgcttaccggtctgatatttcttagcttcagctgggtgcgtccgcgataatggtgaacatcgccgacgaccttgacaatcgtctgcggcgcataggtcacttcatcactttgcttggcatcccacagcttcgcttcaatatcgcctgactggtcttgcagcatcagcgtcagaaacggttttccattgcttgcaatccctttcgtcgaggatttaatcaatagatactggtccacctgttcgccaacctcatgtagcataatccctttagccattctattaaagctccctccgtatcttacataataccagtatatcacataccgattttcagctatagaacctcttttatgacaccaaatggatgatttggctgctatgaaatgcatcttttacgtgctcatggcatgtaaaatacaaaatctgcctaccgccttcagataaatcatacagaacatgtaatacacgtttcagcctttcctgatcaaaatgaacaaaactgtcgtcaagctggaacggaagctttgactcaccctggcgcgtaacggccaaagcaaagcggatcgctgtatacagctgttcacacgtcccttgtgacagctcttccgcatgatagacagtgccatcgcgatgcataaccatgatcgaatcatccgtttcggaaaaataaatggtttggtagtttccgtcagtcagaggacggaaaaattctcctgccgtctccagaaggcgcggaagctcgatttttttatgccgctccaatttgtttctgatcacctgtttgaccatttgtatggaggcccattttttagccgtttctttcacacgttctttttgcatttcggtttgaagcttgaggtctgagaccattcccgaagcctctaattgttcctgtttgactgagagcagtgcgatttggctgcggagctgctcgatctcctcagtcagccgctcttttctttcattctcaacaaattgcttatctttcaattcagaaagcgtattggaatccgccagttcaagttcctccgggtacccgccttgaagctgtgcgtttacgtgatgaagcttgttctccgtatccttcaattgcctgctgatggcggctatggcaaaaaacgcatctctgtcttttgcagcagccgcggcaaataactgttcaatctgtgcgtggaaatactgtatttcttgctcaagttcaagcatctgttcctttgtataatgaatatctgtttcaatttcctttttttgcttctcaatttctttttcacgttcaatgtttttccgcaatgtgtgaagggcgtccgaaatggagatatcctgactctgattcacgggaagaagcatactgacgcgttcttcgaatgttctccggtgctttttcagcctgcctgcttctatggtcagctcatgctttttcttcacttcttttttaacatccttcattaagctgtatgcatcaagcaaaaatgatggatcttccttaaatccgagctcattcataaaacgctcaacctgtgtaaaggacggcgccatttcggcttcccactgttcaaactgctggatgaccctttcatacgccgcctctttttgctggagcgctgcacgctgtgtgagaaggtgctgcttattgcggtcatcctcccataacgcttctctaagcatttcagcttctgctggtgaaatatccgtcatgggctgtcttgtctctcggctgtttcgagaagacgactttcctgaaacaagccaatacacaataagtgcagcgccgaaacttatggcgggaatccattgctgcagcagagaaaagagaacgatgaacaacataccagctgcaatgacagtctttttctgtttagcctgctgtctttcaaaaaacgttagctgttctctgagcttcgcttgctcttggtgctgcccctgtgtttcatcatatgctctaagagctgcttctttatcttttctttggctgttttcaagaatcgcggacgaagcggcacgaacggccttttccgcgtcttccagctcttgccgggcaagttcaaacgtctcgtcaagctgccgttttctgtctcttgcctgtacatattgctgcaccgcttgctgaagctgccattcataatcatatgaggtgttcatattcaggagctcattttcatccgttttattgagctgttccagccctgccgctgtctgcgcagacgtctggcgcagctgtgcctgaatggctgccagctgttctccccaggattggtacatatgaaacgctgccgaaagctcttgtatcagcgtttctttcgccaatagttctttatcggggataagcttttgcctctgtttgtccaactccgccatcttcacccgaagcgcctcaagctgtgctgatttcgggtgaagatgggattcatatttttccagctgatgcagtccgtcagcaggaaattgtcctgcgtgttccggaaattctgcaatcacctgttcgagtgtcgctttttcatttagcagcggctttcgctcaatcgctccctcaatcattcggatatgtcccgccgtctctttcaattcggtttccgcggctgcaaggcgggcttcaagcgttcgtttttcctcgagaagctgatgatagcccgcttcctctgcttcagcctgttttagcttaactgccagctgcttaagcgtttccagctcctgattcaattgagggtttcgcccatttggtttatagagcctttcgctttccttcgtcagccttgaatcaagctttgatacggcttcagcaccaaacaagctggaaaagagcaaaaattcccctatcttgtcccgattaaaggcgtgaatttcctgcagcccgaatacgtcgaacgaatatatggctttgtacaacgacctgtctgtgccctggaacagctgctttaaaacatctccctgctttacttcgcccttttctgtgtacacgcttagtttttcggcagtccctttcgtccgttcgatcttcagcaccccatactcaggatgttcagcttcaagaacaccgccgtagacaccgcctgttttcggttcatactttttcgttttcggaaaaccgaacagcatgctttcaatgaatgacatcatcgtcgtttttcctgcctcatttaatccgtagatgacttggacaggagaggcggaaaagtcaaaggtccgattggaaaattttccgtattggtagatatgtaaagatataattcgcaaagctgtcaccgcctcatgtatcaagcaccttaagctgtcttttcaatattatctgtgcctgctcttttatttcctttacctcctcttggctaaaccggtccgcgtgccttctatacactggatgccgctcaagcccttccagcacgtctgacagatcgctgcgatcaatgtcttcaaataaaccgccaaaaaaaggatcaaggtttgttaggtttgcttcgttttctgtctcatcgtccaatctaagaggccaaacgaaacgttcctcttccgcttcttgttcctgaagagcttcaagaaactcatccaaggtgccttttggcgcctccagcagccattccggcgccgtcccttgtaaaacaagccttacacaaacagggctcccctttttccgcagcttcgaaaacgtgtcctccaccatttggaagagggctgtcatattctttgcctccgtcacatcaaccgccgctttttcccacaggacatcatgcgctctctgaaattcataagatatatctccgtttgtcacatgaacgagataatagcctttatctcccgtctcctttatatggcgtgcttgcgtgtttcccgggtaaatgactgccggatgctcggcagatagaacctggcgtttatgtatatggccaagcgcccaataatccatcccgcttttcacgaggtcgtcatgtgtaaacgggcaatacggatcgtgtccttcagatcctgacagcgtgccgtggagcatgccgatatgaaacggtgcgtcagttgatctccgatagcgggcggcttggttttccatcaatgctctggcttgatagctgaagccgtaaatgcttgctatgcgcctgccttctttaaaaaacgatttttcttctggaacagcggacgaaaaaatatggacattctcaggccattcaatcggcgtccactccccgccaagatgatcgtgattcccaaagatgacgtataccgaaattccgcactctctgagtctttcaaactgttttttcaaaaagagctgagcctttaagcttcgattggcttcatcaaacagatctcccgcaagcaaaatgaaatcaacgtgctctctcactgcggcgtctatcatatgtctcacgcttgcaaacgtgctttctttaatccgggcaaaaatcggctccggcagatgcgatatcccgtaaaacgggctgtcaagatgaagatctgccgcatgaataaaggttagatcagtcaacattctgctcctttccaggatgaagtacccttattttagcaccgaattcttgcgaatgcacgttctgtcaataaagaaacagcctgagaatccccaggctgttttccaatcagtttttcgctaaacgtagcgcttgtttgatcgctttgaacgcgcttgaattgccgtaaattaatacaccgcctttataaattctggcgccgataacggccagtatgacaatggtgagcagtgtgattccgattccgacagccgcctgccagaacggaatatcaagcatgccgacgcgcaggaacataatcattggcgtaaagaacggaataaacgaagttaccgtaataaatcctgcgtcaggcgcattcaaaccgaacatcgcgatcataaaaccggcgacaaccaaaagcgtcatcggcgtgatcgtttgctgcacgtcctctattctgctgacgacactgccgagaaacgcggcaagtgtcgcgtacaaaaagtatccgagcaaaaagaaaatgacagcatagatgacagtggttgcagatacgtcggtcaaattaaggaatccgccgacagatgaagccgtttcgctcttttggttcagcttaagcgacagagagccggctcctataataatagcaagctgtgtgatcccgacaagcccgataccaagcagctttgcaaacatttgctggatcggcggcatacttgagatcaggatttccataactcgcgaagatttttcggttgcgacctccatcgctatcatgctggcatacataatcaccgagaaataaatgacgaacagcataatgtaaacaagccctaccgtctggccaagctcttcctcagactttgccccttctttcagcgccttctgccccacagtaacaggcgcataaaggctgctaatcgtttcctgcgacacgccgagctccgctgttccgacagctgttttggtttgcgtcagcgcctgctgcagtgtttgatacgtgctttcatcagaaatcgttaacgctttatatgttcctgaaatggtccctttttcatctcgtttgatgatgagcatgccatcgagtgattcatctttgacttgctttgtgacctcatcctccgattgcttcgacagcttcacatcaagatcgccgtctgtatccaccgctttcagctgcttagaaaaaaccggatataattcgtttgtttcatcaacaacggcgattttttctttcgcatcgtcaccttgaaacaaagaaatgatcgactccagattcgttacaactaaaacaagcagcaccgtgatgacagtcgaaataataaaggattttgccataatcttatttttgtatgtatgagaaagcatgatccaaaatttattcatagacggcccccaccttttctataaaaatatcatgcagtgacggctcttcaagctcaaactttctgataaacccttttccttggagcatcgcaaaaatctcttgagaaatgtcttcattggcaatctgcagcttgacgccgtctgccgtttccttccattgaagaatgccttcatgggactgcaaaaagcgcagatcgtcatcggagtgaatggtaacattctttttaccgaaagaacgcttgatctccttcagcttgccttgtacaaccggttttcctttctgcaatatgcaaaggttctcacaaagctcctccacatgttccatccgatggcttgaaaataaaatagaaacaccgctgtttttcagcgagatcacggcctcttttagcagctcaacattgacagggtccaagccgctgaatggttcatcaagaatcaggagctccggcttatgcaaaactgccgaaatgaattggattttctgctgattccccttcgaaagctcttccaccttcttattctcgtaatctgtaatattgaagcgttcaagccatgtcccgagctcttttacagcctctcgcttctccatcccttttaatctggcaagatagacgagctgatcccttaccttcattttcggataaaggccccgctcttccggcaaataaccgattttgttgctgatatgataattcacaggacggcccttccagctgattgagccctccgtaatgcttaataatcctaggatcatgcgaaacgttgttgtttttcccgctccgtttgcgcctaatagaccgaacatttgctgttccggaatatctaagtccaatccgtcaacggctttataatctccaaatgtcttcgttacgtgatcaattgtaagcactgaatctcctccttccctgacccattatatactaattttggataaagcataataaaggattttgatttcctttttagaatataaatgaagaaagactgataaaccttaaaatggaggagaaacctgatggctgattatttccttaccgtatttgatccttcggggaacacgctggtaaacgagcaattcgaggcagaacatgaagaagcggcaaaaacgcatggtgaagccctcttaaaagaaaaagagcttcatagtcatactcatcgtttagtcaatgcagccggaaagctgattttgtttcacagatgatcagctttccggctgatctgttacgcttgaaacttcggctcccgtttttctaaaaaggcacggattccttcttggtgatccttggtccttctcattctctcttgggcgctgcgctcaagggatagcacttttttcagttcttcaatttggaggctttgaaaaatacctttcgtttcgatcatcgccaaaagaggggaggccaacagggtttcgataatgggtcttgcgccttcggcagggtctccggcaaatgtcccatcaagaagccccatatcggcagcttccgaggcagatagtttttttccgctccaaatcagttttttcgcttttgcttcaccgattcttttcttcagcaaataatgtcctccgccgtccggaacaagcccaatgccgataaaattcatcgcgagaacggcgtttttttcagcgagcacaatgtccgcacaaagcgccaaactcaggcccagtcccgcagcagcaccatgaatggctgcaattgtcactttcttcatctgatataaattcagggtgacagcctcaatcgtatccatcagccgtttaaattggtcagggtcatgctctgacgtcatcatcctgatatcaccgccggccgaaaagcctttcccgcttcctctcaggagaacgatgagcgcctcgcttgcagccgccatttcgactgcctccttcaattcagacagcatctgttcattcagggcgtgatgggcatcaggccgattcaggataatctctgcaacggccccattacatgcatattgaacaaactccattaaaagcacctccatgtatgcgcttactttttctttctcctatacattccccgccatccccaaataaacctttttatttttcaaggtcaatagatactgaaaaatgcatattgtttgaatggaaacataaagttttatatagtgaaaaagaagggatatcttgatgagaagggaggaaaggaacatggataaattgctgatcagttttctgttaagtttatttatggtgtactttcccccttcggacgtggttctgccttcccagtttgaagcaagcactgacagctatgtgcctatgtcttcatatccgcaggaaacacaatcggcaaaaacgccatcgccgggcagcatgcacccggctgagctgatcaaagagtacagcccgctggcgcagtctgtcaggcagctctctgtcaaaccacttgacgaaccgctgataaacaggctggaaaaggctttggccgtccctgtcaaataccagtctaattacctccgaatataatttgctcaagttttatttgtaactcaccccatactgccaacactacattcggagggattttcattgaatattaaagaaaacgatctgccgggcatcggcaaaaagtttgaaatcgaaacaagaagccacgaaaaaatgacgattatcattcatgatgacggaagaagggaaatttaccggtttaatgaccgggacccggatgagcttctttcaaatatttcattggatgattctgaagcaaggcaaattgcagctattctcgggggcatggtctataaaccgcaagctctggagtccatcgaaatggccttcagcgatcttattattgaatggtttaaggtcgaaaaaggcgccaaatcgatcggacgcacactcggtgagcttgatgttcgccagaattacgatgtcactgttattgcgattatcaaacacaaccaggaaaagctcctaaatcccggagcggattcgattattgaagaaaatgacacccttgtcctctcaggtgagagaaagcatctgaagaaactgattcacgattttctttctggagagggcgtgtgagccccgatggaccatcttgtatttgaagtcggaactgcacttgtgcttgtggcaatcgccagtgtgatcgccaataaaattaaattttcgattattccgtttctgattgtgctgggaatgcttgttggaccgcacgcgccgaaaatggggattattgatctaacatttattcaaagcagtgaaatcatcgagtttttcgggcgaatgggcgtactgttcctcctcttctatctcggactcgaattctctgtcgggaagttaatcaaatcaggaaaatcaatcgcggtcggcgggacgatttatattttgattaacttcagcctcggactgctttacgggtttatcaccggattttcctttctggaagtcctcatcctcgcaggcgtcatcacaatctcgtcaagtgcgattgtcgcaaaagtgctcgttgatttaaaaagaaccgccaacccggaaaccgaattgattctcggcatcatcatgtttgaagatattttccttgccgtatatctgtccgttgtttccggccttatactaggtgatgcgacatccgtagggagtgcactcttgtccattttgatcgccttcggttatatgctgctgttttttatcgcagcaagaaaactcccgccgctgttgaacaaactgttggacattcgctcaaacgaagtgtttattatcgtcattttcgcagcactcttttttatcgccggttttttcagagacgattcatgtagcagaagcaatcggcgcgctgctgctcggtttggtcttttcagaaacagagcattccgataggattgaacacctcgttgttccgtttcgcgacttcttcggtgcgatgttctttttcagcttcggcctcagcatcgatccgttttcgcttggtgaagcggtttggcttgcgttgggtgcagtgattttgaccattctgggaaattttatcgccggaatggtggcaggacgacgcgcagggctttctcataaggcttcatcgaatatcgggctgacgatcgtatcgcggggagaattttcgattatcgttgcgaatctcgggatagccggcggactgtcggccacattaaagccgtttgccgcattatatgtcctcattctggcgattttgggaccgcttgtcacaaaggaatcaaaacgaatttaccgcttgctgaacaaggtatttaaatggaagcctgaggttcagcccgcaaaaaaacagggataaaaaaagcagcactgtaatcagtgctgctttgtcgttttttcaaaaatctgctctaaatatttgattttttcgtccgtgtagtgctcgaagcgctcattgtacgatttcggatctttcggattcgcaaaatgcgtaattttccctgtatcccgatcaataaatttactagcagcgccgcagccgatgccaataatcgtctgcacctcttccataatcataatgttgtagatgctttcttgtcccggcaaagagtatccgacgttttcaaggtttccaagaatgtttttctggcggtataaataataaggcacgtacccatgctctttcgtccaggctaccgcgtcttccatcatttgagaaacctcttccctgccggcaactttgtacttatgcttgtttctcgtcatttctgacgcccgtttaaatgaaagagtatgaacggtaagggattccggcatcagtttttctgtttctgaaagactgtgcctgaactccttcacgccttccccaggcaaaccaataatcaagtccatgttaatattattcatgccgtgctggcgtgacagatgatatttctcaatggtctcttcaaccgtatggtgccgcccgatcgcctttagcgtttcgttttcgtaggattgcggattgatgctgatccgatcaatgtcatatttgtttaaaacggcgagtttttcttctgtaatcgtgtcaggacgaccggcctccaccgtaatctcacgaatgtttttcacatccgggaaggagcggaccatttcttcatacagcagatccatctcctccgctgtaatgcttgtcggcgtcccgccgccaaagtaaatggttgtaaccttaacatcatgctccttcagccattcaccgattttctgcatttcgtaatgcagtccccataggaatgagccgactctgcccgcctgtccttggatagcgtacgcagggaatgtgcaatacgcgcattttgtcgggcagaacggaatgccgatataaatgctgacttcatcctttactcggtacaaatccggcactgccgccagctgacggtcaacaatttcctgcattagcatgattttttcatcatgaattaaatagtcttttttcaactcagcatgcgcttgctccttggacattccgctttgcagttttttatgaagcagctttgtgggccggattcctgtgaggattccccacttctgcgtaatgcccgtatgcgcctgaagaagattgagatacacataagaaattgtgtttttcacttgcttaaaagcttctttttcagtcatgtctggagaaaagaattttgtatgctgttcctttatgccagtacccttcacttctccagaaaccgtcacatgctcatccgtttgtgacaacgctaaagaaatgacaaaatctgcgggctcctctccgccatacgcaagctcgcactcttcataaaacaaatttgcaatattttgcagaggccgatgcaggcggtcatcatgtatgccttctattttaatttgcaacttcatcacctaatttatcagattcaaaactttctttagtgtacagaaataaactgctaaaatcaatccggcaaaaaagccgccgcacctgtcagggcgcgagcggcttttttacacacgtttcatgtggaacttatcaagaaatccttttcgctgctgcattcggaaatattccttcatcatataagcgacaccttgctcgtcattggaccttgtaacccaatctgcctttctcttaatttccggaacggcattccccatcgctaccccaagaccggcaagttcgatcatcggcagatcgtcatactgatgcccaatggccacgacatcatccatactcaggcccagctctgaagcgacgagggccaaacccgcttccttcgagacacccttcgggacgatattcagtttctcatcgtttacgcgaatcacgtccaccgcagggaaggcttttgtaatcgtttctgtaatgtcatgctgaatgtcgtgctccgtgtacacctcgatgacgggtgcactcaccggctcatccatgaggagatcgcttaatgattcaacgaactggactggataaaagatcgggtcagacggatgaatgagtgctttccctaataaattcgaattcacctttttcttgtttccgatggaatacttttcgtgaagaagccgaatattgcattgatagctctccagcacttgaacaatgttaaaggtatgatcatcagaaattcttttttcaaaaaacggggcgtcaattttctcagcgatatatgccccgctatgggtgatcagcttggcatcaagctttagcgatttcgctattttctgtgctgagcgaaaatgacggttggtcacaagtgtgacgtaaatcccttttttctttacatattcaatcgcgtctttcgttgcctgatgaatcttcccgttcgaccgaagcagcgctccatctatatttaaggcaagcaattgttttgacacagagatgtccccctccttgatgactgtacttgtgtataggatatgaccctgtctctgtgtttagaacaaccttttcttaaagcaaaaaaagcctggctcagcagactttatgtatggcttgttgataggatacgatcgaagcagccattctccctaatatcgttatttcgatttacgaaaaatcatgtatcaggaaccccttgtttgaccaatgatgcgctccgaacacttactctctgttgcttatcccctctatataacggcatgatatgcgaccgtatccatttgaaataggtaagtgtaggcgctttcaatgttattatctcagttttcctttccgatgacaagggtttttttaactaaaaaagtaaccaacttttgtatatccgtggtaggatcagttgttaatttttaggactatacacttgatccagaacgtacattcccatacaatataaataataaacgaaaaagcggtgtttatatggctgatttaaaagaaatatataatgaagaactgatatctcagttgatccatcatgtaaggtcatcctatcctgattttaacaaaaacagattcttggatacattacggctggaggactggcctgaactcactttaaaagagcggatgcgccgcgtgacagtttctttatacgaaactttgccaaaacaatacgttgaagcgctcacaattttacgggatacagcccctcattttaaaggactcagcggaattttatttccagattatgtggaacagtacgggttagcgcattgggaagaatcaataaaggcattggaatcctttacgcaatattcgacctcagaatttgctgtaaggccttttttgctgttagatcaagaaaagatgattgcacaattgcttgcatggtctgagcataaaaatgaacacgtgagaagacttgcgagcgaaggcagcaggccccgcctgccatggggaaaatcgataccggctttgaaatcggacccttcccccgtattgccgatccttgagaagctgatgcaggacgagtctttatatgtaagaaaaagcgtggccaacaaccttaatgatatatcaaaaacgcatcctcatttactgagaaaagtcgcagatcaatggtacggaacacatccccatacagactggattatcaaacacgcctatcggaccttattaaaaaagggtgataaacaggccttagcgctttttggttatgaaaatgctgattcgatacaactacatgatttaacatgccagcccaaacgtatagttattggcgaaagccttgaattttctttctatattcattcagacagggatcaaaaagtaagaattgagtacgcaattgattttgtaaaagcaagaggccagcgtcatcagaaagtatttaaaataacagaaacaaatatacgaaaaaacgaaacgaagtcatacacaagaatccaatcctttaaggatttaaccaccagaaagcattacaaaggaattcatacattatcagtcatcatcaatggagaggtaaaagattcattggatttccaagtttgctgagtgaataaaaaatcccttcttatccaagaagggattttgcttattagccttcaacactgccgtaaagctcttctaaaggcttcataatgattttgttcaattcaccaatcagcatgctcatgcgctgctccgcttccatcagctgagaaattttttcgtgctgctgtacaagcgcaactgttttttgagcctgcgtcacttcttcttgtgtaatctcttctcctgccatttgtttttgctggagtctaagctgtacatcacggaagttttcgaacatgcgcttcgctgattcatctgcgttaacttcgtcgtaaaggttttttaaacgggtgaattcttcgctcccgcgtaatgcattttccagatcatacgctacatcataaaaattaacagccattgtaaatagctcctttcatcattgccgtttgacataccactccactataacagactatggagctcctttcattaatcaaaaaccatttcttcttaaaaaaggatgacaaacaatgcttgaatcgcgcctataattccgccgagaaggccccccaaataggtaatcattttaaattctttttttgaaatggacagcaccatttcttcaagacgctccaccgggaactgatccacctgctccttgacgatttcctcaagacgcaaccgttttaagacactttcaaggttggacgaaataccttcaagcaatttgtctaatagtgccggcagcatttgctgggtcagctcagattcatagcggacggtaagcgtgccaatcgtattgttgaagaaaggggcagtcgaaaatgcttgcagcactcttcgtttcaaactgaaaatgagcgcctttgcattccatttttcatctgcttcattaaacgtatactccctcagcttgccccattcgttttttaagagatcagaaagcaatttatttgtttcctcattgcgcaagaatttcagcagctccggcagcacgcgatccgcaaggcttgaattgccaagaaacaattgcaccatgcttccaagcatgccgcgctcttttaaaaagtcatcaatcatattgccaagacggatttttccttcatcactttcaaaataacggacactccgtgacaatatatatcctgaaatcatcggaattttttcctcaagcttttcctgcacttctataggcaccagctcttttaacgattggtccccgtattggcggaaaagctcatgcagcttatcatcggtccagctgctgatccatgcatcagcagctttttcggggcgcttcatcccggctttttcaagcgcttcttttactgtcacttcagaaagtgacagcttttgaatcagctgttcccccactcgaagagcctgcgttttggctgcatcagagacgagccgctttttaatgccttcaggggttaagagatgattgactaccatcagtcccatttgttttgcaagttcatctcgccgtcttggaatcagcccgggcgtaaaaggaactcgtttcccaaacaaatagtacgctttatacggcctaaacagcatttgaattgctaaatgattggtcaccgctccaatggcagcgccgatcacgatcataaaaataaaggttcctgcaatacccattcctattcatcttcctccatctgtgcttcagcttttttcatatagattatgtacctatacgtattatagaggctcatgcaatcacttagcaaacgaggagacaaattcctgttcttagaaaatcagcttgttcttttggaatagggcaaggtggagaatcgtattctgtaaagtagaataccgtcagctgcgttcgtcttacatgtatttagtgtaaagctgcggacacccgccggcagcttttgaataaaagggggagtctcaccatgataacactcggttttatgtccttatcccgccagcatgaagcggattattccgcagaactggccaaaagagcacccgaattcggcatacgtttcatccggtttacaccatttgatatttcacctgacactttgcgtgtcaaagcatcggtctatcattcggccagcagcacatggaacgaaactgaaatggcgattccagattatatttatgatcgctgtttttacggcaaggattcacattcccaaaaagcaaaaccaatcgttgagtggctcaaaaaatatccgaaaacggaatttatcgggcggggtcttcccgataagtggaccgtccttcacgatttgcagcagcactctgtaatcaatccctatattcccgaaacgataaaggtgagccgctacgaacaaattcactcctttttatccaaagaaaaagcctgcatccttaaaccggcattcggcgcgggaggcagaggcgtgattcttttgaagctgggcaagaaaaacatcactgctacttatcacatcggaaaggataagcagacaaaaacgttttccaaccagacttcttttaaaacatggtgcaaaaaagtgcttcagcatcaatatttgcttcagccttacttaaacattcaagataaggaacaatacccttgtgatattcgtctgtttatggaaaaaaacgaagcaggtgaatggaatacagtcggaaaggcagtaagacgcggatacaaacacgggctgctggccaatttgtcaggcggatctgatgcgctgacatttgactcctggtttgaagatataccgaaaaaacagcaagtggttttactagatgatgtgttttcaattacccaatcggttccgtattatcttgacgagcgctatgggccgttgtttgaactcggtcttgatatatgtcttgcaaaggacgggagaatttggattttagatatcaattccaaaccaggcaggaagtcaatcctgcgtgtctctcccgagcaaaaagaacagctgtacacttgtcccctaaaacgctgccaatatctgttttctgagcaaagccagaaaggagttcttccgcgtgaatcctaaacggtttttgatcggcatagacaaaaccagtgaaaacaccctgtttctgccctcttcgctgaagcaagacggacttttgcatgccgcattcggaacgaaggttgtcagatgccacgttgcttacagacggcatctggaacaaaccgtgcttctctctgaaaatctgtttcatgagcttttgcttccccaccgaagcagggcagatatactgattcatgatcatacagtgcatatcgggccgttagtcggcatctttacggcagggtttactgtatctcttgaacgcccatttaaggatcgttccctctttttttctaaacttgtcacgttacacgagcaagccgggggctactgcttcgtttttggcgcgcaccaaatcaattgggaggaaggcacgattgaaggcctcctttacagggaaaacggctgggagaaaaaaatcgttccattgccgaacgtcgtttatgaccgtttgccgaaccgaaaaattgaagattcacttctcttgcaacatacaaaaaagaggctgatcgatgaatatcagatcccatggtttaataaaacgtttttcaataaatggaacgttcatcaattgctcgaaaaagatccaagaacggcaccctttttgcctagatccgagctgacaccgtctgtggagctgatagatgagctctgtggcgcatacaaaaaagtctatatcaaaccggcaaatggagcactcggcaccggcatttatcagctgacaagaacagatggcggcctgacggtaaagcatacgaatgacgccaaaacttttacatcaattgattattccgatgccgcctcattccttgcagaatttcaaaaacatcacaacccgtccgactttctcattcagcaaggtgttgatctcatcgaatttcaaggcaaaccagcggatttccgtgtccataccaataaaaacagaaaaggaaaatggacagtgacagcaatcgccgtaaaaatttccggaaagaacagcattacaacacatctttctaacggcggcactgtaaagacacttgcggaagtatacgatgatcccgctgaaagagttgaggtcattaaaaagctttctgcagcggcactgactgcaagccatgtccttcatgatcatatcgagggatttatcggggagattggtttcgattttggcattgatcagaacggtaaagtatggatgtttgaagcgaattcgcgcccgggccgaagcattttttctcatccaaatttgcatcatgttgattctcttacaaaacgaagaagttttgaatacgcgtcatatttatctgagaaggcaatcacatctccggaagcattgtggccttcgtaacctgtccgcttttttaataaagcgggcttatctttatccaaagctgggacaaactgcatatttaggcctcttcaatgatgttctgaaacaatgatacaatgaacataagccgtttttatttaggtcaattgataccaaatgtaaggagcgtggccgtaatgatttctcatttcagctggaaacctttgttcccaaaagaaaagctgcccggatggaaaatttcattttattataaagggacccattatgaaggcatctatcataagagcggtgagattgaatggggagacttgtttcccgcccgcgctgacgagcctgctcttacaaacgagatacatgaactgatgctttttcatatttatgactagcttagcctaaacggctaagctttttttatttctcaagatttaccacacaattctccgcatgattttccggccattttaacataatacgtagtaacaagccggcaaagcattgggttacgccgaggcggcagtgacacccgagaagggttcacagattggtgcaactccagttaacccaaccatactaaataaaaaggagattttacacatggctaaccaaaactcttcaaatgacttactagttcctggcgcagctcaggctatcgatcaaatgaaacttgaaatcgcttctgaattcggcgttaaccttggagcggacacaacttctcgcgctaacggttctgtcggaggagaaatcacaaaacgtttagtatctttcgctcagcagcaaatgggcggcagagttcaataacaattcaatatatggctatagagggcgcggtttccgcgctctctttattttgtcacccttttttcctgctccacatatcctagaaaaaaagggagggaatcggggtgtcattcatcaccattgtgaattgggagctggttcaattcgtaagtgtatccatgattcatgaatatgtttcccatcgttctgtttatttgtacaggtattctttcccgcgctgttcaaactgagaacatccttttataatgaaaggcgaggaggttttttaatgaaaatcgctttattaggagccagcggccgcgtcggacaagcctttttaacacaagctgcagcagatgaaagatttgatattttcgctctgatcagatctcaacatgctgatcttcccctttcaaaagacagaactgtcatggggaacgcccgccgcttagaagatgtgaaaaaaataatggagaatgctgaaatcgtgatcagctgtctaggcacagatggtgatgataccttgtcaactgctatggcacacattctctccgttatggaggaacagcatatcaaacggcttattacgatcggcaccgcagggatcctagattcccgatatgaaccgggaaaataccggtttgaaacaaatgaatcgaaacgaaagcagacccgcgcagccaaggagcatgcaaaagtatacgaaatgcttaaagaatcatcattagactggacaatcatctgccccacttacctcccggacggaacagcaaccggcgtttatcgtacggagcgtaacgttttgcctgagggcggcacaagcatttcggtcggcgatactgcggactttttatatcgtgagctcgttacaggtgagtatgtcggaaaccgtgtcggactggcttattgactacataaaccaaaaacccaaaacacgattgttttgggtttttgagcgttatgcaatggaatgtttctgtcccttttgcagttcatacatttgataatattggccttctaatgccatcagttcctcgtggttccctctctcaacaatttctcctttatcaagaaccaaaatctgatcagcatttctgattgttgaaagccggtgagcgatgacgaaggtggtgcgtccttgtttgacgacatcaagcgccttctggatcacggcctctgtctctgtatcaatatgcgccgttgcctcatctaaaatcaagatcgcgggatcaaacgccaaagctctagcgaaagaaattaactgccgctctccagaggatagcgtgctgcctttttcaatcacgggctcattaatgcccttcggaagcttcttaagaagaggctcagcaccgacttgccgcagtgcattttttatttcttcttcagtcattctttcgtcatccagacttacgttagatccgattgtgcccgagaataagtacgggtcctgaagcacaatacccatatgggatctgagttcctgtcttgacatgttgtaaatgctttttccatcaattaagacatcacctttttgcgcatcataaaaacgaaacagaagattcaaaatcgagctttttcctgatccggtatggccgacgagcgctacggtttcgcctttttgcgcagtaaaggaaatatgctttaatacctcttcaccttcttgatacgcaaatgacacatcacgaaattcaacccgccccagcgcgcgctccttcgccggttcacccgcttcttccgtattcttttcttcaagcagttcaaaaacacgcccggcggagacccttgcaagctccagctttgaaaactgattgacgatgcctgtgatcggctgaaataaccggttcaaataatcgacaaacgcgtacagcacaccgatagaaacaatccccgccgcattcaggctcgcaccgccaaaatgccagatcagacagacgaacgcaagattgcggatgacattgaccagattatgggacattaaggagtttaaattcagcatcctgttttggaaataaaaatgtgattcatttaattcctcaaattctctcattgtttccttttgatggcggaaagcctgaataatggtcatgccttgaattgactcattcatttttgcgttaatgtcactgttgatcgagcggattttttggttgtaatatgacgcatatctccggtatatgaccgaccacagccagataatcggcacaattgccagacatacaaacgcaagcttcacatcaagcagaaacaaagccgtgaatatcccgaacatatagattccgcttgtcacaaatgttgaaagcactgtgacatataaatccctaatagcctccgtatcattggtaatccgcgcaacgacttttccggccggaaggttgtcaaaatagcgaatcggcattttctgtatgtgcgaaaacacgtcctgcctcatcttttgaataatccgattggcgctcatctgcagcagataatgctgtccgtattgaaagaataccgaaaacacaagcaagcccccatacaggcagatcagtaacaccattccctttatttccggctgatagaactggaaaagttcctgcttagtcagcttttcggcagcatatgcccggctcttgtctccgtttgtgatcgtcagcttcccgtcagaaaccgttctattcccgtcgaagctgacagcctgatcaacaaaatagaacgccattcccacttgataaatatgcgcttcttttgcttttgaaacaggctcctgcaatcggtcctctctgacatatgagacgccgtgaaactgaacggcatttttatctttttccgcagcttcataccatgttttctcaatgccgaggatatggtcgtctatcatttttttgccaataaagggcccagtcagttctgcaccgacggcaacagttagcaaaaggacggctgtgatcagcaattttcgataaagaagtgcgtatctccataacgtttttcctattttcatgcccctgctcccccttcttccgcagtgaacagctgctgtctttcatattgttcccggtaccacccattattggccagcagttcttgatgcgtgcctctctcagcaatgacgccgccgtccatcacaaggatcaggtcagcgtgctctaccgcggataatcggtgtgtcaaaataaatgtcgtttttcctttgcggttttctctgatgttcttgataattgcagcctctgttttggcatctacagcggaaagtgaatcatccagaatcaagatttccggattcgccatgagtgctctcgcgatcgaaattctttgtttctgcccgcctgacagtgccacgcctttttcaccgaccattgtctccagaccggacggaagcatgtgcaaatctttttcaaaatgtgcttcggcaatggcttgctgaacctctttatcagttgcatcctgttttccgtataaaatattttcttttacagtccgtgaaaacagtaaatgatcctgaggcacatatccgatccatccgcggagacggtcaagagggatttgctgaatcggtacacctgaaaatgtaatgctcccttcacctggaggatactggcgcaaaagctgcttaataattgtcgtttttccgctcccggttttacctgcaatcccgacagtctgcccttttcgcaccgtaaatgaaatatcctgaagattgtcacttgttgagcttggatatgtaaagctgacatgactgaaaacgatatctccaggctctttaagatcagcgggctgttttggatctgtcacatccgtttcataagaaagagtttcatttacccgatctaatgacgcattgccgcgctgcatcacattaatgagttcaccgattgcaaacatcggccaaatcatcatgccgagataaacgttaaaggacactaactctccaagcgtcagctcgttccggaatacaagaaacgctccgtagccgagcccaatcagatagcttgcgccgacaagcagttttaccgtcggctcaaacagtgaatcaataaaagccactttcatatttttctgataaacatcagcggtcatttcattaaaccggcgaacatcgtttgtttcctgaacatacgcgcgaatcacccgcacgcctgaaacagattccagcactctgtcattcagcgccccgaacgcgttttgggcctcagtaaaccgctcatgaattttacttccatatagactgattgcaatcgccatgactggaagcgggataatggcggcaaaggtcagcttccagctgatcaaaaaccccattgtcaaaaagatcgtcatcataaacatcgtagaatcaactaacgtcaagatgccaaaccctgtggttaaactgacggcctgaagatcatttgtccctcgtgccattaaatcgcctgttcggtttttttcataaaacggcggcgacatagtcagcaaatgccccatcagcttcgtacgaagaattttctccatcagattcgctccgccaaacagctgatgcatccaaaaataagacatgatatacacggccgccgtcagcacaaaaaagataccgatataaaacagcagcccttccgcagtaaatgcccctgctttcatatcatctatggcgttccccaagagcttaggcggaaacatttcaatgacattgactgctaataaaaggacaatcgcaatcgtatagcgcagccagtacgccttaaaaaaccagccaagctttttcaaaactgaaaacatctatccccatctcctcatcagccgccttctattttttccttgcagcttttttcatccagtttggcacgaactgccctcgcctctgtatttgtcttcacatcccatacacctgtctttccttagattttgtatataaaaaaggcatgaagcgtcagctccatgccttttttaaccgatatgttacgcacagcgcttttcagcgcgcggtccgacctaaaaaaccgttcacgaaaacagaacaaaaggtttgccgcgccaatatgaaactgtttgataaacacgcaaattccttggcatagcaaaccctccttccattctgatttcatctttttatcatcatataaacaaaaccttttattgtcaatcattacttgaataggaaaaggttaattgtgctcaaattcgggtagtagtgttgtaagacgctttgaaagggtgagaaggatgttccatgctgaccgtatcattgttgcgtttgacggaagtgaaaatagtaagaaagcgcttctgacagccattgatcttgctaaaaccgtaaatgccgctattaccgtcgcccattcacatgatatgaaagacaatcagaccgtcatcgacccgcccagacccgcagctgaggcaagctatatcagcggaggcatgacaagtgttcctgatccgctgatatcggatgtaacatcacctgagccaatgatctatgaagaccgtacggaagaagtcatcgccgaagccagaatgatgctgaatgaacagcaggcagatggagatatcgatatattagaaggcgatccggctgaatcaattatcgagcatgcaaaccgcatttctgccgatatgatcgtaaccggaagcagagaccaaaacaggctgaaaaagctaatattcggaagtgtaagtgaaaagctttcagcgaaatcggatatacccgtcctgattgtaaagtgagcacgccctgtgctcacttcttttatattcataattgtgaaaaaacatagattttcgtttttttctgttataatgctttcgtgcccaaaagcacaaaagcattaaagataaatatggggtgttattttggattctcaaaaaaagctgacgtttccgttagccgtcggtttatttatattcatgttgtgcattattatttcttgcttattcttgcttcatgtagaacctcatatcccgctgtttttaagtgttgtcatgctttcagcagcagctttatggtttggatttccctggaagagcattgaaaaagggattgtagacgggatcaaaaacggcgtacagccgattattgttctagcgctgatcggcatcttaatcggcgcctggatgtacagcggcgcaataccgactatgacagtttatgccctatcctttattgaaccaagccaccttctgttgactgctttgttttcatgtatgatcatcagcacacttgttggctcaagtctgacaactgtaagcacaatcggagtagcgctgatcggcgtggcgagcgcggctggcgttccgcttgaatggacagcaggcgcagtcatatgcggcgcttgttttggggataaaatgtcgccgatgtcggacacaaccaactttgcagccggaataggcgaaataccaatctttgaacacattcgccatatgatgggcacaaccattccagctttgctcatcactgtcgttctgttttactttctcggttcatcagtgtcagcggacgctgcttcaaccgataatattcagcaggtcataaccggaataaaagatgctgcaaacgtgacaccgtgggcccttctttctccgctcttagtcgttttgctggcaatgaaacgggtatcagtaatccccgttctgactgccggaattatttcctcgggaattttgactgctatttttgtaccctacagcagcctgcaggcgtttatgacagctttacaaaatggcacaactttcgaaactgacaatgaggcagccgctaaaattattaacagaggcggactgcaatccatgatgggctctgtctctctcattatgattgcttttgcactcggcggattgatggagaaaatcggattgatttctgcactattggaaggcgtcatgaaaggcatccgctcaaaaggccgtcttgttgcagcaactgtctgctcaagcatcggcgtcaacttggcaacgggcgaacagtatttatcgatattaataccgggacaatcatttaaatctttatatgacaaacgaaacatccagcgaaaatttctgacaagatcattagaggacggcggaacattaattaacccattgattccttggggcgtcagcggcgcatttatggcgagcgcacttggtgttccagtcatagactacatcccatttacgttcttcctctatatatcgccaatgatctccattttgattggatttgttaaaaaataaaaagagccccgctgtaaaaagcgggctcttttcttcgttcatttatgaaatgctagcagcctgttgaatgctttcttgaaaagcagcctgaagctgtttggtcaccggtccgggtttcccgcttccgatcgattgtccatcgagcgtcacgaccggaataatttctgccgtcgttgacgaaataaagatctcttccgcctgtttcaactcttcttcactgacaggagtctcatccagtttgatcccattcttctcaatcagtcctaaaatattcatccgtgtaattccattgagaatgagccgattagccggatgtgttcgcactgtgccgttgataacggcataaacgttagaggatgtaccctccgtaacaacgccgtccctaagtaaaatggcttcaaatgctccggcttcataggccctttgcttcgtcatgacattatacagtaaattcagacttttgatatcacatcttaaccagcgaagatcctcatctgtaatggccgccactccgtatgcctgctcttgctccggttttttcaccgtaaacgtataggcagtagtctgcggctcgaggccggcttcatactggtgttttcgcggggccacacctcttgttgtctgaatgtataccgctccctcactgaccgcattttcctgtacaagcttttgcaggtcccactcgagatcttctatactgaatggcagtgaaattccgatttcagcagcacttctgaaaaaacgctctgcatgctcacgtaagccgaacaatactcctttgtacaccctgatcacttcatagatgccgtcaccaaactgataaccgcgatcttccaaatcgattgatgcttcactgcgcccaatcagccggccattgactaaaaccttcataaaagccctcccttttcgagatgtccctgatgtcattcaagctgtcattatcactaattctaccatattggacaagctgaaaaacagaaagatcaagagatctatagcggaaaggagtttattttttccttaaaatctgacatttcgacaaattttctatgtgctttccagttttattcctgtatacttgactggtaatacataggttgtaaacataaggcatcttcataagctgcctgctgtacagcattatgtagagattttatgccaatggagagattgttatgcgacaaacgagaggagaggcttctccttctgcagtttcgcttgcttttaaatttgcaagtttagcagttttatgtgtgctgcttttgcttatggtgattttgggttattccaacagttcaacgaaagcaaaggaagtcactgtcacaacaaacggccagcttcgagatgagaaggaaagccttaagctgaaaaacgactcccccgatctcctgataaaacatctgcagacaaagcagaacatgggagataaaacggtttacttaaccttcgacgacggcccttcagccgttacaacccgcttgctcgacgtactgaaaagcgctgatgtaaaagcgacgttttttatgctgtcaccgcggatgaacgaattcaagcaggctgtgaaaagagcagaaaaggaaggccacgcactcggtttacatggcgttacccacaataacagattgttctatcaaacaccgacatctccgctaaaagaaatgcaggaggcgcgtgacacgctgcaggacattacaggatataaaaccgatcttgtcagaacgccatacggaagcaagccgtcactaaccgcctcacaaattcgcaatctggagaaagatgggtttgtgtactgggattggacgatcgacagcatggactggaaataccggaattcacagtatgtgaccgccgtattacagcagcttgagaatatggaacacagctcttcaagccgcccaaatgtaattctcatgcatgatcttcctgctactgtaaatgcgctgccggtactaatcaataaattaaaagaaaaaggctattccttcggagtgttagaggacacaatggttcctgttcatgaataaaaaagtgaggcgcataaagcggctcactttttcatgcccaaacttcgggcaaactcgccgattttttgatggatgaccatgtcaaacaagctgtcgcaatacgttggttcaaggtttatgatgactttcttcatgccgggaatcaggcttgcatcctcaggcacaaatctagccggagccacttcgagagacgtgccgataaccaataaaagatctgcttgatccagcttttcataaagggtgtcaaagtgcatgacggcatcgccaaagagaacaacatcggtttttaataccgttccgcaaatgtccccattgtttccggccgccgtgcactccggcacctcccgctccagcaaatggggaagatcatatcgggcgccgcatgccggacaagctgctgtctggatagaaccatgcagttcgtacacatgcctgctccccgcttttttatgaagaccgtcaatgttttgcgtgaaaatatcgacctgcttcccttgcttctccagctcagctaaaagcaaatggccttcattcggttcaaagctgccgctcattttcatctggaacaattctttgaatttgggccaaaacagacgcggataacttaaaaaataatcaaggctcatcgcttccattcttgaggcatcctccgtccaaatgccccctgctgaacgaaagtcggggatccctgattctgtgctcattcccgctccggtcagcacaacaattctctgtgcttcatgtagaatacttttgaatgtttccaactcaacaccgcctttttctcttattttaccatgaaaaagactccgcctctgtcagacgaagtctctcttttaagcccgttccttttcctctttatttagattcacctggaattggtcgctttcgtgcttttgcttgacaacaaccatttggccgggatatgcaaactgaacgccttctgcacctaaaatctcaataattttatagttgatatcctctctaatattaaggttttcagcccaaaccgtcgtttttgtatagaagttaaaaataaattgtagtagctgtcggcaaacgtatcaaagttgaccatgattatttcattatcaacgccctcatgctctaagagcattgttctgagagaatgaatggagcgttcaaggttctcaatcggcgtagcgtaggacacatggatggaaaacgtaatctggcgtttggtcattcttgtccagttcgtgatcgcttccatcgacagcgtagagttcggcaccgttacaagcgccccctgtgctgttctgaatctcgtgctcctaaaggtaatatcctcgactgatcctgttactgtcgacgtctccacccagtcaccaattgtaaacggcttttcagtaataatgataataccgccgaagaagttgctgatggtatccttcgcggcaagcgcaaaagccagtccgccaagaccaaggcccgctacaaatccgttgacatcataattgaattcctgagcgatcacactgacactgagcgcaatgatcacaaaacggagcaatttggataaaaacggggccagaatgtcatccatgtcaagctcgaagcgctggttcaccttatggaagataaacgacgatgttgcggtcaaattacaaagaccccaacacaagagcgccacaatcagtgagcggtatattttgctgatgaccggcatttgctcatctaaaaacggtgaataccggatcgctaaaaacagcccaagggcaacaaaaaaccatctggccggcttatcaaacgccagaaccacctgtttaaaaatttctgttttcggccggtttgtcaaattaaaaagcaggttaaaaaaatatcttgtgaataattttctaagtataagaaacaccagcaaaatcgccaagctgatgccgatttgtatgatgttatcaagcgtaaaatactgctgcagataatccggcatgactgtctcccctctatcccaatcaattgtttattatactaaaatattcgtaaggatgttcatttaaatgtcttatgcagcacaaaaccccggcgaaacgccggggtcatttctcaattcatctatcagccagattcaatagggacagtcacttaccttttttcgtttgtgtctgatcaaggagagttgctttttgcatttcagcatccgtttcggctttaattctttcctccactctgattctcccttttcccatgatctcgcctccttttttgctattataaaggatcatattttgttgtgaacatgtcgaaagacctaattttctgacgaaatgtgttctgatacgctgagtgtctttttttagttatacgcattcctcagcccggaccattccgatatggcagaaaaaattcaccagtttgtatcgcggtgcatatatggatttgatacaataacagaaatgcccatacgaggagctgacttagcttgtacatcattgcccatcgcggagcatccggctacgctccggaaaatacgattgccgcatttgaccttgcggtgaaaatgaatgcagatatgatcgaactggatgtccagcttacaaaagacaggcagattgttgtgatacacgatgacagggttgaccgaacaacaaacggatcgggctttgttaaggattttaccttggaggaattgcaaaaactcgatgcaggaagctggtacggtcccgcttttcaaggagagcgtattccaaccctggaagcggtgctcaagcgctaccacaaaaaaatcggccttttaattgaactaaaaggccatccgtctcaagtcggaattgaagaagaggtgggacagctattagggcaattttctttttctatcaataatattgttcaatcctttcagttccgctccgtccaaaggttccgcgagctttatccttcgattccgacagcggtcattacaaggcccaactttggcatgctgtccagaaatcagatgaaggccttccgctcttttgcaaactatgtcaatataaaacacacacggcttaaccgtctgatgatcggctccatcaataaaaatggcttaaacatatttgcatggactgtcaacaatcaaaagacagcggcaaaattacaagccatgggcgtggacggcatcgttacagattacccggatttcatcataaaggatggcaaacatgaaaatatatagcgcggtttttatcggaggcgcgcttggcgcctgcctccgatacggattaaacttatggatacacaccggtcagttcccggcggcaacctggctggaaaatgcggcaggcagccttctattaggcattttgaccggattttttatgatcggggcaaaacggcctctgctgtcggcttttttaggcaccggcttttgcggaggcttcacaacaatgtccacgttttctaaggaaacagtgatgcttttgcaaggacaaccctcattggctcttttatatgtggcagcctcattgatatcagggatcatatttgcactgattggtgtttttgtgggacggcgcatagcaggcattcagcaaagaaaggggctgcaggaaaaatgacactagcgggtattttcatagggggcggacttggcgcaatgcttcgcttctggcttggcaatgtcataaccgccaaaaccaaaggtctcagcctgcccattggcatactgacagtcaatattctcggagctctcgggctcggaatatttacaggacttcacgttgcaaatgcttcggtctcgcttatcattggcacggggttttttggcgcctttacgaccttttccacattcagcgttgaaactattcaactccttatggccaaacgtgtaaaagaaagcatcttgtacatcgtcctgacactttgcgggtcgctttttgcattttggtgcggctggacaatcacaatataaaaaaaccttgagcttatttctcgctcaaggttgcactgttcagcatcacaggctcgggcagcggcagcttgtggtgcgccgtaatcccggttgtgttgccggcttcttcttttatatcgatttgcttgattaatcggccgtccatcttcagcacctttatcgtatatgaaccgatgcgaatggattcaccagcctcaatatcgatgttttcttttaatatcagcccgccgatcgtatcgacgtcttcttgaatcgatgcgccaagaaggctgttcacctgatcgatccgaacctttccatccatcacataatggccgtcgccaagcttttggatcagcggctgttcatcttcatcaaattcatctcggatctctccgacaatttcctcaagaatatcctctgtcgtcacaagtcccgaggttcctccgtattcatccgacaatatagccatatgaatgcgctcgcgctgcattttaatcagcaagtcatgaaccgggatcgtttcaatcacttcgatgaccggcctcacatacggatggatcgtcatcttcattcgttcttcttctgtcataaacagcaaatcagaaaacaaatgcttcgtattgaccaaaccgagcacactgtctttgtctccatctgtgactggccagcgcgtgtatttttccttcagcatgacttcaagcatctcggccatcgtcatctcagttgacacagcagccatttccttccgcggtatcataatttctttggcgatccgattatcaaattcaaaaatcttattcacatatttatattcagacggattaatctctccgttttttaaactctcagataacagcatcctgagttcttcctcagaatgggaaccatcatgttctgacgcaggcttcaaaccgaacatcccgcataaaagccgcgccgatccattgaggatccaaataaacggaaacaggagcaaatagaataaacgcaaagggcccgctatcagtaaagtcagctgttctgccttttgaatcgcgaccgttttcggggccagttcacctacaacaacgtgcaggaacgtgatcaagccgtacgcgactgcaaaagagactgcatgtgaaaccgagtccggcaagccgagcggttcaaacagtggatgcagcagccgttcaaaggccggctcacccagtacgccaagcccgattgatgtcaatgtaatgcctagctgggatgcggataaatattcatccaaatctgtaatgacacgccttgcgagtatcgcccgtttgtttccttctgtgataagctgatctattctggatctcctcactctaacaatcgcaaactcgcttgcaacgaaaaacgcggttaaagcaatgagcacgccaattaaaatcagactgtcaatatcgtccatttaaccctatcctctcaacaaaggataaggagtcacctcctgatataatcatttttccttaacattgaggtacgcggtgtattgttgcctaagcagagggccccatcataccacctccaaaagtcaaagtttgattataaattgtatattttattgtaacacaactcattccaaaaatgatttttaatttttagacttttatcatgaagaaagccttaactgcatgcctgcttgtcaattctgcgcctgtctggattggaagaggaaggattttgcggatataaaaagaaaacagccttgaaaactgttttcttttctttgccttcttaagcaaaatctttatataaagaaatgaaaatgtcccgtgagtttttaatctgctcgatcggcacactgaaggataatcggaaatgcccgctcattccaaaaccgctgctcggcacaattaataatttgtatttttgggcggcatgcacgcaaaatgcaacttcatcttcaatcggcgatttcggaaaaacaaagaaacctccctttggcatttcaaattcaaaaccggcttcttttaaaatgtctaccattaaatcccggcgctctttataagcgctcgcgtctactcttaaatcatccattcgtgccacagcccgctgcatcatgacaggggcattcacaaatccaagcgttcgattacaatacacaaaagcgttgatcaaaaggtccgcatccggcattcggctgtccaatccgatatacccgagccgctctccggctatgccgagatctttactgaatgagctggccaatatcacacgatggtacgattgaaacggatttgccagctcttcatcatagattaattgactgtacggttcatcaaacagcacataaatcgtctggccgctcttctcttctatttcttttaataaagcgcctaaatcgtctatatttttctggctgagaacagtgcctgtggggttatgcggtgtattgagaatcagccctttcgtctgtggagtgatcgattgccttaccgcttcaatgtcgatctcaaaccggcttgtcaacgggcagctgacggcttttcccccgtagttctcaatatacaacttatattcggcaaaataaggtgcaagaataatgacctcttccccagggtttacgatgctttttaacgcaacattcaaagcgcctcccgcgcccaccgtcatgacgatgcgctccgctgagaaatcagcttcaaaacgcgagcccagaaattgcgcgactttttctctcgctgcaagaagcccttggttttgtatgtatccgtggctgcctttttcagcttcctctattaacgctctcttaaaagcttcaggcggttcaacaatcgggttgccgagtgaaaaatcaaatacctggtcttccccgaactccttcttcagccttgcaccttcatcaaacagcttgcgaatccatgatcctttatttaagttttcttcaacttcccgggataacccagccaatttcatctgtcccttccgcatataaaaatttgaaaattctatcttcctatgttacttcaatcagatgatgaattccacaacttccaattccggtctaaaaaaaacaataaacttgtgcaagacaccgttcatatattaaactattctcataactataacgtgatggttgggagggatatagatggggctgagacttatcgcatcagtgaactagcggcactcgccggagtaacgaaacggacagttgattattatacgaatctcggtctgcttacgccggccagatcctgttcaaattaccgttactacgacgaaaatgcactcaaacgacttatatttattgtagattgcaagaagcagcgattggccctgtccgatattaaagatcgactggagaaccagtttccctcttcagctaaacttgatgatgaaattggaaatctggcattagaaattgatcatatgaatcaaaacatctccggaatcttgcatcggtttgaacggctgaagcccgaggatcgtgacaagctgaaaagcaaactcccgcctgaaaagctcgccgtgttccaatcatttatgctgctgttaagttaaaaccattttatctaacaggaggtgttaccttcattctcattgctagagtgaaggttctaattggacatagtgaatttgattttagttgctgttttaatcgccctgacggcatttttcgtggcatctgagtttgccattatcagaatcagaggctcacggatcgatcagctgatcgcggaaggaaataaagcagcaatagccgtaaaaaaagtgaccacgcatcttgatgaatatttatctgcgtgtcagctcggaattacattgacttccatcggattaggggttttaggtgaatcaacgatcgaaaggctgcttcacccgcttttcgtccaaatgaacgttccaggttccctttcacatgtcatatcgtttatttttgcgtatgccattatcacgttcttacacgttgttgtcggagaacttgcacctaaaacagtcgctatccaaaaggcggaagcagtgtctatgctgtttgcgaaaccgctgatttggttttaccgcatcgcgttcccattcatttggcttttgaacaattccgcacggttattgaccaaagcatttggcctggagaccgtttcagaaaacgaactggctcactcagaagaagagctgcgaatcattttgtctgaaagctataaaagcggtgaaatcaaccaatcagagtttaaatatgtgaataaaatctttgaatttgacgacaggctcgcgaaagaaattatgattccgcggaccgaaattgtcagccttccgcatgatatcaagatttctgaaatgatggacatcattcagattgaaaaatatacccgctaccctgtggaagagggcgataaagataacattatcggggttattaacattaaagaagtgctgaccgcctgcatcagcggtgaggtatctgttgattccaccatttctcaattcgtcaaccctatcattcatgtcattgaatctgcgccgatccaagacctgcttgtcaaaatgcaaaaagagagggtccacatggccattttgtctgatgaatacggcggtactgccgggcttgtgacggttgaggacatcattgaggaaattgtcggtgaaatccgcgacgaatttgatattgatgaaattagcgaaatccgcaaaatcggcgaaggccattatattcttgacggaaaagtgttaattgaccaagtaaacgacctgctaggcatccatttagagaacgaagaagtcgatacaatcggcggctggttccttactcaaaaatacgatgttgaaaaagatgattccatcatcgaagagggctgcgaattcatcattaatgaaattgacggccaccacgtcgcatatattgaagtgaaaaagcttcaagaagaagaacttctggagacagctaaccagcaggaagcataataagaaaagcaccttgtatagggtgcttttcttattttcacagtttcaggacaatctctcagaacgccttatagctgatcaagtttattctctagttctttaatccgctgattcaaagcctctgtcattgctgcaagtctttcctttgaaggcaggtgggcaaaatcagcctggtgaagaggctcaccgataatcagcttcatttttccttttttgaataattcttttccgcttgaagggccctgatatgcagcggggacaagcggcgctttccccatttgcgcaatcgtcaccgcacctcttttcaaaggcacatcctcagaggttcttgttccgcttgggaagataccgacgatctctccttctttcagcagcttaatcggcgttttaatactgcttggcccgggattttcccgatctaccggaaaggcatgaattttcttcagaaacgaaccgatccatttattttgaaaaagctcttttttcgccatgtagtgtatttgataaggaagaatcccgactccgagtgtaatcacatcaacccagccggaatgtgtacacgcgatgacaaaacctgaatcggccggaaggttttctttgttatacaccttcactcctccgcgaagagaaagaataacttttaaagcatttgcacaaaacttatacatatcgcacttcctttgtcgtaatcaatgattctttctgtcatctattataacaatattttttattacctggtactaatttttaagatttctctcgtttaaacgccaaaaagctgaggattcgccctcagcttttgttatatttcctctctggtcggcggggccataaactccggtccgacagggtctgatatcgtattttccaatatagtattgatatctttctgatcttcactgttcagcgtccagcctgtaatctcagatagggcctcaagctgcccaggctttcttgctccccaaagagcgatatccgctcccggctgatctaagatccatctgacagccaagtgaatcactgattttccataacgtgtcttcgccagcttatccaattgattcacagcagaaagatactctttaaagcggggcttctggaattttggatcgtgattacgcagatcatcgccctcaaatgtatattcttcagtcattttgcctgttaacagccctctgcataaactgccgtataataatgttgttatcttgttatctttcgcataaggaaggacactctcttccatctctctttcaaacagattatatggaggctgaatcgtatggagaggtgcgacggcgcgaaatgtatccatttgctcaattgaaaaattgctgacgccaatcgcccggatttttcccgcatcatataattccttcatgacttcagccgtttcttcaattggcacaagcggatcgggccaatgcacctgataaagatcaatatagtctgtttgaagccgcttcaaagaattctcaacttcctctacaattctcgctctgttcgcatggcggaacagctggttgttcttccagtccagagccgttttcgttgcgagaatcacctggtctcttttgccgtactctttgattgcctttccgacaatttcctcggactgcccgaagccgtaagccggtgcggtgtcaatcagtgtaatcccctgatcaagagcggcgcggattgtttcaatcgatgttttttcgtcagtgcctccccacatcgttccgccaatggcccatgtgccgaggccgattctggaggcttctattcctgtatctgctatactggtatattccattgtgccactccttcactttttcactatcttttcccctctggaaaaaatgttaaacctttctccgcactatcttttgcggccatttttgggtactatatagtaatggtgtttgattaggtataaaaaagccgtttgcatgtaatgtgcaactttaaacctttcttatgcgtgtataacatagaggggagaaaaggcagtgacgatcgatgaaatttaccaaatgtacatgaatgatgtttacaggttcctgctctccatgacaaaagacaagcatcttgctgaagacttactgcaggaaacctttatgcgggcatacatacacattcactcctatgatcacagcaaagtaaagccctggctttttcaagtggcgcgaaacgccttcattgattacgtcagaaagcataagaaagaagtaaccatttctgatgacttaatcggaagcctctttcaaaatgctgttcaaagtcctgcccatcaggtagagataaaggaagtgctgactggttatatgtccgagctccccgataattatcgggaggccttaacgctatattatttaaaagagttaaactacaaagaagcatcccatattatgaatatttcagaggcgaattttaaaagtgttttatttcgtgccagacagcggctgaaagcactttataatagaggtgttaatgatgaatgaagaatttaaaaagcgttttgatcaatataaaaatggggaaatgagcgaccaggaaatgactgcatttgaggaagaactcgagaagcttgaagtatatcaggaactgattgacagcgaactagaggacgataacgattgggatctcagcatcagtcctgaaaaacaaaaagcgattttagcctacggcaaacgcaagtcttatttgcgaatttctgtgcttgccgtcatttcgacattgatgattttgccgctttgtacgctgggaagctacctctattacggaatgggtggaaaacacagcaccggcaatgagttcatggaaactgccgcagtcactgtagccctgaccatgccgaatgttcttgttgatacttccggactgaaaagccaagtgaagctatttggaatgaatacggaattcccgctgcaaaagcagattggcacgaagacggctgccgtagggaatgaacgggttgaaatgttttataacaaagtaaaagcgccggcagtaaactactatgacttagaagtgaataaaaccggccattactttacacatccttcaaacaagtctgaacaaacgaccgcaaaagcagaaaaaacgttaagcacattgcctgaaggaacggtatcagaggtctacctttcatatgaccgtgcatatccgacaaaagacgtgtataacaaattcaaaggctatgatgtgagctttttgtggaacgcaatcgaaacagagaaaaacacaaataagacagcttccacagaacctcttggctatcctggaaaggattcaaagttcttggccgcccttaatacaaaaggcaagtcgaatggcgatcagtttatcaacgccctgaaattcatgtccaaacacgaaaaatgggctcaggtcatttcaaaacggaaagacctgaatgtagataaccgattagattatgtagagaaaaacggtgtcaatgtatacggttcggtcgttacagggccaaccaaggaaatccagcgcatgctgaaaaataaatctgtaaaatcagcgaatgtcggcgaggtggaattatggaactggtaagaatttttaaagaacacaatgtattcggctggatctctgtcgggacagcggttctgtccctgctgttgctgaatttggccattatcagcaacgtcacgttttattcctatcaaatgcttccgttcgccatggctgccgttccgttcggcgttgttgaactcttcatcaagagagggcgcacaggtccaggcctgctcggcgtcatccttaatctctttgtgattatttgtgtgtataccattgtatctgtagatacgaatttacagtttggcttttaaaaaagacgccttttcaggcgtcttttttcgttataccggttttcggaacaaataactttctatagtaaaacccattttatctgtataaaatcgatgtgcgtctttacgctgaaggccagatgaaagactgacaaaaccgagtccggcttttctcgcccagtctgaggcataatccaaaagcattttgccgtatccctttgatcggcaaggtgccgttgtaacaagatccgcaatccacaagtgctctcctttatgaatggaaactctcggcagagccccgcacagcgctctgattgctgtattttcatataaggcaaacagcatatacgattctttctgcacacaggcttcaagcctttgtaaatacgtctctatatccagttctgttctcaattcactcataatcggatacgactcagcccattcttctttcgaggttaattgtttcatatggatcatcttctcaatcccctttcctttcgttacaatgatcatagctaataaatggcatttgccaaatagccaatatcagaaaaaatgaccatgccagctacaaaggagacatgagatggatattacgccgtttcttgataaaaagagcaaaacaccgctgtatgaacagctttatacctttttttaaacaagaaatttcacatgcgcgaatcacaaagggaacaagacttccgtcaaaacgcaggctctccagcttgctcgatgtcagcacggcaactatagaacgagcttatgagcaattaactgctgagggctatgtcaaaagcaagccgaaaatcggctggttcgcggcggaagtagaaccaggattcccgacagctcctgaccattttcagcagtctgtacagccgggattacatcaaaaaaacgcacctgctattgacttccatcagggcagcgttgatccgaccctctttccctttaacgcatggagaaaaagcatagtaaaaagtcttgatcgctattccggatcgtttcacacctctggcgaccctcaaggagaatacgaactcaggcacatgattgcccgattcgtcaggctgtctcggggagtaaattgtgaacccggccagattatcatcggcgcaggaaccaccgtgcttctgcaaaatctttgcctttcgctaaagccaggtacaaaaatcggctttgaagaaccgggctttcaccgttcaagaaggatgtttgaagcaaatcacatggatgtcactccgatttgttctgatgcagaaggcgtcctgccggatgagctctaccgtcagaatccttatctcatgtatacgactccttcgcatcagtttccgattgggaccattatgacgattacccgcagacaggagctgctggcatgggcggcagaaacaaattcattcattatagaagatgattacgatggagaatttcgctacagcggccatcccattccgtctttacagggtcttgatccgaatggcagagtcatatatctgggcactttttcaaagtcacttctgccttccttgcggctcagcttcatgattgtgccccctgaactcatggaaccgatccaaaacaatgttcagttaatgaagcagaccgtttctgcccactcgcaattggcactggcagacttcatcgaaaccggagagtggcaaaaacacataaatagaatgagaagcttataccgaaaaaaacacgctgtcctgttagaagccattcgctctgaactgggaaacaccgttgagattctcggtaagaactcggggcttcacattctgctgcgccttttgtttccagcaagtgaggaagaagcaatacaagcagccgctgaccacggtgtaaccctctatcccgtgtctccctcatatatagaacagacgccttttacttctgtcttaatcggttatggcggtttgtcagaagaggacatcaggctcggcatccaaaaactgaaaacggcatgggcaccgttgatatcatcttattaaataaaaaacaggccccggaaacggagcctgttttttaaaatgataaaattccgattaaatttaagaacacgataataatggcaagcggcacgataaaacgaagcaaataaaaccatgtgtaaaagaatgctttacctgcatttgatccatttcgcatttcagccaagagttcgcttttcgaaattttcagcgggataaatagagaaattaacagagcgcctgaaggcatcaaaacattgctgacggtaaaatcggcaatatcaaaaaacgttttgccaaataggtgcacatcactcaaaacgccataagacaagcagcatgggattccgaccaaaaagatcaaaagcccgctcgtccatgacagtttttttctcttcttttcgtccccttttccgattgtggcaacgataatttcaaccatcgaaaatgctgaggttaaggctgcaaataaaaatgcaacgagaaagccgataaaaaacaatgtgccgaacggaagctgttcaaaaacggccggaagcactgtaaacagcaatgtcggtccttcatttggctgaaaaccgaatgagaaaaccgccggaaaaatagccaaacctgccaagagtgtcacaatgatattcatcaagacaatggaggctgccgaacgagggatattttgtgttttcggcaaataggagctgtaggtcaccatcaccgaaacccccagtgttaacgtaaagaaggcctgtcccagcgcgaataatatggattccggagtcagatcgccgaaatgaggcacaagcagaaactttacgccttccattgcaccattaagcgtaagagaccgaagaacgagcagaataaacaataaaaacaaaatcggcatcatcaccgcgcttacccgttcaatccctttttgaacccctcttgcgacaacgagtacagtcagtgccataaagacaagctgagccgcgagcgtctgcaccggattttggataatagaagcaaaaagagcgccatactgtgcttgagaaagcccggacagtgatcctgacgctgttttcacgatatacagcaaaatccatcccccgattacactgtaaaacgacagcactaagaaacacgccgctacgccgatccaccccgtaagaaaccaagctgatcgcggcgcttcttttttatatgcatcaatggcattcgtctggttccgtcttccaaaaataaattcccccaccaaaagcggatagcctaagaggatggtaaataacacgaagataagaaaaaaggctcctcccccattggtccccgctacgtaagggaacttccaaatcgcgcccaagccgatagccgagccggccgctgccatgacgaaaccaattttcgaagcccattggactggtttttgctcagacaataaacgtcacttcctttccagcctatattatctcttatttttgtcttcatttctatagattcatttgccaagaacagaaaagaggcggcctgtatggccgctctctttatcaaaaggttattgatttaattttgaatgctttcttgaatacaggaaatagattaccaagccgattaacagccacactaggaagcggacaatcgtcacccatcccagatttaaaatcaagaacaggcagaacagaatcgccaggcctgggatcacgggaactcccgggcatttaaaagctctcggaagatcaggctgtttctttctcaaaacgataactgccacagaaatcaggacaaatgccgacaacgtcccgatgttcaccagctttgcaagttcatccagcggaacaagtgagccgagaagcgccgacatcgttccgaaaaaccaagtggctacataaggtgttttgtgctttggatgcactttagaaagtgaacccggcacaagtccgtcacgcgacatggcaaacatgacgcgggtctgcccgtaaagcatcacgagcataactgttgtcattcccaacacggcgccaatatcaatgatgcctgccacccaattttgccctgcgctttgaagaacaagagaaaccggatgatccacacccgcaaattgagcaaacgggataaccccagtcatgatggctgatacggtgacatataaaatcgtgcagaccagtaaagagaaaataatgcctttaggcagatccttcgcgggatttttcgtttcttccgcagcagaggatacagcgtcaaatccgataaaagcaaagaatacgagcgccgctgcactgaacacgccgccaaagcccattggcataaacggctgccagttgtgcggcttcacgtaaacggctgccaccgcgataaacagcagaacaaccagtatcttcaagataaccatgatattgttgactctttttgattctttgatgcctaaataaagcaaatatgtgatcgccattacaatgacgaatgcaggaagattaaacagggtaaaggtgcctttcactgcgcccggtgccgctgttaaagcaaccggaagatgaatgccaagccctgataaaaacgattggaaataaccagaccagccgaccgacactgcacttaccgccagcatgtattctaaaattaaatcccacccgataataaaggccataagctctcccaatgtcgcataagtgaatgtatacaccgaacctgaaacaggcacacttgacgcaaattccgcgtaagacagggcggcgaataaacaagccaacgccgccacaacaaatgaaatcgtcagcccgggaccggccgtgactgcgcctgttcccgtcagaacaaaaatccctgtgccaataatggcgccgattccaagcaacgttaaatcaaatgcccctaattctctttttaaagacttttccccgctcgtcgcagcgattaaatcctgaatgcttttcttcctaaaaacgctccctttcattccccttcaactcccgatcatctatttttatatattttatttgaattttctgaattcatgagtaacaatggtcattattcttttttttctactatatttgtactggtcgcgaatcattcctttctcctactcaatattatatataaaattgcaaaaatgaaaacaaaattgttagaaaaatcgacaaattttttattttgaaatttttcaccacacaaaaaaccagctcttgagctggtttttcgttgattacgttgaaataaaacggccgccattcacatgaatggtctgccctgtcatataggaagattcgtcagacgccagcagaacataggcgcctgcatgctcaaccggctgtcccggtcttcccattggggtatccaagccgtgctgtttcactttttcctcagggaatgtcgccggaataagcggtgtccaaatcggaccgggcgccaccgcattcactctgatgcctttatctgcaagcgacttcgccatggaacgcgtaaaggaaacaatcgcaccctttgtgctggaataatcaattaacgccgtatccccttcataagcggtaatcgatgtcgtattaataatggcacacccctcttgcaggtgaggcaaagctttcttcgtcatatgaaacatggaaaaaatatttgtgcgaaaggttttttccagctgttctgttgaaatattgagaatgctgtcctggggatgctgttcagcggcgttgttcactaagatatcgagtttaccaaaatggtccactgtttgctgcacagcttgttcacaatggttctcgtccccaacatctcccgggataagcaggcagcggacattctccttttcgatccgtttgcgtgtttcctctgcgtccgaatgctcgtctaagtatagaatggagatatcagccccctctttagcaaaggcaatagctgctgctctccctattccgctgtcgcctccagtaatgatcgcaacttttcctttcagttttccgcttcctcgataatcctcgtcctctgacagcggcagcggattcatttttgactcaatgcccggctgtctgtcctgatgctgcggttcttgtccttctgtttgtctgtccattgggttcacattcatcactcctagacatgtggttgatactgaacgttaccacacgacagaaatgaataaacgccaaaatatgttatgaaagaacttcctcgggaatggcaccggtatattgcgctgacgggcggaaaatcatgttgttttctgcctgttccagtacatgggcgcaccaccctaccattcggcttgctgaaaaggtcggagtaaacaattcatcgtcaaaatcgatggccctcatcactgcagctgcgtaaaattcaacatttgtgtacagctttcgtcccggtttgtagatttctagcaaacgaatcgcttctgcttctacatgcagcgcaagatcaagatcacggtcattgccggccacctcttctgctttctgtctcaaagcttctgcccgcgggtcttttgttttgtacaccctgtggccgaatcccatcaagcgctctcctttttcgagtttttctttcagatatgcttcagcatgttccttttctccaatgtcttcaagcatttttgtcaccgcagaaggagcacctccgtgcagcggacctttcatcgtaccgagagcagccgtgacggctgacactaaatcactctctgtagataacgtgactcgtgccgaaaaagtcgatgcgttcatgccgtgctccgtggccagaatcatataggtttcaagcgctttcttttttgcctctgaaggctgttcacctgtgagcatataatagtagttttcgacatgtccgtactgggaagaaggtgcaattgcttgttcaccgcgcgtccatctttttctgtatgcaatgatagaaggcgtgattgcaatcagccggattgcttcctctgttttcggatggaatgtgtacgtattttcccccaatgctgaaacaaccgttctcagcaccgacatatcgtccatgttgtttggcagtgattgaatcaagcgctcaatatgttccggaagattccgttccgcagccagcttatctttaaatacctgcaattcttcagttgaaggcagttttccaaataaaatcaaataagccgcttcttcaaagctgtgattcagtgcgatgtcttttgcatgatgtcctctgtaaatcagacgccctttttcaccatcaatatggctgatggatgtttctacacatgtaattccctttaatccgtaatgtaccatttgtattccccctatccttttctgttattatagtaaatataatatttaaaaaataatcaatattttaaagggaattaattaaaaatattaatcagagggagaatagaaatggatttcaaatggcttcacacctttgtgaccgctgcaaaatatgagaacttccgaaaaacggcggaaacgcttttcttatctcagcctactgtgaccgtacatatcaagcaattagaaaaagaaatcagctgcaagctgttcgagcgtaaaggcaggcaaatccagctgactgatgaaggcagggcgtatttgccgtatgcgctcaggcttcttgatgattatgaaaacagcatggcagagcttcacagagtgagacaaggctactctcaaaccttacagctcgcggtttctccgcttattgcagatacagtgcttccttctgtcatgaagcggtacacagcaatgaatacggaaacagaaatggcggttacgattttcgaatcagcggaaatcgcgtcactgattaaagccggggaagcagatatcggactaagctgtttaaaggtacagtcttcttctttaagctgccactgcttatacaaagaccctgtcgtccttgttgccccgcccgataagcgtttcatagaagacaacgaaattgatgccaaagaggtgctcgaacaatacctgcttttgacccacaatcatcctgattactgggacgacttgctccgtcaagtcagaatgacatttccatttgtgagaacaatgaaggtcactcaaacacatataacgaaacggtttatcaaggaaggactcggagtttcatttctgcctttatctacagtaaagcgtgagttagcagagaaacagatgatcagaattccttatcagtctgtacagctgccctatgccggcgcttacgcgattgccctttatgaaaataagaaagaaaaaaagttcttggattttttatcacattttcatttttaggagcaaccaaaacgcctgtgctccgtctaatgaaaaaaacccgttccaatgaacgggttttctctaaaaattagaatcttttcgcaccgaggtaacgaggcttccagtagctgttgttcaggctgctgatttgtacgccgtcagatcctgcatgaatgaaactgttgtttccaatgtaaatccccatgtgagaagggccggatttatatgttgtgaagaagacgaaatcaccaacagacgggctggcaatgctcttcatagaactccagtatcctgcagtgcttgttctgcccacacttgtttgtttattcagtacgtaccaaatgaatccgctgcagtcaaagcctgaagttgtcgttccgccccatttatatggcgttccgactaacgcttttgcatcagaaaccagcttgctcacattaagtgatgtagatgacgttttgctgcttgaagacgatgaagatgaagcaggttttgagctgcttgtgcttgttcctttcaccttcaatacttggttgacatagattacatctgattttaagccgtttaagctttttaatttgctaaccgtagtgccgtatttgctcgcaattttagaaaggctgtctccgctcttcactttataagtagaagttgaagacgatgacacttttgatgagctggagctgcttgaactagttgaacctttcagtttcaggacttgtccaacacgaagcaaatctgattttaagccattcagcttcttcagttcattgattgtcatgccgtatttttttgaaattttccaaaggctgtccccgctctttactttgtatgtagaagaagaggaagaagaactgctgctttttgaacttgtagatttgccgttaatcgataaagtttgtcccacataaataatgtctgaacgaaggtggttctctgatttaattttactgatcgttgtgtcgtattttcttgaaagatcccataacgtgtcgccttttttcaccttaatgctttgtgcagatgccgctcctgcaaataacgtcgatcctaaaacaactgctgtcgtagctgtaatgatttgctttttcatattttcctccccaaatgttaactctatatatatgtatctctttttttaaattaatcttattgatttctattataaggatagattcccatcagaaatagtcttgacttcatgtgacaaatttcttaattattcgttctaaaaaaaagtttttaagggtattaaatatttcattttcattgcaaaggtgacaaaaaacgagtgcttttgtcatgttttatgggatgtttttcaacataaaggaaataaatgaaaaactttcggggtcggctcatatatcggaaaaatgagtgataaagtatattcgaggagagctgtggttatccgcagtttttttatttaaacaaacatatcatgcaaagacagagaggtaaagatttttctgaaaaatgaatgctttacatcaaataaggcaagataacgaaaagcgttttttcatttccttacaaggctttacttattgtttacatgatcaacagccgcatttaacaaagtttccctaacatgataaacggaatacattaaaggaggcatgaaaaaaatgagtttgtttcaaaatatgaaatcaaaacttctgccaatcgccgctgtttctgtccttacagctggaatctttgccggagctgagcttcagcaaacagaaaaggccagcgccaaaaaacaagacaaagctgagatcagaaatgtcattgtgatgataggcgacggcatggggacgccttacataagagcctaccgttccatgaaaaataacggtgacacaccgaataacccgaagttaacagaatttgaccggaacctgacaggcatgatgatgacgcatccggatgaccctgactataatattacagattcagcagcagccggaacagcattagcgacaggcgttaagacatataacaatgcaattggcgtcgataaaaacggaaaaaagtgaaatctgtacttgaagaggccaaacagcaaggcaagtcaacagggcttgtcgccacgtctgaaattaaccacgccactccagccgcatatggcgcccacaatgaatcacggaaaaacatggaccaaatcgccaacagctatatggatgacaagataaaaggcaaacataaaatagacgtgctgctcggcggcggaaaatcttattttaaccgcaaggacagaaacttgacaaaggaattcaaacaagccggctacagctatgtgacaactaaacaagcattgaaaaaaaataaagatcagcaggtgctcgggcttttcgcagatggagggcttgctaaagcgctcgaccgtgacagtaaaacaccgtctctcaaagacatgacggtttcagcaattgatcgcctgaaccaaataaaaaggatttttcttgatggtcgaagggagccagattgactgggcggcccatgacaatgatacagtaggagccatgagcgaggttaaagattttgaacaggcctataaagccgcgattgaatttgcgaaaaaagacaaacatacacttgtgattgcaactgctgaccatacaaccggcggctttaccattggcgcaaacggggaaaagaattggcacgcagaaccgattctctccgctaagaaaacacctgaattcatggccaaaaaaatcagtgaaggcaagccggttaaagatgtgctcgcccgctatgccaatctgaaagtcacatctgaagaaatcaaaagcgttgaagcagctgcacaggctgacaaaagcaaaggggcctccaaagccatcatcaagatttttaatacccgctccaacagcggatggacgagtaccgatcataccggcgaagaagtaccggtatacgcgtacggccccggaaaagaaaaattccgcggattgattaacaatacggaccaggcaaacatcatatttaagattttaaaaactggaaaataaaaaggatgcagaacgctgcatcctcttttttataaatatctgcggtgaacaccttttccgtcgtacgaaaacatgacttccttatcctcaagcacagactcaatgtgcacgcttcttccccaaagctggaataaataaggaagcactttctccaaatatttcaaatccaactctatgccctcataccaatgcttaatatagagttcgttatttttcatataatcgccgtcgtttactgtcaaatatggaaaaccgccatttacccgcatgcttacgagctggtcgcgcaccgacttccactgtttatcgatgattttataatctcggccctgtttttgaaacaaataaagatcctcgcgcatgactaattctttggttaaataattgcggatgaaagagatatcggattcaatctccctgacctcaaacattttctcccggccggagtcaggctgcacgcccattttcttcatttcctccgtcgggttgttgtacctcttttcaatgtcttcaaatattttcagccctaaataataaggattaatgcctgttttggacggctgaacgacacctgcattcagcttggcgaactcgatcgcttcatcagaggttaaatcaagctcacgtataattctctggtgccaataggaagcccagccctcattcataatcttggtttccagctgaggccagaaataaagcatttcctctctcatcatcgttaatatatcacgctgccatggctccagctcccgggaatgctcctcgataaaaagcaggatatctttttcaggccgcggcgggaacggttttttcgattttttcacttgttttttcggtttcttttcatctaaagaccatagatcatcgtaaggcgtggctgcctcttcaatctcctcttcctcatcatccacactccattggagctttggtcggaccaacgacggatcgatatgctcctgaatcgaaaggattgcatctaaaaaagattcgacttcttttatcccgtgaacctgttcatagtgttttatccgttcagctgttgccgccatgctttccaccatatcgcgcttcgtgttttggaaacggcagttgtttttgaagaaatcgcaatgagcaagaacgtgtgcgacaatcaatttattttggatcagtgagttgctgtccagcaaaaaagcgtagcatggatctgagttaatgaccagctcatagatcttacttaaccctagatcatagtgcagcttcatcttgtgaaactgcttgccgaagctccagtggctgaatcttgtcggcatcccgtacgcgccaaatgtataaataatttcagccgggcagatttcatatctcatcgggtagaaatcaaggccgaatccttttgcaatttcggtaatttcctcaattgcccgctgtaatcccttcttctcctccgcgttcaaccgaatcccccctacttggacttatctataatgtatgagcccgccagacaaaagatgatagtctcactcgggcaagaaaaaattcccccggcacattcatctgtttgcttattggataagtgggtaaacacacaccatactacgaaaaaggagcgataccaattgaatgtagcagacgtgttttcttcttatctcagtaagctgccaaacgtaatcattgctttactcgtcttattaatcggctgggctattgctaaaatcattgaaaaagcggtatacaaaggactcagcaaaacaaaaatcgacgacaagctctttgctgggaaaaagccttcacgctattcctcggaaaaagtcataagcaaggtcgtttattttatcgcactgatcatcgtctttattttattctttaacattttgcacctgacaacagtggcatcgccgtttgtcagtatgctttcggcgattgcagctgcgatcccaagcgtgctgaaagccggactcattctgctgttaggatgggctgcagcttctgttttgagcttccttgtcaaaaaaatcgggatgaagctgaacacgagtgacaaactgcgcaagtggaatttggtgtctgaaggaaaagatattcaccaggctgtcaataccgcttcacaaattgtcttttatctcgtgctgcttgtttttctgccaggggtcttatcttctttgaaaatcagcggcatttcaggtccttttacaaatatgatggaaagcgtgctcgcttttctgccgaaattatttgcagcggcgcttatcgtattaatcggatggcttgttgcccgccttgtccgtgatatcattacgaatttccttgcaagcatcggcaccgaaagattcgcggcacgtatgggtttatcaatttacttaaaagacacaagcctttcagcagtcatcggaacaatcgcttatgtgctcattatgattccggtggtcatttcagcgcttgatcagctggatgtcgccggcatttcaaaaccagctgtctctatgctgaatacgattttaaacatgcttccgaacatcatgattgccatcgtgcttgtattagcgggtatctgggcaggaaaatgggtgaaatccatggtgtccggactgctccatcgcgcaggctttgattctgtcttagggaaaatgggcatggaagccggaacgcctgcaaagctgtccttgtctcaagttgtcggtatgattgcgcaaatcattgtcattctgctctttacagctgaggcgcttcaaattgttcggctgcacttcctcgtagaaattgccaccggcatcatcgcgtatctgccgaatgtccttgtcgcagtattcattctcggactcggcctttacgcaggagaattggtgagaaaagtgctcgcaagcatgataaaaggtcaggaattcaagtctttagcgcctattgctaaatatacgattatcgcacttgctttctttatggccctggatcagctgggtgtcgctgcgacaatcgtcaattccgcgttcatcatcgttcttagcggcttcgcacttgcttttggtttatccttcggccttggcggtaaggattttgcatcacgttatctgtctacatttgaacgcaaaatgcaaaacacagaaatcgaaaaaaaccgtaaaaaccaaaatccgccgaatgacatgtaagcaaaaaacatgcacccagctgggtgcatgttttttaattccttttttttcatttttcaatcgattatgataagatatagaaaatgtcttattctgaggtcttattatgaagttaaccaattatacagattattcattaagagtgttgatttttctggctgcagagcgtcccggagaactttcaaatataaaacagattgccgaaacgtattctatttcaaaaaatcatctcatgaaagtcatatacaggctcggccagctcggctacgtagaaacgatacgcggacggggcggcggcatacgattaggcatggaccctgaagacatcaacatcggtgaggttgtcagaaaaacggaggacgattttaatattgttgaatgttttgatgcgaacaagaatctctgtgttatttcccccggtttgcggcttaaaacatgtgctgaatgaagcgcttttagcctacctcgcagttttagacaaatacacactgcgcgacctcgtcaaaaacaaagaagatatcatgaagcttttaaaaatgaaggaatagattaagattccttctttttttatgccctttttcccccttattgttaagataatttggctatttttataaaaaggcaaaacgatgagacaaatgtgccgatataaaaaagaaacagcaaatgcaaaatcattgggggaaaaaggagagctaagatgaaaaagaaattagcagcagggctgacagcatctgcgattgtcggcacaactttagtagtgacaccagctgaagcagcaacgattaaggtcaaaagcggagattctttatggaaactggcccaaacctataacacaagtgtggcggccctcacatccgccaatcatctttcgactactgttctgtcgatcggccagacgcttactattccaggcagcaaatccagcacttcttcatctacttcaagctcaacaaccaagaagagcggaagttctgtttacacagtgaaaagcggagattcactttggctgatcgcaaatgagtttaaaatgacggtgcaggaactgaaaaaattaaacggactaagcagcgatttaattcgtgctgggcagaaattaaaggtgtccggtactgtttcttcaagctctagttccagtaaaaaaagcaactctaataagagttcaagctccagttcaaaaagcagttctaataagagttcaagttcttcatcttctacgggaacatataaggtgcagcttggagattcactttggaaaattgcaaacaaagtcaatatgtccatcgctgaattgaaggtcttgaacaacttaaaatcagacaccatttacgtgaatcaggtgttgaaaacaaaatcaagcggctctgatacgtcttctaaagacaattcatccaaatcgaaccaaacttcagcaacaactaaatataccgttaaaagcggtgattcactttggaaaatcgcaaacaactataacctgactgtacagcaaatccgaaatatcaacaatctgaaatcagatgtgctttacgttggacaagtattgaagctgacaggtaaagcatcttcaggctcttcatcatcgtcgtcttcttcgtcaaatgcaagctccggcacgacgactacatacacggtgaaaagcggtgattccttatgggtgattgctcaaaaatttaatgtaacagctcagcagattcgtgagaaaaacaatttaaaaacggatgtcttgcaggttggccaaaagctggtcatttccggaaaagcttcatcatcgtcttcatccggttcttcaaacaccaccagctcaacgagtgcgaagattaacacaatgatttcggccgctaaagcgcagcttggggttccgtatcgctggggaggcacgacaccgtccgggtttgactgcagcggattcatttactatgtactgaacaaagtcacatccgtatctagattaacggcagcgggatattggaacacaatgaaatcagttagccagcctgctgtcggagatttcgttttcttttcaacatataaagccggcccttcccacgtcggaatttacctaggcaacggggaattcataaatgccaacgattccggagttgtcatttccaatatgaacaactcttactggaaacagcgctatctcggtgcaaaacgatatttctaaaaacagaaactgtgcggccttaacggctgtacagttttttattagagcctaaagacgttgatgctgatcatatgatttgtcaccggatgaaaatagacttcggcccgaacagaaaaagtgtcatctttctgtctgactgtcacccgaaagacatctttagtctgctgatcattcacctctgtacgccccatataagcataatcagaaaatgaagcgcccttatattcatcctgaattttgctccaggcaagctgttcccacttttgaacggactcgtctgtgtccgttgaatgaccttttgcagccattgacacgataatcaatccgcaaaaaagaagtgcgatggtatacggcagggatttcattttttcagtctcctgtacccagaatatattccctcataggtttaccaaaagcgatatcttcattcaggcattttgattttatgtctccctcatattgctacccctttactgacgcagacggcaagttttgccccgtcaataacagaggatgcggcataaactaatcatgaacttctcacccaagaaaggagaagcgattcatggattatgccgattacgataaagcgctttattacacccatcgttctcaatgggataatttattaattttaatggtgcgtacagaggacgatttgttatcaaaacgaattgagcattttctgcatgcgtatcattttgaacaggattacgccgttttagaaaagatgctgtattcccttctccgatatattgatcatgccacagagctgacttatgaagatcaaatagcccttctcacataaacaaatcccggcgtttagacgccgggatttcctgcttttgcgaacatgctgagttcttcgacaagctcttttatgctttccttaatgttttcagccactgtagcattttcaacatcaatatgcaccggatcaagcaccagctgcttcggaatgacattggcgtagacaccccgcatcacagttctcatattgttcagcgcattgatgccgccttttccgcctcccgctactgccaataatgcaacgggcttatatttgaattgttcgctgcttagaaaatccaaggcattttttaaagcgccgctcatgccgctgtgatattcaggcgataataatacaatcgcatccgctttcgtaacgcgttgcttaagctcctgtactttcaacagttcagattgttccgcttcaccgttaaaaacgggcaatacaaactcgcttagatcaatcaaatccgtgtgatacagagctgcaatataggatgctgcaattcttgttctgccatgttttcttggcgtgccatttatgactaacatgttcattttgagatctctccattcaggttatatttcactgcgaaaagcgctgcttgcgtgcgatcggccacttcaagttttgctaaaagattcgatacatgggtttttactgttttttctgaaataaacaaggctgctgcgatttctttattgcttttcccgttcgctatttcagtcagaacgtctttttcccttctagttaattgatagtatttttctttttccgggtcgtgctgatttttcatatgtgtcagcacatggggcataatagctgtagaaagcttgtattcgccaccatgcacttgtcgtgttttcaccaattcctcgggctccgtatcctttaattgatacgccttcgcgcctgcctgaagcgcggggatgacgtgctcctgatcagagtagctcgtcagcacaatgatattcgtatccggaaattgctgtattgcttttttaatggcttgaatgccgtccatctcgggcatagacaaatccattagcacaagatccggctttgtctcttcgatgacacggagggcttctaatccagttgcagcttctccgacgacttcaatatcatcctgggtggcaaagaaaaaacgcagaccctttctgacaacatgatgatcatcagcaatgacaattttcataccgcccctccttttcggctttttagcggaagcctgatggacagctttgttccagttccaagcgctgactcaatccaaaacttagctccggctttttccgctcgctctttcataccttttatgccaagtgaaggcagaccggcatgcgcttcatagcgaaatcctgccccatgatcgatgatatccagctccgcatggcacaaagaagcagtcagactaacatacgccgtatccgttccggcatgctttttgcagttatttaaagcttcctgtacgacacgccatagcatatgctcctgctcatcagtcagaacaggacagcctttttgtgtaaaaatgatcttcaatccaatgagcgcaccatagcttttaatggcttcagccagccctttttccaatcctccggggcgaagctgccaaattaacgctttcatttctgcgagcgcgtcctgtgataggttttggatgaaatcaatcatctgctgtaaattttcatcttttgttagtgtcttcgcagctttggcagttaaactgacggaaaacagcatttgattgactgaatcgtgaagctcctgagcgaggcggttacgctccattaaaagagcatttttttgttgatattcagaaagcctcatacgctggattgccgttccgatctgaaaggcgacagactcgagtaaatgcagctcttcctcatcaaacatggtttttccggccgccgctacatttaacaatccgaatcttctgtccccgtcttctaaaggcacagttgcatgatgcgtaatcccttctgtgtcaaaacaatgcaggttttctgctgattcgatgcgtttgcagttcatgatatttgcagcttttctaagccctccgttattgaatttcgtcaggcagtaacactccccttcgcacatcagcactttttccttgcggcttaaagccgggggcagataagcgtcggccgctaacgtataagacccatcttcttcgatcagaaaaatccatccggattgaaggtttgtcagactcagcaactcttttaaaacctcatccagtgttgctttgatatcgtgcccttgatttaaggtttccgcaatcgttttcagcgtttttaatttttccatcctcgttttgctcacgtttctcactccggcattgatcttgtatttaagattataccagttttttgtatttcattgcttcacttgtaggatgattttctttcagacttttggatgagaaaaagaaaaagccggatcatttacaatgacccagctcatacttgaattattttgctgttgactcaacaatttcatccaccgtcttcattacatcttcagaaaggacggcaagtcgcttttcactgtcttccaaagatgacccttttacggcgaaataaaatttaaccttcggctcagttccagaaggacggagacagaaccaagacccgtcttccaggaagtatttcaatacatttgattttggcaagtcgatggcttcttctttgctttcagtcagaagcgtccgtttgcttacagcgtaatcttctgctgtgacaacctgtttgcccgccattttctgcggcggattttgtctgaaggaagcaagaatcgcttcaatttgctctgctccttgtttgcctttcagcgtcagggatttcagcccttcacgataaaaaccatattcgttaaagagattgatgagcgcctcatacaatgacattccctgttttttatagaacgcgcaaacttcaactgccaaaagcgcagcctgaatggcgtccttatcgcgggcaaaatccccgattaaataaccgtagctctcttcataaccgaattggaaggtatactggcctgatgcttcgtattccttaatcttttcaccgataaacttaaagcctgtcagcgtatcaatcgtatcaaggccgaatgaagaagctacagcacggccgatttcgcttgtgacgatcgttttgagaacaacaccgttatcaggcaggatgccttgttttttcttttcagaaagcaggtaatgaagcagcaacgctccggtttggtttcctgtcagcactgtatatttgccttgatcgtttttcaccgcgatgccgaggcggtcagcatcaggatctgtcgcgatgagaatatctgcattctgctcctccccaagcttaatggcatattcgaatgccgcatgctcttccgggttcggcgatgtaacagtggagaagtttgaatccggcagttcctgttctttgacaaccgttacatttttgtagccgagtgcttcaagaccgcgtctgaccggtttatttgcagttccatgcagcggtgtgaaaacaacctttacatctacttcttccgataattcaggatgtacagaaatggacgtcagtttttctgtataaactttatcaatatcttcaccgatgattttgattaagcctttttcttttaacttattttcttcgtccactgtgatcgtcagctcattttcaatcgcgtttacctgctcaatgacgatgtccgcttcctttggaggcagctggccgccatcatccccgtatactttgtagccgttatattcaggcgggttatggcttgccgttaccacaattccaccataagcgttcagctgtctaacagcgaatgacagctctggcgtcgggcgaagctcatcaaacacgtatgtttggatgccttgtgtcgcaagtgtttttgccgcttccatcgcgaactccggagacttatggcgggaatcataagcaatgacaacgccccgttttttcgcttcctcaccttgcttcgagatgtatgccgcaaacccggccgatgctttgcgcacagtgtaaatattcatccgatttgtcccggcgccgatttccccgcgcattccgccggtaccgaattcaaggtctttatagaaacagtcctcaagggcctgttcatctccctctaattcaataaggcgctcttttaattccagatctaaatgttctgtctgtttccagcgttcatagctctttctccaagtcatattcgtcctcctatgtatcagcttatgccattattttatatgaagcgggtgcctctgtcacttgataacctgagatctccccctttcggcacgtaaaaagaaataacgggctgcagacagcccgttatgatttattgctcaagcggtacgaccgcatcgtgtaaaagcttgttgaggttttctgtatgtttgtttttcgcctgctcatcccattggaatcgctcgctcataaaatcaataacggcatctttatatgttcttacccaattgatatcaaaaaataaacgtcccgttctgcggacaaagaagtcagcaggggttgcagtcatctcttcttctatactgtattctgcctcagcaagaatatgaaccggaatgttgcgtttcgcggcctcatctttcagcgcttctacccggtcaaagacgcgatctacgttagagccgtatctgatcgcaagctgttttgcgtctttttctgataaaccggctgcaattccttcttttgttttcgcggtaacgaaggacataagatttttcgaaccgccgacgtgcccgccagagattggcatgtttttcgttttacatggtccaaaatccttttcgccctcttcttttaagcgatcacggacaagatcaacgatgtgctccgccatttttctgtatccagtcagttttccgccggcaatggtgatcaggcctgagtcagatgtccaaatctcgtctttccgtgaaatttcagaaggatctttgccttcttcatgaatcagcggacgcagccccgcccagctggattcgatgtcattcgcagtgatattcagttccgggaacatgtaattgattgatttgatgacataatcacgatcctccgttgtcatccgcggatgctccagcgcctctttgtaaacagtgtctgttgttcccacgtatgttttgccttcacgaggaatcgcaaataccatccggccatcaggtgtatcgaaatatacagcctgtttcagcggaaagacagactggtcaaatacaaggtgaatgccttttgtatgctgcaaatgctttccgtttttcgaatggtctttttctctgagctgatcgacccaagggcctgtagcattgacaatttttttcgcatacactttatattctttctttgtcagcacatcttcaattaatacgccgacggctttgcctttttcgtaaagaagctccttcactttggagtaattcacaggctctgccccgaatttaaccgcttccttcatgacttcgatggtcagtctcgcatcgtcagtgcggtattccacatagtacccgccgccttttaagccgtcttttttcaccaaaggctctttttgcagcgtttcttttgctgaaagcatgcttcttcgttctgactttttcacacctgcaaggaagtcataaacccttaacccaatagatgttgtaaatgaaccgaatgtgccgcctttatgaaacggaagcagcatccattccggtgtagtgacatgcgggccgttttcatacacaatcgcccgctcttttcctacctcagcgaccattttcacttcaaattgttttaaatagcgcaagccgccatgtaccagcttcgttgatcggcttgatgttcccgccgcaaagtcctgcatttcgcttagtgcgaccttcattccccttgatgccgcgtcaagagctgttccggctcctgtaattcctcctccgataataaataggtcatatgtttttttcgtcatgtctgtcagcatgcgatctctttcaagacttgaaaattgatgattcatcattacgtttcctccttgttgtcacggtaaatagaaaaagagaccacaacagccaaagtgcatgcttacactttggtgctgtggtctctcctcatctcaggaccgttcttattaacttgtaaccattataccatagtattactttatttaaaagccatagctgctttcacggctttttgccagcctttatacagctcatttcgtttttcttcttccaattcaggctcaaaccgtttatccagattccactggttcgcgatttcagaacggtccttccagaatcccacagcgatacccgccaaataagccgcgccaagtgcagtcgtttcattaatttccgggcgctccacaggaacattcaacaggtctccttggaactgcattaggaaattgttttttacagctcctccgtctacacggagcgtctttaatgaaatgtttgaatctgcttccattgcgtcaagcacatctttggtctgataagccaatgactccagtgtcgcacggataaagtgctcttttgttgtccctcttgtcaggccgaaaaccgaaccgcgcacatcgctgtcccagtaaggcgttcccagtccgacaaatgctggaacaacatacacgccgtcagttgaatccactttttctgcataagattcgcttagcgatgaatcctggaacattctcaaaccgtctctaagccactggatggcagagcctgcgacaaaaatgctcccttctaacgcatagttcacttttccgtcaatgccccaagcgattgttgtcaaaagcccatgttcggacttaattgctttttccccggtattcatcagcatgaaacatcctgtgccgtaagtgtttttccccatgccttcttcaaagcatgcctggccgaacaatgcggactgctggtcgcctgccgctccagcaatcgggatattttttccgaagaagtgataatcaacagtctccgcatacacatgagaggacggcttcacttcagggagcatggatttcggtacgcctagaatgtcgagcagttcatcgtcccattttaaatcgtaaatattaaacatcagtgttcttgaggcattggagtaatcggtcacatgcgcttttccgcctgacattttccaaatgagccacgtatcaatcgttccaaacagcagctcgcctttttccgctttttctcttgcgccttccacattgtctaaaatccacttcaccttcgtgccggagaagtaaggatcgattaaaagccctgttttttctctgaatttatcattatatcctttttcacgaagttcctcacaaatgccggacgtctgtctggactgccaaacgattgcattatagacaggacttcctgtatctttatcccacacaaccgtcgtctcgcgctggttcgtgatgccgatgccggcaatttgagaagcgctgattcctgattcagagatgactgaggcgataaccgcgaggacagagccccaaatttcattggcattatgctcaacccagccaggatgcgggaagtattgtgtaaattccttttgagcagagtggacaattttgccttctttattaaacagaatcgctcttgaacttgtcgtcccctgatctaaggataaaatgtacgtttccataagatgtctcccctttgattaaatatatttagaatttgataatgttttagcagaatgtgatttcgtataaacatagagtcctaacaataccacaaccaatataacgcttacaatccagaagctgcttgtgatgtgccctttaaatgcagcgttgtaaaatacaccgccgaatgatccgcctaaaatcgggccgactaccggaacccatgcgtatttccagtttgatgagcccttccccggaatcggaagaaaagcgtgggcgatccgcggacctaagtcacgtgcaggattgatagcatagccggtggtgcctcccagagaaataccgattgctacaatgaggaaaccgacgattaaaggattaagtccttctgtaaattgatttgcacctatggccaagattccaagtacaaggacaaatgtcccaatcacttcgcttaaaacgtttgcaaatgtatgcggaatgctgggccctgttgagaaaacacccagcttggcagcgggatcatccgttgacttccagtgcgggaggtaatgcagataaataatcaccgcaccgatgatcgctccgatcatttgcgccgcaatataaaccggaacctctttccaaggaaaatctcctacaaatgcaagcgctatcgttagcgccggattcaaatgggcaccgctgatgccgccaaccgcgtatgccgccatggcaacacccaatccccatccaaatacaacaacaatccagccagactggaatgaaagcgatttctttaaattgacacctgcacaaacacctgcaccaaaaatgataagcagcatcgtaccgatgacttctccccaaaatgctgtcatagcacattcctcctaaagtcacgattaaaaagcatgatagagaagaagagaataaaaaaaccacaacaaaccgctttacgggtgcataaacatttgccgtaaagagctgctgtggtctccgagttctccatcacaatgtattaacctagtgcaattgtatcagtgcatgaaagcggtgtcaatcactttccgtcaaaaagttttcatattttttccacaatttggtattagatgttgtgacagctacagcccccgctttcaatgcctgctctacatcctcttccgtacggatgaaacccccggcaaagatgggaatccctgttttctcttttatttcctgaatgagtgacggaacgatgccgggaagcacttcgatgaagtcaggcttatgcttgccgataaactccatgcttttctccatcgcgcttgtatcaagcaaaaacaggcgctgaatggcataaattttcttctgcttcgctttggcaatcacattcgatcttgtggaaataatcccagcgggcttgatatcctgacatataaattccgcaccgtattcgtcatgcttaatcccttgaatgagatcgacgtgcaccatcatgttctttccgtgcttttgcgcttctttgatcacgcccttcagctggccgagatgaatatcaagaataacaccgtaagagaatgaactgttcaaaaactcatcaaattgcttcatattgcgaatagccggtaagatcggctggttgtgaaaactcatcatgtgctcctttaataattcacttttatattatatcgtttgaaagctttctttcaccgttttcacgataaaggaaaggtcctcttctgtcaggcaaaatggcggcgcaagctggatgacattgttgtagccggcgactgtatcgccgtttttgccgatgatcagccctttttctttgcacgccgcaaccacttggtttactttggcggcatcagccggctctttagtcaatttgtctttgacgagttcgattccgatcagcagcccttttcctctaacatccccgactgccgggtgttctctcagagcttgaagctcacctaaaagctttgctccaagatcacgggatcgctgaatcagctgttcgtcctccataatttgcaggtttttcaacgccaaagcacaggcagccgggcttccgccgaacgtgttcacgtggcggaaacggtcataaggagcttccccctgatacgcttcgaaaatgtcccgtttcacagcagtcgctgacaatggcagatacgcgcttgtgattccctttgccatcgtaatgatatcaggcttcacaccgtagtgcataaacccgaacggctcacctgtccgtccaaacccgcagatcacttcatcgcaaatcaaaagggctccgtggcgccggcaaatgtcctccaccttcttcatatatccgtccggcggcattaggatgcctccgcctgtaatgatgggctccataatgaccccggcaatcgtttcgcttaattcccatgtcatgatgcggtcgatttcatttgcgctttcaagcgtgtctgcatcatcaggattccggtatatatctggcggagctgcatgcaggaacccttggctcaaaggctcgtatttatatttccgctgcgcctgtccggtagctgagagcgctcccaatgtattgccgtggtatgcccgatatcttgagatgaatttataacggctgtggtcgccgttttgcagatggtactggcgggcaattttaaaagcagtttcgtttgcttccgatccgctgttggaaaaaaaataacataatcgccgccaagccattcattcagcttttccgccagttgaattgcgggtgcgtgactttgcgttaacgggtagtaaggcagctcctttagttgctcataggcagcctccgcaagctcctttctgccgtaaccaatgttgacgcaccacaaaccggacatcgcatccaaatagcggcgtccgtctgtgtcggttacccaggccccttcggccttctgggctatcaggctgtccgcttgatgcgctcccttcatggcatgccacacaaattgctcatctttttgctttaatccctgattttgctgaatgttttccatccccatcatctccatttcattagcgttccctataatgccaattcaattgaaacagaccttctctttatgtgatgtcttggtgatgatttccctgccttcaatataaagccagaccgggtcagagtcaataaaccgcgtaaataataaaacatcccctttctcaagaagaaagaggatgcagcttccaaagcaaaacaggcaaagtgacaatgctcagcatcgtactgataaaggtcgcactcgaaacaacttggacagccattgcaatagcaatgtgaagcctagccgttttctgtatgatataggaaatggcgaaaatacagaaactccataaggcacatccactatacaatttacttttattttaaagaaagcacctaaacaattccgcttttgtttaaaaaaacccgccaattcaggcgggttttttgggaattattttttatattgaatatgataaatatcacgtcgtctgtcttttagctggcgcactgtaccgttttggcgctgtcttctgagaatttccaggtcaacatcgccgatgacgaccatttcaatattcgggtttgtttcgccgacaatgccgtctcgggcgaattcaaaatcagacggggcaaagatgcctgactgggcgtattggatatccatgttttccgtttgcggaaggtttccgaccgttccagagataaccgtataaatttgattttcaaccgctctagcctgcgaacagtatctgacacgcagatagccttgacggtcttctgtacaaaatggcgtaaagatgattttggctcctttatcagccgcaatccgggcaagctcaggaaattcaatgtcataacagatctggatcgcgattttcccgcagtccgtatcaaacacgcgaacttggtctcctgcgctgatcccccaccatttgcgttcattcggcgtaatatggagtttgtattgcttctcgatcgttccgtcccgtctgaacaggtaagcgatattatagatcttgccttcctcttcgacgaaatgagatccgccgataatgttgacgttatacttcacagccaagtcagtaaacaggctgatgtaatcttctgtatactcggtaattctctgcaccgccaagctcggtgaccgttcctcaaggaaggacatcagctgggttgtgaaaatttccgggaacaccgcaaaatcagatcttgcgtcggaagcaacatcgacatagtattctacttgattcgcaaattcctcaaaggaataaattttcttcatttcgtattggatcacacaaattctaacagggaacgccgatttataatagcgttttgtctgctgcggtagataatcgacattattccattccatcagcgtcgcatacttgatcgaagctgtatcatccgggagatagttcgggttaattcgcataagggtaaagccgttcatcagctgaaaagaaagaaccggatcgtaaatttggtggcgtgtcacctgttcaacatactctctcgctgtcatttcctctgcatatttgtgatagtttggaatccgtccgcctatgatgatgcttttcaggtttaagcgtctggctaagtcctttctcgcctcgtacaaacggtggccgatcttcattcgtctgtatttcgggtgcaccatgacttcaattccgtacatattcaagccgtcaggattatggttggtgatataaccgtcatctgtaatgtcctgccacgtatggcggtcatcatattcatcaaagttaatcaggagacttgagcacgaaccgataatttcaccttcgaattctgcacaaaactgtccttccggaaaatgctccaaatggctgattaaatgctcccgcttccaaggctccattcctggaaagcagtccttttgaagatcgataatcttgtcgatgtctttctcttcgatattgcggataaccattttcttttcaaaccgggtcaaatctaatttctcagacaacctactcgctcctttctagttttgtgagttcagatgatcaagcaatagggcgagctccatctccgccattgattcaagcctgtgatcatagtcttcaaacatcaaggtacccgttactttattcgggacaatgacacacttcatgcctgcacgtttcgcagcaatcgaaccattgacagaatcctcaaacgcgagacattccgctggcgatacccccaggttctttgccgccaataaatagagttcaggattcggcttcacctcttccacatcatccgccgtttgaataacttcaaaatcatcaaacaggccgatttgcttcaaatggccggacacccatttataatcagagctggaggcaaggcctatttttaagcctaaatcctttgccgcattcaaatacgcttcgacaccaggtctcgctttttctgattccatgcgtttggcaaaccgctctcttctcaattgtgtgagctcttcatggttcagctttttcccgatctgctcttctaaatattcaaaaggccggaaacccgcagcagttccgatgacctttccccagacagatagcggcagcactgagccgtgctcttcaaatatttcctgaagaacctcatattcgtgtgtttctgtatctagaataagcccgtcaaaatcaaaaattaacgctttaatcactgggtacaactcctttagtacgaattgagacatatgtatacactcactataccccgaaacaagtctgctttcaaaaagtaaggttttatgtgaagaaagagcctgcacactgcaagctctttcttattaatgaatgttttggtgagaaatgtttgtcagcgctgatcccgcagactcgttcgacatctgattgactgccaggtctccaagcgcaacgatcccgactagattgttttgatctacaataggaaggcggcggatttggtgctgggccatcagctgcgacgcgtcttccagactcatattagggtttcctgatacgagttctgttgacatcacttctgaaacgggtgtctggccatcacggccctgagctgtagttcttaatgcaatgtcacggtcagtcagcattccttttaaaacaccttgctctacaacggggatcgccccgacgttatgctgtttcattagagaagccgcttcctgaatcgtttgattcggagaaacggttgccacctgcgttgtcattgtatctttaactgaactcattgtcagcacccctttcaatcattagtatgttcagacacgagccgtttaaaaagggagttagaggaaaggttttatgatatgatttctctgatacaaaaagagcttttctaaaaatagaaaagcccttgccgcatgattatatcagccttctttgaccgaaaaaggctttgttagtcttcttttgaaagtcagaaaaagcaaacggaaaataaatcccaaaatcattcagcatcttgctgtttttttcaaaaatcgcctgatcactcaaatcagagtgcggcgaaggcttggtcaggataatatgtatcatttgcagacaagccataatttgaaatgcttcttttaatgttccttggtaataatggttatttaaagacagaacgcctttctttttaaagcgctgaatgtccagttcggagaaataaagaggaaatacatcatggatcagctccatagacagctccttgataaagctctcctgttctgcagttgctgcgttcacaattctcacgtcaatcacctttcttgccatcgaatatcctaagtcttactcaagaatagcacagaaaaaaacgcgaaagctaaggtaagtgtttcctatgagaaacagcagccttccgcttcgaaaaggagccatttaacatgaaccaaaaaggcagagggcttgagatcctcatcaatgaaaaacaggacggccaatggctgttttccgtactcaaaacagcgctcaaagcttctaaaccagtgatacaagactggatgtcccatcaacagataaaggtcaatcacgaatccgtcttaaacaatatgattgtaaaaaagggagaccgcgtgttcattgatcttcaggaaagtgaagcatcttcggtcattccggagtatggcgagcttgatattttatttgaggacaatcatatgctcatcatcaataaacccgctggcatcgcgacgcatccgaatgaggatgggcaaaccggcacactggctaatttgatcgcgtatcattatcagataaatggcgaaacatgtaaggtgcgccacgtccatcgtcttgatcaggatacatctggcgctatcgtttttgccaagcatcgtttggcacacgccatcttagaccagcagttagagaaaaagacgctgaagcgtacgtataccgctatcgctgaaggtaagctacggacgaaaaaagggacaattaattcaccgatcggcagagaccgctcacacccgacaagacgccgggtttcaccaggcgggcaaacagccgtcactcatttcaaggtaatggccagcaatgcgaaagaacggctgtcgctcgttgaattagagctggaaacaggcagaacacaccaaatccgtgttcatctggcgagcctcggccatccgttgacaggagactcgctttacggaggcgggagcaagctgctaaacaggcaggcactgcacgccaataaagtacaagcggttcacccgataacagacgagctcatagttgctgaagcccctttccctgctgatatgaaaaacctttgccgcacatatttttcatgaagaaaagccgcaggcactgcctcggctttttaagtcactcgttttccatatataatatagcgcttcggggcatttccgacgtatgaaaacggatagcaggtcgtcagaatcagctcttccttttcatgctggagcgtgataatagatgtgtcatccttatcgacaatttttgtttttacaatttcatatgtgaattctccatatgacaggagaagacggagctgatcccccttttccagctctcccgtccggcgaaacacggtatcccgatgccctgacagcacaatttgtccgttttcatcaggataatagctgtccttgtaatgcccgacacctttttctaaatcatcagcatcggtgccctccacgatcggaagctctgcattgattttcggtatttctaaaatgccgctcgcttggccggtctcaggcttaaatgatgctttgttctttgcttgatctgtgctatttttcgtccccgaagcttcctgcggctttttagccgccagctttgcttcttttaatgtctgttccgttttcgtattcgtatcgatcaatttaaagcctccatagcctgcgatcactaggccggcagcaatgatgaatagtggaataacttttttcacgttctggaggcgctcctttttcttctgacatatagataagttcctgacaatgtcaccgccgcaccgattaccataaagttatagtagcccgctgacgtatccggaagctgatgatcagacccgctttccgcagtctcggtttgtaacggcaatgtgctgatgctattagcagtatcagcggtttttgtgttgttgattggtatttcattgaatctcgaaatggctgaaggcggaagctgatgaaccggtgctgttcccggagtttcttttatatcaggcaaatcttcacctggccttggatcctctttaatcggatcctccgtccccggatcatctccaggctcttccgttatcgggtcttctgttacagggtcttcaatatcactggcttcagcaagcttaattcttccctcttttgtatacgcaattggctcatcaaaactcttcacgtactcaactgtcgcttccaaatcctcaggccctgtcaccggattttttcccagcagtccgattggctgatatttggctcctgtcgccgtcgccataaagttgttgacggtcaatgtatatgtggcatcgggctggatctcggtgccatctgccattttcatatcaactgcttttccggtttctttatcccacgtatacgtaaacccgctgatgctgtagtcaggcccaaaaaccggcgagatttgcgcattgataatctctcttaaatcttttcctttaatctcaagcttcgttaacacatttccaaacggctgaatattgtaaagatctccccacgtaattggacccttcttcagcgcttcacgtatgccgccgccattcataagggcaaaatccgttttcatggcagctctcataccatccgcaatcaggtttccaagaggtgtatcgccgtcatttgaataccccccttccatatcaacagcggcttcgccgactacctcgctgataatcggttccgcaattgtttcgtatttctttaaaatggctgacgcgctgacatccggttcgattttactttgatcaacatatacgatttccgcggactttttgacaatgtcttttgtcgttttatcgatctctacatcaacgacacctatcgcttttccatattcaaacgcttgaacaatcagttttccattcacttcaccgttaacaacctgatgattatgcgcggcaaaaatcacgtcaatttcagaatctgttttgtttgcaagatcagcagactcaccggtaatggcgttgccgttttgttcagctgacatatgtgcgagaaccgcgatggccttcacgccttttttcttgagctcttcggccgccttattcaccgctgttgcttcatctgtaaactcgatattttttattccttcaggcataaccatgccagctgccgactgtgtgacaactccgataaaagcaacgggtacgccctccacattaatgatgtcgtaagccggcaaaaagggctctccagttgatttcattttacaattggcacatacaaggggaaagttctgtccatcatatccgcttgtgcctttcggatgatcaccgccatttaagatcctcagaagttcatccgtgccttcatcaaattcgtggtttcccacggttccgacatcaaatccgatgtcctccatcagttctacagtcggttcatcctgaagaagagaggaaactggagagcttccgccgatcatatctcccgcgtgcacaatcagcgagtttttcttttcagcctttttttcttttaaatatgcggcggcataatccatgcgtccaaacgtgccgtctacagttccatttccatcaagatcaagctcatattgctgatcgattttgccatgcaaatcattcatgctgagaattctaagcggcacatgttcttgaggtgccgtttgcctttttttatatcccgcgctctccgcttcacttgctgaggcgaagaaaattctgttttccacagctatcttcttccagtcagctggctgcacatatgttttattcgacgagtcccccacatatcttgtcaggcctttcccttgctctctggctctgaattcaaacggcatttccatgaggggatcgttttcattccaaattcctttttgatctttttttgcagcggctactgcggcctgaaattgctgataatcctcttcattgtcaaccggccaaataaaatacgtcggagcatagccgttttttacaagctctaagttcacgtttgaacctgattcggttatgacttgtccgagcaatctgccatagctgtccttggcttcactcccgaccttgacagtaattttatcacccggggacagaaccgtttttagatagtcagatgcttttttgccaaatcttaattgattttcatctgcgtcattttttggtgtgtgatatgtttcgggtgcatctacatttacaaaccggatttttgtcgttccaagcaccggagatttaagatgaatggtatcgccgtcaactacccggtcaacaatcccttcatattctccctctgcagacggaggtgcgggctgctcttcaagcagcttcaggtcagccgattttcgcggaagcagctgaaaggtttggtatctgcttaacacaccggtaaattcataccatttgccctcatcaagctcgtttatcacccctgtttcattcataacccggagcgtcattgcatgatggtcgtcatcaatcattgttacattgtaaccgccgccggcaggagaacttggaattgaggaaacaaaagcggttagtttcacaaggcgtccttcatactgatcacctaggctgccgttaataagttcattgattgttaagtgtttgggggcggggagggattgatttgactggttgattttgatgcctgatgagtttggaacgatttctttcagcccctggtaagacgtgattttccctgtcaccgtgacatccataccctcttttaattcgggaaattgttcaggggatggcgaataaatgttaatgcctccggtttcatcttgcaaaaaggtcgacagcttcccgcctccgattgcgttttgatcagctgtaatgatcccttttatcgttacttcttcattcagccttccccgtgcttcatttatggtcacttgctgttcagccggcggagtttttgtgtcatcggttacgttcatcgactgaacgtttttaagtcctgtcgtgttaaagtaattttcaagctttccttgaaccgttatctttttcccaagaagaagcggattggtttgcagcccaaattggcttctgaaggcggaggggatttgcacaggaaggatgtgttcgggcgatgttttgtttttacggtctgccagcgcaacattataatcatttgaaaaagggcttgtcagtttataatgctgcggggaaacagcctggccgactgcatatccttcgacaagtgcctgtccttctttttgctgtattgccttctcaatcgatataggctgttgcggttcagctgcctttacagcttcgaacgtgtacattacatttaagaacattaatgccgtgatcaacacaatatgcagaatacgcctcatcatatttcctcccttatacacataatgacaacgattttgtctgcttatcatttcgacagacagcatataattcctttcaggcttctgcataatacacggcagactgacacaaaatacagctgatctgaaaaaaaaggaggaattcggtttggatcagttcaatcagcagcagcaatcccaaatgaacaaaggtattcctggcaaaccgcataaaaaccacggcggacatgaaatgtttgatatgcatgaggtgctttccggaacacttactgtgcttgatcagtttatgatgctgagacaattctgtaaggatcaagaattactaaacatccttgatcgtcaacatcaattcatcacatctcaatacaatataactgcagaatgcttcaaaacaggaagcgaaccttcacaaaaaacagcaacttatatgatgaaggaagacaaccagactgtttacggcatgcagccgtcacagcctaaaaaacctgttcaatccatgaatgatattgatgacagcatcatcagccgacaaatgctttgcgcgattaaagcacaagcttctatgctgacgatggcttctctggaaatgacaaatccggccgtaagacgcgtactgtctgcgcaaattcaggagtatgttgaaatggcatttgaaattttcctataccaaaacaaacacggctattaccaggttcctcagcttgatgcgcaggatatggaacagctgcgaaattcattcgcccctgcccaaggacaaatgcctccgacacaaggcggaatgggtcagcaaggacttcactaataacaaaggcattggatagatactatccaatgccgcactgtttttttcaaattttttcttaaaatctttttcaaattgatcaagactttcctttgttgctgatttaaaccctttttcaaagtcccctttttttgccgtttccttaatcatttctgaaataatgtctttcccgtatttgtccgtcagctcatcgatcatataaaagctttgcaaatagacatcagtgtcatattcggctctagcttcctgccagtctcgatcagtctgcaaacggtcaaagggcacgacagaaaacgtgatcggatctatgagcaattcatagttcgcaatccactcgcttaacccttcatgaaaccataacggaaactcatcgggatccgtctcaagctccttcaatttctggtgaaacgcatggtgcgagtattcatgaatcaacaatctctggtacaaataaaccgctacctcgtccccttctaacagtttctttttctcttcaggcaacaatccgatcagctgctcccgttcagaataaaaaccaactacatccaataaaccggagtaagcctccatctgtttttcattaggaaaaaaataatgtcaataggcttttgattcgaatatccaatcataatctgattaatactgaccgcatattcaagcgtttctttcgtcaatggcagtaaggacttttccttagaagtgtaataaatatcggcctgtttgaatgactctttcttcatgtgcttcgtcacttgttcttttgttattccagatgcctgacctggaaaagacaggatatacatcgcgcttgatacgatggctgagcttacagccagcatcacaaggactccgcacaggaatagagcggatgccgcacgctttcctatgccatcccgcaaacgtctccctccctgagccggtccgtcttgtacctttttatttttactctatgcagcctgagttcgcagtgtgtcattaacgcaaagaaaaagccgcacaaattgtgcggcttctttcatttattcagcgttagggaatacacgctgtacagtttgtgtaaattcatcaaataatccggcgattgggtcaccattttgaatacgctttccatatccttgcatacgctctacaaaatcagggttagctgaaacgtaaacattatcaatgtttttgtcagtagatcttacctttttggctatttttttcttcagattgttttctactgcacctttatttccattggttaaaacgactgcaacgtaggcttgatttccagccacaatgatatcggcatgctttacttcttttaggtctgttactttatcagctgcttcatcagcaacctcaagttttcggtcgttgttattatcgtcatttacacgattgttattgacattatcattaacattgttgtcaacgttatcccgattgtttacattccgcatatcgtcattggccggatttcgataatttacgtttcttacatcattattatcacgtctgccctcaccttggtcggctacaccgcagccagtcataagcaaagggataagaagcacagacgcaaggacttgtttttttccaaacatgtgaattcctcctttatcactttacttataggtttttctaactggctttaattatgcatgcaaatctggaggaaatgctttcccgggaaatataacggttaatttgtctaacgagggggaaaatatgaatacactgcaaaggagggatcatgttgttcaaccagcgaagaggaatcagccccgcagcattgatcataggatcaactatgcttattactgcattatcacctcagatccgccaaagaatcagcgggtttatcacaggacaaatgaacagacgaaattcagaaaataacacgtttgatgcttctaatgtaggaaacatggtcaaacaagcatttagcggaagcagcggaagcagcggtgataaccaggaccgttcgcagcatcaaagccagcggcaaaatggccgtcagcaccagcacgctggacagcagcaaccacagcatcagcatacacagtctcaaactaggcaaactgagacagccgcgaaaaaaagacagccgcattatgctgaacccattcattttgaacaaaacgcaatgaatgtcatggacgacaacacgatgatggaaatgctggaggacttagagcctggccgttaaaaaaacgtgtaatcctcttggattacacgttttcatatgttacgcttcttcagcttcaatcactctggattgatcatgaaatgccccttgatcaatttcttttgtgaccttacttgtaataagaccggatgtcatgcttccgctgacattcaaagcagtacgccccatgtcgattaacggttcaattgagattaacaaaccggcgagcgcgacaggcatgtttaatgatgataaaacaagaagcgccgcgaatgtcgctccgccgccgactccggcaaccccgaaggagctgatggcaacgactgcgataacagtgataataaacaccgggtcaaatggattttggccgacagtcggagcaatcatcatcgccagcatcgcaggataaatgccggcacatccattttggccgatcgaaagaccgaacgaaccggcaaagtttgcgattccctccggtacacccatgcttctctgtgttttaatattcagcggtaaagcacctgcgctagaccttgacgtaaatgcaaatacaagtacaggcaccgcttttttcaaataaatcaccggattcaagccgctgaacgtcagcagcagcaaatgaatgataaacatagtgattaacgcggcatatgatgcaatcacgaacatgcccagttttagaatgctgtcaagatcactcgttgcaattgtttttgtcatgatggccagcaccccataaggcgtcagtctcaaaatgagtgtgacaacacgcatgacaatggcataaacggcatcaaccagttttttaaatgtttctgcctgttccggctgtttgtgttttacgccgaggaatgccactccaaggaaagcggcaaaaataacgacagcgatcgttgaagtcggtctagctcccgtaaaatctaaaaacgggtttccaggcagcagttcaacaatctgctgcggcagcgttttcgctgtcatatcctctgatttctgctgaagctcctgtccccgtgaaagctctgtacttccttggtcaacctgaatcgcctgcagatcaaatgaaagcgcggacgcgataccgacagctgcagcaactgctgttgttgctactaaaatcccgataatcaaaccgctgattttcccaagattttttgtcagcttcagctttgtaaaggcgccgagaatcgaaataaagacgagcggcatgacaaccatctgaagcaatttgacatatccgcccccggcaatattaaaccagtcggctgtttgaatgactatatttgaagtcgggccgtaaatcagctgaagcgcaaatccgaatacaatccccagccccagcgcagtaaatacacgtttagagaaggaaacatgttttttctgcataacaaagagccctaagataagtaaaaataaaataaatacatgtaatacaaccagtaaagtctccaaagcaggtaaactctcccttcaaattttctcatttactatattacactaattccgatgggtcaagtgcgaattattttaacttatcaattcaagtaaaaaaccttatataatgccttttttgttcttttctttcccttccatctttagtaccttatataagggtgataatatttgctgaaagaactgtttgtaaatttgaccattttaatcacatttaattatctcttcacccacctgtttaaagaaaggctagtacataaaaaagacagcatatcctttcaagctgttaaaggactggcctgcggtttgctcggggttattctgatggtttttggatttacctatcagcattcaattattgatcttcgaaatatccctattatgattgccgctctttatggaggctgggtttcaacggcaacggccctggccatgatcactgcaggccgcttgctgattacgatgaacacatctgcactatactcggttattatcatttgtatcgctgccattccgtcactcattgtttctagaagaaaaaaagttcaactaaaacatgctttctatcttttaataatcacaaatagcttgatctccttttccttttattttcttatagatttacattcatacgaacttcatttgtatttttggatcatatcaatagcgggcggcatgctcagtttatatattattgatcatgaaacaaatgcacatcttctttttaaacaatataagtttcaggcgcactttgactttttaacaggcgtgtataaccgaagaaaatttgaagaaaccacaaaagctctgtatcagcaggcggccgataccccgcattttcaatttgcactgatttatatggatatcgatcattttaagaccatcaatgaccaatatggccatcatgaaggagatcaggtgctcaaagagctagggttacgtctgaagcagaccatccgaaatactgatcctgccgctcggatcggcggtgaagaatttgccgtgctcctgccgaactgttctcttgataaagcagcccggatcgctgaacggatcaggagcactgtaagtgatgcaccgattgtattaacaaacggcgacgagctttcagttacgatatcactaggggccgctcattaccccaataatacggaacagccaggatccttgcccattcttgccgatcaaatgctttacaaagcgaaagaaacgggacggaacagagtgtgtttttcagaaaaaaagaatgaattcaatgttcgaattcattcttccaatctgaaagacgtttcaaaggcagaaaagccgggacaagatctccctgatattctttttctataaatgccgctgtatcatcagcttgataaagctcaagaatggtttgcagcgcttcccgatcttgatcctccgctctgacaacaatcaaattcatctcttcctcagacatgagtccgccgctctttagcgtatgctttttcgggttcaagcccgctttttttgcttctgatggtttcatgacaaacacgtcggcaccgctcactgcatcctgttgccggacagcttttaatttcaggtgtctcggattatctttaatcatatcaactgaacctgttccgttaaatccgtttttcagcgttagcaaacccgcttcctggagcaccgtaagcgccctgccaaaatcgaacgctttatccggaacagaaacgacagctccccgcgatatatctcggattcgttcatatcgttttgaataaatgcccatgggcgttatgtatgtcgtcccgagcggtgccaaattaagtttgtatttttcagtgaacgactgaaaatatgaaatggtttgaaaggcgttggcatcaatttctttgttagcaagtgcgatatcagactccgcataatcagaaaaagggatcagctgaatatccagccctgcctcttcagccttttgagcaatatagttccatattgccccgtcagactcagcaatcccgatttttatcgattcatgttctgcagacggtgaacatgcagtaaatgaaacgagaagaacaaggacgaaactgcatataagccactttttcattgtgaccatactcctatctatgtattagagcatgcaagcaatatcagacataaaaatcatacgctctcttagttgataaacgttgtcatttgtaatattgattaacttttaccttactcatatccaataaggttgtcaattcctattacttatcttcccaaaatgaaggaatactaaggcaaacgtatgatcacatatcgagaaaacagatgaatttccgtaaataaatatcaaattgaaaaataaatatggtattttccgaaaaaaatttcaataagcagttgttttttctgaagattactggtagagtaaaggtaattatttttgttcgaactatctttaagaagaaagttttgtaagagttttcgtcttgaaagtttgttaagagcaagaatagtgaatttaagcgttatgatcgctttaggaggaaatttcatgttagaaggtaaagtaaaatggttcaactctgaaaaaggtttcggattcatcgaagtagaaggtcaagacgatgtattcgttcatttctctgctattcaaggcgaaggcttcaaaactttagaagaaggccaagctgtttcttttgaaatcgttgaaggaaaccgcggaccacaagctgctaacgttactaaagaagcgtaagcataaattgatatgaaaaactgcaggtgcaaacctgcagtttttattttgacaaaaaagctgttttgtcataagcaaaacagcttttttattagtttgcaatatcccgcttcatgaagattccgaaagcaagcaacaggaagatgataaagtagatcgccagcatgacgagagaaaacgtcatagtcatcccttttattaacggtgtgccatccacatactgagtcaagtcgacattagcaaacaatatatactttgcccagtcaaatttcgctgcaataaatgcagttgcagtcgtaccggcaaccaacaagaagatggaaaaaccaaccgcaagagagctgtttctgaataccgcagacagcataaacgccatcgtcgccaccattaaagccgagacggattcagaaagatacgttgtagccaaatgccccatcatgttttgctcaatgacatggccatccttatagattaaatgaatattcgcggcggtttcaccacccgttccgaagaagatcaaccctaataaagtagaaccgataaataaaatcaacagcaacaggagcccaaacaggagaactgtaatatatttggacatcaaaatttgaaaacgactgagcggccgaatcattaatagcttaatcgttccccaattaaattcgttcgcgacaattccggccgcgatgataatagtaaacagaccggtaaggatggtaaagtttgctgaatccgttacataagaccataccgtatagcccgtgtcactagggatattatgctcgatgcgatagtcattgagtgtgattgtttctttatacccatctttcagtgaaggatcttctttgatttctttctttaattcggcgttttgtgcttgaagctcttgtttccaatgggaatttgattcaccggcagaaaaatgattcgccaaaaatgcaaatccaaccattgtcagccccagaattccgatcatcacccatgttccggcacggctgaaaattttgagccactcattataaatcaaattaagcatgctgaacctcctcttttgtttcacctgtcatttctaagaaacggtcctctaatgattttgttatgaccttgacctcataaatacggatttgctgcatcaccagcaattcaataaccgcagggacttcctctttagccagtttgatttctacaccatttgtcttactcagcaaatcgtactgatttaaaacagtagcggcttcactcggctgctcaacctggaagaaatatgtatcattctcatcaatgttttcatcttttacattttgaatatcgatcagctttcctttttgcagaatcgcaattcgatcacacatcagttccatttctgacagcaggtggcttgaaacgatgacagccattcctctttctcgggtcagcttctttaaatgatctctgatttctctgatccccgccggatcaaggccgtttgtcggttcatccaaaatcagcactttcggatcgtgcagaaggcattgtgccaagccaagacgctgtctcatccccagagaatatgttttcaccttgtcgtggattctgtctgttaaaccgaccagttcaacaacttcatcaattttttccttcgtgacacccttgaccatccttgcgaattgctggagatttttatatccgctcaaaaatttatacagctcgggattctcaacgatcgctccgatatgcttaatcgccttggcatattctttcgtaattgattggccgcaaatgaggacatcacctttcgacagcttcattaaccccaccatcatccggatggttgtcgttttccccgctccgtttggtcctaaaaaaccgaatacctcgccttcacgaatcgtaaaactgagatcatcaatgatcgttcggcctctgatgtttttagtcacgtttttcaattccaacactgttttcatcatattcctcctctttctagcaaacttccatttttgatttaaaccattgcaaaacagacatgccttcctgttcacgaatatcttctacttcacgctgcgcaactttttctccattggcgaggatgattacttcatctaacaaagtctcaatttcatcaatttcatgtgtcgcgatcacgacaatctgctgctcaaaatcaatgtacgacacaaggctgtttacgatggaatccctgaccatcggatcaagcccggaaaaaggttcatcaagcaagatgacgtctgcccgtctcgctaaagcaagaacgattttcagcctgccccgatttccttttgatagctttttgatctttttttccggattcagctgcatctcattcaatagcttataaacctgttctgtatgaaaatcaggaaactgcgactgataaaaattcaccatatctttaacagtgaaatgcggataaaacatatcaagctcagtaagataagccgtttgacgcaccatttctctcgtaacctgctcttcatcaacttttacaaatcctgaagtcggaaacagaaggccagccatcattttcagggtcgttgacttgccgctgccgttcggtccaatcaggccataaatccgtccggatgatagggtgattgacacatcattgacggccgtatggcggccgtatttttttgatacatgttctagcttgatttccattttagcctccctctgtgaatgttttaatcccttctaacatttcttctttcgttagccccagctctttcatttgcttgacaaagccttccagcacctctcgtgtcagcttgtctttcagctcgtctacgatttctgctttttccgcaataaacgtcccttgacctcttcttgtctccacaatacccagcctttccatctcactgtaagttctttgaattgtattgggatttactttagtttgaatcgccatttctcttactgaaggaagcttgtctcctgggagcagctccttcctgaccagcctataaaagatctgatcagcgatctgcagataaatcggtttcgaggattggaattgattgtccatatttacacctctactttacgatcaagcagttttgaagccatgatgagcagcaagaatgtgatgactatagcaataggaaaccctagcacagacagatggataggttttagttccaatctccaaacattgtggaagtggaaatcaaaattgcaatagactgttacaggccagaaatgcttttgagattcaaccaaagggcttatgatgtattcatcgaagaataaccacattgcgaccaacagaaccatcgcagcccaccgcattccgcgccaatttctgagagagtgaaaaacagtccaaaacacaatgactgttactgacatatctaacgaagaaataagcccatacatattcagcaaagccactgtactcgttatatcaacttgatgctccagcagattttttacagagagcatatgatacatccatatgccataggctgttaatgccaactgaatcacaaattgatagagcaaagatgctgccaatttagaagaaaacagccataagccgccatttggattgtacagccaaagctgtgatttcccttccttgcgaaggtgataaaaaacaaaaacaggagataagaaaagcagaaaaaaagcaactgcaacaaaaaaaccaaaaatgactagaggttctttcgtgcgagaagctataatatggcctgttcccaataagaaaatgattccgcatatccatactagcagccacattcttgaaagcttgatatctttctttaataaacctaaaaaagaattcatgtctttacctcccggaaaaaatcctcggtgtatgagtaacatagtacactagatcaaggtggaatacaacatattccatggatttatttgataaaaacataattgatggaaacagcaaaaaaggcaaacccgcatgagtaaacggatttgcctttttcattactttttcttatttttcatagagagcagcgcatcacgatagctgcggtcctgcattttgtcactttcctcagtgacctcttcttctgcatgaacttcatcagaatgcttaaacttttgcagcgcctgcctgtaaatatcatcacccattgtgtcacgcttctcttttggagaatcgtttttgacaacggatggcgtatgctcggcagcccttgcttcagcagggtaatgcgcttcgtttttttcctcttctggaggtgcgattctatcggttgcttcttgcttctcaggtccaggtgaggcgttgcggacgttaaatgtaataagggccgcaatgacaatgacagcagcaattattgctataataatggccatttcaacctctccttactgtcctgctgttaggtttcctgtgacttggctgacacgtcttcccaacgcgcgtccaagctgaataccttcctcagacattaactcatcactgtctaccggacaagtgacacctgctccgtaataagagccataaagtgcgttttcaggcacgttgccaggcagtccgacaacaatcatgccttggtggaacatcggcgtgattaaattgtgcattgtcatttccaagccgccgtgtgttgttgccgttgtgcagaagacagcaccgactttgttgatcagctcgccttcagcccacaagtagccaagtctgtcgatccaagttttaagaccggagctgattgttccgaaatgccctgggcatccccaaataatcgcatccatatctttaagcttgcggatatcagcctgatctacatggtcgatgaacacttcagccgcgtcgttttctctcgcgccttcagcaatcgcttctgcaagcactttagtatgttcgccttcactatcatacactacataaattttcattcaggaaacctccctgtacagattaagattccttagcttcttttggagcaggaagtaatgaaagctcctcttttttcttcttacgcaatttatcttttctgacgtcacgcaggaagatacttaaaatcaaacctgctacacagaataaggttgcccacataaaggcatcatttatccccatgacattggaatcgagtgatgcgtgtttataaatatgtgagtacacatatgttttcgccgtatcataagacacattcatattcaccattaaattcgaaactgcattttggaacgcatggaggaagttcgggtccgccgtgcttgttttatctgcaatttgtgaataatggaatgtcgtccggtttgtataaatcgtcgtaattaaacttgttccgattgatccgctgatttggcgaagcgtgttactcatcgccgttccgtggctgttcagacgggcaggaagctggttcatcccggctgtcatgactggcatcattaagagagacataccaaatgcacgaattgaatagatcagcatgatgtgtgtatatggtgtatcaattgtcaattgcgtgtattgatacgttgttaccactgtcacgagaagcccgataatcgcaagcggtctcggtccgaatttatcgaacaaaatacctgagatcggtgacataatcagcataacgatcgcacccggaagcagaagcagaccggattgaagcgccgtaaagccgaccaggttttgcagataaatcggtaaaaggaacataccagtgtaaagtgccactgtaataatgatattaatgacactcgagagtgagaaaatgtcatatttaaacactctgaaatcaagcatcggatcatcatgacgcaattgctgaacaacaaaagcaacaattgcaatggctccgataataactgtagacaatacaatcgggtcggtccagccgtcagatccggcttcactgactccgtataataaggaggcgaatccgacaatcgagaggattgcgccaagagtatcgagtttgattttttgcggctccaccatatttttaaagatgaagaaagccacaatgataacaattgcgccgatcggcacaagtccgtaaaacataatgcgccatgtataatgctcaataatccacccggaaagagtcgggccgaccgctggagcaaacatcatcgctagcccgaaaatccccattcctttccccctgctttcaggcgggaaaattaacagaatggttgtcataacgagcggctgcaagatacctccgcccacggcctgaatcaaacggccgatcagcattgtagagaagttaggtgcgataccgcagactaacgtaccgagcgtaaaacaaaacatcgcgacgagaaagagactccgctggccaaatcgtgtaatcaggaaagcagataacggaatcaatacaccgttaacaagcatgtaacctgttgtcagccactgaatcgtcgttgcacttacgccaaattcagtcattaagtgcggcattgcaacattaagcagtgtttggtttagaattgccaaaaataaacccgccattagcacaatcagcaatgacatagggttttttgcatttttttctttgcctgtagccatctaagacaacctcctttcatggtttgatgactgatctgttttactcagaaattttaacagatgcattcattccaggaagcaccttatcagatgggtttttgattgaaattttcacaggaactttttgtgttacttttgtgtagtttccgcttgaatttgtagaaggaagcatatcaaaagttgagttagtcgcataaccaatttcttctacagtaccgtcaaatgtagtatcagggtctccgtcaactactacgtctacactatttcctacttcaatatccgcaatatctgtttctttaatatttgctgtgatgtataggttgtccatgtcaatcgtttgtgcaattgttgtaccagcttgtacggtttgtccgtttttcacttcgtttttcacaattgtgccatccataatggattttacgtcaacagtttgttcacctttgatttttgcaactgtgtcgccttttttcactgtttttccttcgtccagatcccagtcagatactttacctgctgctggagcagtaatagcagccatatcgcccgctacttttgcttcatctgtttttacgtagtttgtgctttgataatagtagtaagcacctccagctataattgcaagaacaacaatcaaaccgataatgttggtcagaattaaacgtcctctgttcattttgttttctcctttcgtttcatcctctatcattttgcggaaagctggtgaaaatatgtgagaagtttttaattaccgcttttttctgaacagccttcagcaagcttcgttaaacttccggctagtttgcgcaaatactgcagctgggaggtatcaagcttttggtacaagccagcacccatttttgcatattgcacagcggctttttctatcagttcttccccctcttcggttaactgaatcatgacgatacggcggtcatccggactgtcatatcgattcatcaattggcgcttatacagaatatctgtcatccgcgtcacagaagcaggcttaagatcaagcgacattgccagcttgcttagcggggtgcttccgctttgatgaattttaaacatcagcaaatattgaaggactgtaatatcaaaaggctcaagcacaatctccaatatcttcttctgttttttatatatcgcccgagacgtatcgaagagctgttcaaaagtgagcaaagcacgttctgattcagtcaactccttttcacctcattcctcaataatagttcacaagataaaatattaataaatgaaagaagatttgtcaaaggaaaaatttctttttctcccgtatttttttcgcaagcgttttcttgcttttattaaataaaaaaagccctgaaatgggcttttcattacgaaaattgatggcttacaccagactcttcatttctgaaaaagttctttagagcctgaaaaacatcagatttctgttttaaaatatagtacttaaatttctcatcttttacatttttatatgcagacattaacgttgaatgcctgttgtactgattgacctcgccgtagcaaaacagattggccttcttcataatatcattgaccagcttcacacagcgcgcgttatcagatgtcaggttgtcaccgtcagaaaaatgaaacgggtaaatgttatagcgggcgggattgtacttttcatcaataagctcaagcgacttccgatatacggaagaacaaattgttccgccgctttctccctttgagaaaaaatcctcctccgagaccactcttgcttctgtatgatgggcaataaattcaatttccacagtctcgtattttgtccgcaaaaaacgggtcatccagaaaaagaagcttctggccatgtatttttcccaaacccccatactgccgcttgtatccatcatggctaaaacgacggcttttgattcgggctttgtgatgtcattccacgtcttatatttcaggtcctccggataaattgggtagaacgacggttttcctgacattgcgtttcgtttaaaggctgacatcatcgttcttttcttatcaatattaccggttaaccctgttttacggatatcattaaactcgatatctgtatgaatgatattgtcccgctctttttgctggagattcggaagctctaattctttaaaaagcgcttcttctaaatccattaatgaaacttccgcttcataataatcctcgcctgcctgatcaccggcaccctgcccttttccaggcccttgttttttgtctgatccatcccgggccacaacatctccaacctggctctcgccgtctccttgccctacatgtttatttttatcatagttataacggattttatactcatcaagtgaacggattgggatcttcactacatcttttccattagacataataatgctttcctcagttacgaggtccggaagattgtttttgatcgcttcctgcacttttttctggtggcgctgctggtcatcgaagcctttgcgatggagggaccagttttcctcagaaatcaaaaaatggccgctgtcattttgggacatgaattcccctccttaaccatttgtggtcgtgatacatacgtattccggcttgtgccagattatgaaacaagtcttttgaaaagatttatattcatcatatgcacatatgcacgtttaattgacaaactatttagaaaatgggacaaaataacccgccctattcggacgggtcacgttgcttatcggttcagcaggctgccgacatatttcagcagctcattggcgctcgtcgagttgtagccgtgctcatcaattaaacgggccacgacttcatttacctttttcagctgctgctcatccggcgtttttgttgaggtcgtaattttaacgacatccttcagatcagcaaacagctttttctgaatagcttcacgcagtctttcatgggaattgtaatcaaaccgcttgccttttctcgcataggccgagatgcggattaaaatttcttcgcggaacgcttttttggcgttttccgaaatgccgatctgctcttcgatggatctcatcagcttttcgtcagggttcatttcctctcctgtcaaaggatcacgaagcttgtttttattgcaataggcctctacgttatcgaggtaattgtccataagtgtttttgctgattcttcatatgaataaacaaacgctttttgaacttcctttttcgcaatatcgtcatattccttgcgggcggcagagataaaattcaaataccgctccctgtcctcgcttgaaattgatgggtgctgatcaagaccttcttttaaggagcgaaggacatcgagagaattaatcgattccatattttttctgataatcgttgaagaaatccggttgatcacgtaccgcggatcaattccgctcatgccttcatcattatattcttttttcatatcctcaacgtcgacagagttatatccttccacactttccccatcatacagtctcattttcttgaccagatcaatatccgaccgcttcggctcttttaaccgggtaaggattgagaacatcgcggcgaccttcaacgtatgcggggcaatatgaacatccgccacatcgctttctgcaatcattttttcataaattctctcttcctcagacacttttaaattataaggaaccggcatcacgatgattcttgagtgcagggcttcattcttcttattagaaataaatgagcgatactccgtttcattcgtgtgagccacgatcagctcatcagcagaaattaacgcaaaccgcccagctttaaaattcccttcctgtgtcaaggaaagcaaatgccagagaaatttctcatcacatttcagcatctcctgaaactccatcatcccgcggttcgctttattcagctctccgtcaaatcgataagcgcgcggatctgattctgaaccgtactcggcgattgttgagaaatcaatactccccgtcaaatcggcaatatcctgagatttcggatcagagggactgaatgttccaattcccgtacgcttatcttctgaaaagaagatgcgctccaccttcacatcctcaattcttcctccgtactcttcctccagcctcatgacatttaaaggagaaagacttccttctattctaatgccgtattctctgtaaaagtcatcgcgtaaatgatgggggattaaatgtagagggtcctcgtgcatcgggcagcctttaatcgcatatacagcgccattatctgtcagcgtgtacgcttcgagaccttttttaagcattgtgaccagcgtggatttaccgccgctcacaggccccatcagcaatagaatccgctttctgacatctagacgtttggcagccggatgaaaatactcttccacaagacgctccagagattcttcaagcccgaacagctcgcggtcaaaaaaactgtacttcttgcgtccgtcaatctcctctatcccgctgtcttttatcatattaaaaactcgagaatgagcagattgcgcgaccatcggattttctttaataatctccaaataatcggcgaaagttccttcccatttcagccgctgctcttcctctctgtacttttcaattttctttaatatatccataaggacctcctctatcatgtttgatacactatgcaaataaggtactttgatacaatctatgccgccatctcgtgatacatgctttggtttcttaaaaataaagatactcatacatcgttgacaaggcagactgcgaccgttcataataaagaaaaatacagaatcatccagactcggacagcacggaaaaattgaagagggggagagacggtgaaaacaatcatcatgatgggtgtcattgtcacttttttagtatcaatttttaccgcaggatacgaaagcaagcctggaaaagaataaaaaagggtgctcctgaaagagcaccctttttgtataacagaacaatgttttacagttttgttttttctttaatctgtgaatgcggatcgcattcacatttgtattcgtactcaatcgttccgatgctgcatcccggcccgatgatcacttcttttcccctgacaactgccgcttcggtattctccaaataaacccgatctccttctatgacatcggcgatcagcttccctttcttccggctaaaaaaactcgcgcgtcttttcactgtaattgttgttccgccgatttcctgcacatggcttatatcatggctcaatcccagcttgatctcacccgaatttaataaccccgatacatcaacacagcctgtgacatggaacatttctgtttcacaatcacctattacgctaagcttccctttcacatcgcaggattctccagtcatattcccgccaatttcagtctggcctttcagattgaatcgatcaaattgaagtgagccgctgactttcattgtcccatatatattgattttgccggctgtcagatcgcctttacattcactttctccgagcacacgcagccgctcagtctctgcttttccgagaaaaaggcccgttccgtatatgcggcagcctacagcagacagcccttctccaactataccttctcctttgatgctgacattgtgatacgcgcctcctgcggcatgcccagcgccatataattttaaatttcccagttttgttgtctccattacgatcctccttacaactttgtggatgtttcaaccgacgcgcttggatcacaggtatagtccccgctgtattcgacggtttcaatctggcaatccgggccgatgatcactttattaccgcgcacggttttcgcctttgtatttgtcaattcaatcacgtcaccttcgatcagctctgctgttagaacaggctgcggcatcaatctgagcaatgtcagcattccttttctgcaggtcacttgaagatggcggcagccgatctcccgcgcatagctttcccctgcagaaagcttaatgatcacctggtctgcatttaaaagcccgctgattttgcatttcccttctgattgaaaggtttctgtttcacaatctgcttccatgacagcttttccgctaatgtcaattccatcagccttgacagtgccgccaaatgttgatgatccagcgattttcaattgttttgcagatacctctccttgaataaaaccagtgccattcatccggatagattctgcttcaacgtctccatgtatctttcctgaaccgctgatagttaccgctttcgctttgacgctgccgtccgcttttccgtttccattaaaagaaaaagtgtcacactccacgtccccggccactgtcccgctgccattaatctcaactgattgaaatgttcctcccttagaacttcctgatccatttatcaccagcttttccactacatccattgatggccctcctgcataaatgttgtttttaattcctctgaagcttttaataaatctacccgttccacaacctttacggatgattcaaacaaaatgctgtccgccgcagccgctataaaacaagttgtgacaccgagcttgcggagcacaatcagctccgtctgtttttcaatctcttcagtatcatgcttctttaatacctctgcagccatttttgcttctgcaaggctgacatttccagactgcagcaggccctcaagcacaaacagcgaaagcaaatcgctggatgaaaaaaccggacttcctccgtcttctgaataggcttcaagagcaggccttgaaaccaaacctttatgaagcaattcatcagcggtcatgctgacatccttcattttcggcgacagcatttccctcatttcatccaaagacaaattttctttcatcttttgaatcattgatatacgttttaaaatctcctctctcggaaaaaacgtctcttgccctgtaaatgtggatttacgaataaaccattcctcaggtattaagtttttccgcttccatcgatacagctgaccgtatgaaatcgatgttctttcaagtaattcttttttagagattaattgttcttccataagtccagctcctttgatgggtacattgtaacataacactgttacgttgttaagcccaaaaacgaaacaaagcatttcaacatccgcaaaaaaacccgcccatcatcgatgagcgggtttttcactattttaaatcacggtaattttgctggcgcagcgcttcataaacaagaatcgcggcagtattggacagatttaacgatctgacatgctctgtcatcggaagacgcaggcagcggtccatattattttgaattaaatcctttggcaaaccgcttgtttctcttccgaacacgaagaaataatcctcgtcaagatcagtgtaatcaaatgatgtatgaggctgctggccaaattttgtaataaagaaaaacttgccttttttatatgcctcaaacaattcttctaacgaatcatgatacacaacgttaacaaactcccaataatcgagtccggcacgcttcagcattttatcatccgttgaaaagccgagcggacgaatcaggtgtagcgttgtattggttgctgcacaagtacgtgcaatattccctgtgttagcgggaatttctggttgatataaaacgacatgtaatgccacaatgttcacctctgtttttcttatccgcccatcattataacattaattactcttttgtcgtatcatcaacgatatgaaaaaaggcatatcgtattgacggcgtgtatgccgtagaatcctcatatgaccaatacctcatcctgctgtcataagtctgggcgttgacaagcggcatattgcctttgtcctttgccacgacaatcgttgtatgattaaaccggccgtctccttcgaagtcatagcaaatcacatcgcccggcatcagttcttccgctgatttcacccgcaccgcacgcagtccggcctttgaattcgacaaatacattttcatagagtgagccaccgtccagctgtagctccatgagctttgtttcatccaccagcctgatcccctgttcggatgaccgcgcatcggcgcgcctcctgcatgaagacactgagaaataaaatttgtacagttatcgctgaaatttttataagcaggattgcgcttgttccaaaatttctcggcatattggacagcgccgagacgatcgtattgaaaagccctgccaaacgcttctctttcctcttcagcttcagaatagtcaataatactggtcccttcatgaaatccagccggctttttcgcaatttcctgatcactaatcaaaatgtgatcatacaggaaagccattcgctcctctatgtgctcttctatatacaagctgtcatcttgttccttacacacgtattcgtaatggatggtatacgaaaggcaggtcgttccgtcatcctcaacccgcacatgattaatcacggcctttgctttcgcttttatgatgtcaactttacgtttttccagaagctttttcttacgctccatgactttaaggtctccgacttgagactcctgtctcatagcatgcccgttaaccagaaagcccagccgctcctccgctaattgttctaaaatgtacttcaagctcaccccacccgccatacttttttatagagaaaaaacacttggatgatctcaagtgttttttccttctgctctatacgtatgtcaggacaggccttgtttagtcatgcctgaagcttttagcaactcaattcctttttcaatttccagctttgcctcttcatccttctctttttccagcgctttttcaagctcttccgcgtaggcggggtctccgatttttccgattgcccatgcggctgtccccctgatgacaggacgcggatccttgtgcatcagttccgtcaattcaggcagtgcggaagcatccttaaaatgggcaagcgcgagaatggcgtttcgctgaatcggtttttttccgcgccaagaacctgagacatgcccgaatttctccttaaattcccgattgctgatggccaaaagcggcttcaataacggtttggcaatctcaggatcaggctccatttccggatgaagatgaaaatccttccctttattgagagggcataccgtttggcacgtatcgcacccgtacaggcggtttccgatttttgtccggaattcatcaggcaaaaatccttttgtctgggtcagaaaagagatgcagcgctgcgcattaagctgcccgggattaaccagtgctcccgttgggcaggcgtccaagcatttcgtgcaggacccgcacatatcttcaatcggcacatcaggctcaaaagggatatttgtgatcatttccgccaaatacacataagagccatactcgggtgttgtgatcatacagtttttcgcactgaatccgattccggcacgttccgcaacggcgcgatcagacaattcacctgtatcaaccattgacttcgttctgatatcctcatgcttgctttttagaaaatcctccagcagatcaagcttttccctcagcacatcatgatagtcttttccccaggaagctctgcaaaaaatgcccctgcgctcagttctcgtgcttctcggcgcatccttcattctggaaggatatgcgagagcaattgccactattgatttcgctttcggcaaaagaagcttcggcgtcacccttttttcgatatctggctcttcaaagccggagagatagccgagtgattcttgaagaatcaaacggtcttttaaactgtcaaaagtatcagcggtcgtaaaaccaatcttgtctacgccaatgcttttcgcgtattcaattaattcttctttgagctgataaacgttcatgttttgcacagcctcctttctttgtgataaaacgacacagcgtttataataggttgatatcacgtaactggagtgaatgctagtgaatatcaaacttgattctgttattactgaacgtgcggccggcttacatgcagctgctgtcatttatgagaatatcgaagtcggctcctcaccgcaaatgctgaaaggcagactccgcctgtttcaagaatccttgtttttcgactatgcggacggcggtatatccgatgaatccttcgtcaaggaatggcagaaactctttaaacagcttaacccttcatttgagggagaaacaaccccaatggaggacatgctggtcccgatatccaaggaacaattcatggaaagtaaagactcggcccatgacacaatcgattttttcgcattaaaatattctctgcctattatgatttatgatgccggaaagcttcatgagccggtccggatctcattgggagaaaaagaaaacatactgcttttctctgatgaaaacggcatttttggcgatttcaaaaacagcgtcaaccactatcccgtttcaaacgagactaagaatatgctgcaaatcatttttttcccgccatcgattgagaaaagcagcgctgttaacctcttatcatcattaacgaaaatgtttgaacaaattcacggcggcacccatacagtacattggcttacgtaaaagaacacgaataccgtgttctttttcacataaaaaaacgcaatacttcgtttatctgagaaacgaaacactgcgttaataacgtatgtatggagcgggtgatgagaatcgaactcacgacatcagcttggaaggctgaggttttaccactaaactacacccgcatttgtgattgtcagcaacagtaccgctctgactttttttatattacatgtttatttatttttcgtcaagggaatataaaaattttgtcgaaaaaaagttatctttttgtaaagttgttaagttccatttacataatgttaagtatactatacaatataatcaatcgagattgtgaaggggacagacgtcatgatgaaaaataaagtaaaagagctgagggcacgcttcggctattctcaggaaaaactcggagaaacggtcggcgtcacaagacagactgtggcagcgattgaaaaaggcgattatgttccctcactgctgttagcactgaaaatctgcaaagccttctccatgaaaatggaggatgtcttttggttagaggaggaaaactaagatgagcatgaaaacaaaagcagcttttcaccttgttttatttggccttgcatgctgggcgctgatttcatactttgaagcctcagaaggcatagcatcttttttcggcacaaagagcggcgggatggtatttgatttaaacctcactccctttattctgtttgttgcggcgtctgcggtttatttgtacttacagaaaaaaagccgccctgccagaaagcagctacttctgcctgatgagtttgaagagcaggatgaaagagagcagatgatgacggcaaaagcatgtcgcgcgtcatatatcgctgtctacttctcgctgcctgccgcagcggttcttctcattttttatccgctatttcaatcgcgcattccgtttttccctattattattgtgtttatcatcatgatcatccagcacctttcctacgtcatctctttcaagaaaaacgaaaaaaactccggcgcgctgtaatcggccggagttttttcttaccagcttgcttttttcacaccgggaatctggcctttatgggccagctccctgaaagcgattctggacattttaaacttcctcatatatgctctcgggcgccccgttaccatgcagcggttgtgaagccttcccggtgctgaatctcttggcagcttgctgagtgcctcgtaatctcctttttccttcaactcgcgtctaataccagcgtattgctcaacaagctgttggcgttttaactcttttgccacttttgattttttagccaagtcacatagcctccctttaaatcgaaattgttacgatttaaaatgtatcattcaccattcaaaaaagcaagcataccgctttgtaaaacagacggcctgaagccgcccattctaatgatgcaattccacataatacagtaacgcatcttgatgcttaatgagctcttttttatgttcagaggtgtgcattgtctcgtcagtccctctaatactgctgccgatcaaagcaggcttctcgaaagtaatcggttccggcgatgaaatattctgagtcatttcctgtgttgtgctatcgtcgcgtttcaccgatgaatcagccgctatagttccctgtttatccacaatgccaaaatgaatggtggtatgtttattctttccttccccctcttcattctcaaaataaacaaattgtatggtatcagttttttcctctgaataatctgcacgaaccggtccaaacctctcaacaagctttcccttttgataatgttcgatgtacatgtcagctgaagaaataccttcaccgatattgacggcttcggcagtgaatgcctgtgaagctgcgacatccattctgtttttttcaagatctgatatgtccgccgctttgatttccatctgttttgaatgtccgcatgctgacagcatagctatgaggcaaatgactgccgcgcttctcaatgttttcagaaaaaaagccccctttttttgaatatcataccatgttcggggggctgtattttagttaaactcatgcatttttctctttgacaaaataagtgtttcctaccgcttctccccttttgttctgaagctttctcgtccgatcattttcaaacggcaaaagcggaaatacaagctctgcaaaataatacgcttcttctaaatgcggatagccggagaatataaacgattctatgccgagtgcctggtactccgctatccggtcggcaatcgtctgcggatcaccgacaagagctgttcctgcccctcctctgaccaggccgatccccgcccacagattcgggctgatttcaagcttcgtccgatcgccttgatgaaggacggccatccgctgctggcctgaagagtcgtaacggctcaaagctgcctgcgctttggcaatggtgtcatcatccaagtggctgatcaagcgctctgccgcttcccatgcctcttgttcagtttcacgggcaatgacatgcagcctaatgccaaatcgaacggatctcccttcttttgccgcttgctttttgactctttctatcttttcttttacttgttcaggcggctcaccccatgtcaagtacacgtctgtatgctttgcggcagcttcaattccagcctgtgacgaaccaccgaaatagatgggcggatgcggctcttgctgcggcgggaaaagcagattgctgttttccacttttatatgctttccttcataggaaaccgtttctccctgcaaaagtctccgccaaacggttaaaaattcgtctgttgcctcgtagcgctcatcatggctgataaacaggccatcgcctgccagctcatacggatcgccccctgccacaacgttgatcagcagccggccgtctgaaatgcggtctagggtggatgtcattctggctgccagagaaggctgcattaaaccaggtcttaccgcgactaaaaactttaagtcctttgtttctcctgccagtgccgacgctgtaagccacgggtcctcgcacgatcttcccgttggcagaagaactcctgtatatcccagcctgtctgccgcctgcgcgacttgtttaaagtaaagatgatccgcagtccgtccatcactttcagatcctaaatatctcgcgtctccatgagtcggtataaaccaaagaatttccatattcatctcccctttatatcttttatccttcgtagctgtttctccactttaacagctttcgttcaagcagcctgacgaaggaatccgtcagctttccaaccactgcaaaaatgataatccctgcaaagactttattcgtttgtgaaaactgtctcgcatccatgatcatatagccgactcccgagcttgagcccatcagctctgccacaacgagcccgagccatgcaatgccgagcgataagcgaatgcctagcaatatattgggcagggctgccggcaatatcactttggatatctgctgatgccatttaaattcaagcacccgggcgacttcaaacagcttcgcgtcaaccccgcggatgccgttaaacgtattgatatagacaggaaagaaggcaccgagcgcaatcagcaaaattttagatacttcgtcaaatccgaaccataaaataaacagcggcgtgacggccagatgaggtacggttctaagcatttgcaacgacggatcaagatacagctccgtccgtttggaaaatccggccaaaatcccgatcatcaatccaagccccgcgccaagcaaaaaaccaagtgccgcccgataaatgctgatttgcagatggccgaacagttcgccggacaaaataagctccttaaaggtcagaacaatcgtaacaggtgtaggcagcactgtagcggacacaacccccagcccgccgatgacctgccagatggcaatgatgacagcgggcagtaaaagccccttcatccagccgtatctcttccttccgggcttttttcgcaccgcttccgcattcgttttgggcagcgagcccgcagcctctgctttcatcattgatcacctcctgaggaatgctcctctaatgcttttttgataaaagtgttatcgacaacatccttcacatcaatcttcttatctatcgcctttgttcgaaattgaaaatctgctgtttcctgctgtgctttcacaatgtcgtcactgatgatctcattaagtggctcagtatttttcagcacattttcgacgacctttttatcgagatctttaatgtcagaatataagtccgctgcttcatccagatgttccttttgccatacaacggctttattaaacaccttcagaaaacggaccacttcgtctggatgctcttctgaaaactttgttcttactaaagtaaaacccggtgaatataaatctgtgctttctccgttcacaaggatttttgctccgtgtttcattgtttctaaggacaagtacggctcccaaatggaccaggcatcaacagatccgttttcaaatgcggaagctgcttcatcaggctgaagctgaataattgtcacatcgttagctgacaaccccacttgatcaagcgctttatacaaaaaatcaaacccgctgctgcctttggcgactgcaattttcttcccctttaagcccttaacgtcttgaatgccgctgttttgattgacaaggatgccgtttgctttcaagccgtcctgagacaaaccgatttctttaaagtcaatgcctgccgcctgtccagcgatcacaggcgaattaccgacttgagaaaaatcaagtttgtctgccgcaaggccttcaaattggggcggaccgctttgaaactccacccatttcactttgatgccttctttttcaaatgcatcttcgaaccagcctttttcttttgcaatcaaaagggggcttaagctttgctgaataccaatacgaatttccttcaattgtttgtggtcaccgctggctccatttgctccacagcctgcgagcagaaaaataacggcaaccaatacaatgagtccttttttcatttccgcttccgccctttctatatccctgatccttctgcgtactccaaatcttctgttttctcgaattccgacagcactctctgtctgatcgcttggaaatccggagtcgtccggtttcgcggatacgccaggtgaatgggcatcagcttatggattttccccggtttggccttaaggatcgcaagctcatttcctaaataaacagattcatctatatcatgagtcacgagaatcatcgttgtttttttcttcctccatatatccagcagcacgtcctgcaggtgttttcttgtaaaagcgtcgagtgcaccaaacggttcatctaaaagcagcacctcaggctcccgcagcagggcccgggcgatggctactctttgtgacatgccgcctgacagctcgcgcggatatgctttttccgatcctttcaatctgacaatctcgatcagttcatccaccttttgtttgacttttgggtccttcaaattcaagtcggctgcaatattctgctcaacagtcagccaaggaaagaggcggtgttcctgaaaaataaatccttgctgaatacccggagctgttacgctgcggccgttaatttccacactcccgtcatattcagaatcaagccctgcaataatctttaacagggtgctttttccgcacccgctcggtccgataagcgttagaaattcgcctggtgcgattgataattctatgttttctaagaccgtgtttttgcggccttcttgaacaaatgccttttctttgatgctgatggtcacagccacttttatccctctctttctgccaaccccgccttcaaaaaaaaccaaaaggcccccatctctgttcttgtagagatgagagccttcggcggtccgatcagctgcccaattgtttttttgtttgaataacatgttaattcaaattattccgatatgtcaactcttttttaaatacgatttttgatatccttgtttatcacttactctgcttgtttcgcaaatagagaaggaaaaattatttctccaaaaattattaagtgtcataaaaagctgttacaacaaggtttttcaacaatttcgatactatatatcgattaatagagataactattttataataattataaaataatattgactttttacttagagatgatattatgttcttataaattccaagaggtgataacatgagttcaaataaactgacaactagctggggcgctccggttggagataatcaaaactcaatgactgccggttctcgcggaccaactttaattcaagatgtacatttactcgaaaaattggcccatttcaaccgagaacgtgttcctgaacgtgttgttcacgccaaaggagcaggcgcacacggatattttgaagtgacaaacgacgtaacaaaatacacgaaagccgctttcctttctgaagtcggcaaacgcacaccgttgttcatccgtttctcaacagttgccggtgaacttggctctgctgacacagttcgcgacccgcgcggatttgctgttaaattttatactgaagaaggaaactacgacatcgtcggcaacaatacgcctgtattctttatccgcgatgcgattaagttccctgatttcatccatacacaaaaaagagatccaaaaacacacctgaaaaaccctacggctgtatgggatttctggtcactttcaccagagtcactgcaccaagtgacaatcctgatgtctgaccgcggaattcctgcgacacttcgccacatgcacggcttcggaagccatacattcaaatggacaaatgccgaaggcgaaggcgtatggattaaatatcactttaaaacagaacaaggcgtgaaaaaccttgatgtcaatacggcagcaaaaattgccggtgaaaaccctgattaccatacagaagaccttttcaacgcaatcgaaaacggtgattatcctgcatggaaactatatgtgcaaatcatgcctttagaagatgcaaatacgtaccgtttcgatccgtttgatgtcacaaaagtttggtctcaaaaagactacccgttaatcgaggtcggacgcatggttctagacagaaatccggaaaactactttgcagaggtagaacaagcgacattttcacctggaaccctcgtgcctggtattgatgtttcaccggataaaatgcttcaaggtcgactttttgcttatcatgatgcacaccgctaccgtgtcggtgcaaaccatcaagcgctgccaatcaaccgcgcacgcaacaaagtaaacaattatcagcgtgatgggcaaatgcgttttgatgataacggcggcggatctgtgtattacgagcctaacagcttcggcggtccaaaagagtcacctgaggataagcaagcagcatatccggtacaaggtatcgctgacagcgtaagctacgatcactacgatcactacactcaagccggcgatctgtatcgtttaatgagtgaagatgaacgtacccgccttgttgaaaatatcgttaatgccatgaagccggtagaaaaagaagaaatcaagctgcgccaaatcgagcacttctacaaagcggatcctgaatacggaaaacgcgtggcagaaggccttggattgccgattaaaaaagattcttaatggagaaatgcaaaaacccgttgtagtcagcgggtttttttatatttagttacacattgcgtatgcttctcatcaatcttcatataaatttcttccatgagttccgcgctgtttataatctctcgtttgtttttttcaatcagcagctcaagcggcaaaatctgattcccgtaggtttttcgcttcctgaatcgttttctccccttttcttttttgactcccatcaataatcccccctttttcatacaaaaaaggcccttatctaaacgataagagccttcggtgttccgatcagcgcgataaatttgaaaaatttgtactgaccatgttaattcatacaataccgacctgtcaactattttttgagggtgttgacactgtatcagattgcatccccgctttttccttatacactcttttcccctgacgcataagctagagaaactagaatacgagagaaagagatgtgggagtgtggaaaagacaaaattgaccggacgtatcgtgacacgggatgatccggactataacgaagcaagaaccaatattaacctaagcttagaaaggtatcctgacatcattgtgttttgccaaaacaaacaggatgcactcaatgcgctgaaatgggcgcgtgaaaaccgtgtgcctttccgtattagaggcggcagacacagctatgagaacttttcccttttaaataacggtcttgttattgatttaagcgagatgaaaaaaataactgtgaatcaggataaaaagctggcctatattgaagcgggggctgaattgggagaagtctatcggacactctggcaatacggcctgacgcttcccgcaggcaccattgctaatgtagggctcacaggtttaactctcggagggggaattggacttttaacaagggctgccggtcttacttgcgacagcctcgtgcagcttgagatgatcgtagcagacgaaaaagagggcgctgatctgattacagtcagctgttcaaatcatccagacttattttgggcgtctcagggaggcggaggaggcaatttcggcatagtcacctccatgacatttaaagcagtgcccatctctcaagtgtcgattttttctattacatggggatgggatgattttgaggaagtatataacacgtggcagaactgggccccgtatacagatgaccggcttacatcatcaatagagttttggcctaaagaagtaaaccgcatagaagccctcggccaatttgtcgggccaaaaacagagttaaaaaaactgttaaagcctttattgaaagcaggaagtccgacaagcggaatggtaaaaacaacgccattcattgaagcggtaaccttttttaacagcccgggaggcaatcagcctcaaaaaatgaaacgctccggctctttcattgaaaagccattatcagaacgtgcgatctcaacaataaaacactttttagagcacgctccgaatcaaaacgccagtgtctggcagcaagcactcggcggggcagccggacgggtcgctcccgaccaaacggcattttattatcgtgacgcaatcatcgcccaggaatacttaacaaactggacatcccctggagaaaaaagcaaaatgtccgctggattgaggggctgagaacgtccctttcgaaagaaacgatgggagactacgtaaattggccagatatcgaaatcagaaactggccaagaacatattacggcgaaaacgttgaacgactccgccgtgtcaaaacgacatatgatccagaaaatgttttccgctttgaacagagtattcctccgcttcgacgctctctgtttttctaaaaaaatgaagatggagcattctccatcttcattttttttattgatataaattgcttcccgtatcgacaaactcttttgctttttcttttaatcctttatttatggcttctgcttcactgagatcgtttttcttcgcataatcccgaatatcctgtgaaattctcatgctgcaaaatttcggaccgcacatggaacaaaagtgagcggtttttgctccttcagcaggcagggtttcatcatggtattcaagggctctctccggatcaagagataaattaaactgatcccgccagcggaattcaaaacgggctttcgataacgcatcatcccggatttgcgctccgggatgcccttttgcaaggtccgcagcgtgcgcagcgatcttatatgtaatgactccttcacgaacatcatcacggtttggcagccccaaatgctccttcggcgttacataacaaagcattgctgtcccgtaccaaccgatcatcgccgctccgatcgctgaagtaatatggtcatatcccggagcaatatccgttgtcaacggccccaatgtgtaaaaaggcgcttctttacaaatgtccatttgtttatcgacgttctctttgattttatgcatcggaacatgtccaggaccctcaatcatcacctgaacatcatgcttccaggcaatttgcgtcagctctccaagcgtctctaattcagcaaactgcgcttcgtcattggcatcagcaattgatccgggacgcaaaccatccccaagagagaaagcaatatcatacattttcataatctcacatatttcttcaaaatgtgtgtataaaaagctttcttgatgatgagccagacaccactgcgccataatcgctcccccgcgtgacacgataccagttgtccgtttggcagtcagcggtacatacctaagcaaaacacccgcgtgaatcgtaaaataatccactccctgctctgcctgctcgattagcgtatcacgataaatctcccacgttaaatcctcagctacgccgtttactttttcaagcgcctgataaatcggaacagttcccacaggcacggggcaattgcggataatccattcacgcgtcgtatgaatatcttttccggtagagagatccatcatcgtatccgctccccagcggatggcccacgtcattttttccacttcttcttcaatggatgacgtaaccgctgaattcccgatatttgcattaatcttcacatgaaaattccggccgataatcattggctcactttcagggtgattaatgtttgaaggaataatcgcccggccgctggctacctcgtctctgacgaattcaggagacacatgctcacgaatggcgataaattccatctcaggtgtaatgatccccttttttgcatagtgcatttgtgtgacattttgacctgccttcgccctcagcggtttccgctttaatcctggatagcttacgtttggttttgcttttttataaccgttatcttctggttttatagcccgaccttcatactcttccacgtcaccgcgctctgtgatccatttttggcggagcggctttaatccttcttgaatattaatggttacttcagggtccgtatacggtccgcttgtatcatagacacgcacaggcgcgttttcctcttcgccgaacgatcccgtcgtcggactcaatgcaatctccctcatcggcacttggatgtccgaagaagaaccctccacgtataccttcttgctgcctgaaaaacttgacataatggaaatgttggcttgctgcactgaattgttttgcattacttttccttcccctttctacgtttgaaaggacaaaatcaagcccataaccagcacaaaaaaccggattcatataaatgaacccggttacagtcagaaagaaacatattattgcccagcaagacaataacaaaaacaattcctctacttccccacgctggtacgaaccagatcaggtccaaagggttaagaagcttgccttctctctcagcccgaaagcgggcacccccagtaactattgatttcgcactcatcttatcataaaatcaatctgaaaaaaagaggaatatagataatattcagccaatttcaccctaaatatttgaccggcaacgggatttcagctatttcatgttcagccatcatcacccgatatgcctttgcacccgaccttgaactcacagtctgaaacagctgatcatttatgaaatggagagcagccccatcatccgctgcatagccactgcataagaacttgttagatatcagctggtggtatgccggtctccgatccttttccccgtcataatggggacaaaagctcccttgcaaaaaacctaaacttttcaaacttgtcagcggtccggctgaatctgtcaccccttcttcaaaccagcagatcgcaccggcacttattccagctacaaccacaccgttcttccatgcttccctgagaatatggtccagcccccactctttccataacacaagtaaattccgcgtatttcccccgccaacataaatcacgtccatttccataacaaaagaaactaaatctgatgatggtggcttaaacaaagataaatgagacggcacgcaatccaatgtttgaaatgcatgataaaaccgctgaatatagttttgggaatctccgctcgccgtcggcaaaaaacaaatacgaggctgctctcgttttgattgattgaggatatattgatcgagggacaaattatccggctccatcgaaaaacccccgccccccatcgcaataatctgcttcatcatcacaccccccaacaaaatttgttgcttattatagcattttgtatagaagcaagaaacaaagtcaaatactttcttatcaggagctgctaaaaaaacaaaggaggtggtttcccattgaacaaagtctttgtcccaaagatattcttgatttgttaacaacaataaaaaccagcattaacaaatacactgtcgcaacaacagcaaccgaaaatccccacatcagaagagcattgcatgatcaattagatacagctgtttatctccatgatgaactgtcagatcttctgttagaaaaggggtggctcgggtgagcaattccaaatcgattcgcttttatcttacagcaaagaccacaaaaagagacgggatctcaaagatgagatgccgtctcttttttattgctccactcttcttaaagcctcatttaccgtttcttttataaacacgtcttcaccgcttaatcggtctaaactgagatcgccgtttctcagcctttcggaaatattgtttatatcctcctctactgtgatttgcagctcaccagccaaaaacattctgtgtaattcatctgcaaccaaactttctttattcacttccatcgactcctttattttcaatattattcttagtctgtccctaggccgagacgaataataggaaaaaagtatgaatcaaacgaatcttttttcctccttcttacgtatatctgttgagaaaaaagaaaaaggggaagatctaacatgtcattttttaagaagcttgcggcaagtgccggaattggagctgcaaaagtagatacaattttagaaaaagacgcatattttccaggagaagaagtacagggaacggtacatgtcaaaggcggaaaaatcgctcaggacatccgttatatcgatttacagcttagcacacggtatgtcattgtaaaagacgatgaagagcaccggaaatacgctacaattcattctttccgggtcactggttcatttaccatacagcctggtgaagagcatcaatttccgttcacattcactctgcctctagatacgccgatcactgtagggaaagtagaggttgccgtggtgacagaccttgacattcaaggcggtatcgataaatccgatcatgaccgcattttcgttgaagcgcacccttggattgaaaatgtgcttgaagcaatcgaaaacctgggcttccgtcttaacgaagcagactgcgaacaagcgccctacttccagcgtcgtcttccgttcgttcaagaattcgaattcgttccgacttccggatattatcgtcagatgcttgatgaattagagctcattttccttttagacgaagacggtttggaaatcattttcgaagtcgaccgcagagcaagaggactccgagggtggttggaagagatgtataatgacggagaacagcttgtacgcgtccgtttcagccaatcagagcttgaagatacagaagagctagaagaggtgctagaagagatcctagaccaatacgctgagtaagtataaaaaggagccgaggctccttttctttaataaaaataaaaacccgtttctgttaagaaacgggtttttcagtataccggtggtcggggtcgaaccgacactccagaaggaacacgattttgagtcgtgcgcgtctgccaattccgccacaccggcaagttttacgtcgtatctaaccgacgaatataaatatatcatggatctcataaagtgtcaacgtatttcaaaaaagtttttatggaaatataaaataaaagtgttgaaagactagctatacagccgctttataataggcctcggaacttaacttgttatgataaatcaaagcattaaaaaaatgatctacttatgtagatcattaatatgattagttataatgataaaacacaaacaccaattcaacttaccatgtaagtaaaattggtgccgagggccggacttgaaccggcacggtagtcacctaccgcaggattttaagtcctgtgtgtctgccaattccaccaccccggcaataagaaggcgacacccggattcgaaccggggataaaggttttgcagacctctgccttaccacttggctatgccgccgtaattggagcggaagacgggattcgaacccgcgacccccaccttggcaaggtggtgttctaccactgaactacttccgcatttttaatggacttaatacattatatgcagttgatataaaaagtgagactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctcaagatgtcataaatttggcaggggcagtaggaatcgaacccacaccggaggttttggagacctctgttctaccgttaaactatgcccctataaatggtggaggggggcagattcgaactgccgaaccctgagggagcggatttacagtccgccgcgtttagccacttcgctacccctccacattaaattttgaaaaaacagtgccggcaagaggacttgaacccccaacctactgattacaagtcagttgctctaccaattgagctacaccggcataggtggtggctcgggacggaatcgaaccgccgacacacggattttcagtccgttgctctaccaactgagctaccgagcctaagtattcaaatggcggtccggacgggactcgaacccgcgacctcctgcgtgacaggcaggcattctaaccaactgaactaccggaccattttaaaatttggttgcgggggcaggatttgaacctgcgaccttcgggttatgagcccgacgagctaccgaactgctccaccccgcgatgatataatggtggaggatgacgggctcgaaccgccgaccctctgcttgtaaggcagatgctctcccagctgagctaatcctccatcatataatgacccgtacgggattcgaacccgtgttaccgccgtgaaagggcggtgtcttaaccgcttgaccaacgggcccagactttcaattgtaattatgtataagtatcagtggcggagagcaagggattcgaacccttgagacggagttgaccgcctacacgatttccaatcgtgctccttcgaccactcggacagctctccaataatggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacaatttcagtgacatttaacattatactatgtattcttgagaaaatcaagtgtttttttgaaaaacttattctctcaaaactagataacaggtgtgacatcattcaaaaatatggttaagc

SEQ ID NO: 55 - DNA, 2966 bp, Bacillus subtilis WAUSV36; identical to SEQ ID NO: 41

SEQ ID NO: 56 - DNA, 308413 bp, Bacillus subtilis WAUSV36
ttttttaaaaactgaattaacaggtacgttttgtcttgtttagttttcaaagatcattttcacttcttgttgaagcgactttattaatataacattttgactttcttttgtcaaatgtttttttgatttattttcccgccgctgtgagcttgttttctcagaagcgcatcagcgacgtttaataatataacacggtcaagaatcagagtcaacaccttttttaaaagaatatcctcggtgatagacagcctgtcctttcgtttctatctggcagacgttgataagtcccttttccgtcaagtaatcaagcataacgccaagatcttgggtaaagtgctttaggtcatgatgttgaagaagctcaccgaattgccaaatgtctttttctttcattacttcgaaaagatgcgccgaaccgatctcggctttggaatggatgagaaaatcatttgctaagaataataattcaagtcttttttccaggctctcatgactttcaatcagctcggaatataatttgtacacttggggctccatctggcgcacttggctccacaccgtggtttcgggatggaatcctctgtcgattacttcaatacgtgctaaatgatgcagcgcatgaacaacggcattgtaggcatctaaaaattgattggcttcaaaaaaagctttcccttcaacataccttctgattaatttgccgtattcgagtccgatcttcagtttacgttcggcaaacggaaatgtattcagcctgtcaatcagttcaactacgtattcattacggtcaaacaagactctgccatttacaatccaatctatgattcttctatttgttccaagcaaaatccattcttgaatctgagaatctgttaccacatgcaaagaagctgtttgatgatcaaattcataatgctttataaaaactggctcatcagcatcctttacaatcaccagcaaagctgcatcaaagttatctgttaaggaagatgttttgtttcttctctcaatcataatgacagccaatgtattggggtgacttgctctttcttggtaaattggacggagaagattttccatcactattcctccaatgcaattgttcaaatttttttattctctatttgattcaattctatggttaaaacgaaattccttttttctaaacacattgaactattataaacaatttcacagtaactctccatatgtaaattccagttcaaccgaaaacatgaagaaaatcccatcgggtttgtgctatagttaaaacagagggggatggacatggcgaaatactccagcaaaattaataaaatcagaacatttgcgttaagtttggttttcgttgggtttatcattatgtacatcgggatctttttcaaagagtcagttttgctttctagtttgtttatgatacttgggcttttatccatcggtctcagcacggtagtttacttttggatcggaatgctttcgactaaagcggttcgcgtcatttgtccaggctgtgataaagagacaaaggttttaggagtagtcgatatgtgcatgcattgccgagagccgctgactttagataagggattagaaggaaaagaatttgatgagtcttataataaaaagaaaatgtcgaaataaaataagctgaccgtttcgtgcggtcagcttatttttaatgattttcttttttcgaacactcttggcagacgccgtaaatttctaaacggtggtggcttaccttgaagcccgtgacgtgggcagcgagctgctccacttcatcaaggcccgggtagtggaagtccacaattttaccgcagttttcgcaaatcgcgtgatagtgatcggatgtgacaaaatcgaatctgctggaagcatcaccgtatgtgagctcttttaccaaacctgattcccggaacacacgcaaattgttatataccgtcgctacgctcatgttaggaaatttcccttccagagctttatatatatcgtccgctgttggatgagccatagagttaacgagatattccagaatcgcatgacgttgaggagtaatgcgaactccggtttccttcaacgtttctaaggcttcttttagttcatgtgcagccatccgtcatgcacctctcttctaaaaaaaattcttacattgtaatgtttataattagtgtaactctttctacgataatttgtcaattgatatcagggtaaaagtaagcataggctcatagagatttacttttcagacatatctttgagggtttgaagcgcttcggctacatggtcctttacttttacttttctccattctttaatgagccggccttctttatcaattaaaaaagtggaacgctcgattcccatatactcttttccgaagtttttcttcagcttccacacatcaaatgcttccgccagcttatgctcgtcatcaacaagaagcagaaatggaaggttatgcttctctttaaattttccgtgtttttcctggctgtccgggctgacgccgataatgacggcatccagttcggcgaagctttcgtgactgtcccgaaaatcgcatgcttcagttgtacatcccggtgtcatgtcctttggataaaaataaagcacgatgtactttcctttataatccgataattttactgtttccccatgatcaccttttaactcaagatcaggcgctttttgtccgatttctatagtcattacgttacctccggatgtttttttattaagcgtatccaattcttgtccagattacaaccatctcagctgaatctgaagcccgaagccattgttcttgttcggaagcatgctacaatagaaaggacgcatggagatataggaggtttttattcttgcatacaaaatcaattgaacttcacaatgaggcattacagcacattgtcggcggtgtaaacagcccgtctagatcatataaagcagtcggcggcggttctcctgttgcaatggagaaagcaagcggcgcttatttttgggatgtggacggcaacaaatacatcgattatttagcggcgtacggtccgattattacaggacatgcccatccgcatattacagaagcgattaaaaaagcagcagagaacggtgtattgtatggaacaccaacgaaacacgaggttacatttgcaaaaatgctcaaagaagccattcccgctatggacaaagtaagattcgtcaattcgggtacagaagccgttatgacgaccatccgcgtggctcgcgcatatacaggccggacaaaaatcattaaatttgcgggctgctatcacgggcattcggaccttgtgcttgtcgccgcaggctccggcccgtctactctcggcacaccagactcagccggtgtaccgaaaagcattgcaaacgaagtgatcacagtaccatttaatgatatcgatagctataaagcagctcttgaaaaatggggcagtgaaatcgcggcggttctcgttgaaccgattgtcggcaacttcggtatcgtggagccgaaagagggcttcttagaacaagtaaatgaattaacacataatgcaggggctctcgttatttacgatgaagtcattacggctttccgctttatgtatggcggcgcgcaggatctcttacaggtgaaaccagatttaacagcactcgggaaaattatcggcggcggacttccgattggggcctatggcggcaaacaagaaatcatggagcaggtagctccgctagggcctgcttatcaggcaggaacaatggcagggaaccccgcttccatcctatcaggcatcgcttgtctggaagtgctcaaagaaaaaggcgtgtatgaaaagcttgatcaccttggcgctatgcttgaggaaggcattttgaagcacgcagaaacacacggcatcaccattacggtcaaccggttaaaaggtgcgctcacggtatacttctctgatgagaaagtggaaaattacgagcaggctgaacggagtgacggagaaacattctctacgtttttcaagctgatgctggaacgcggaattaatttagcaccttctaagtatgaagcttggtttattaccacagcacatacagagcaggatattaaagacacgcttacagcggtcgaggatgcatttaaacatctaaaaaactagaatcaaataccttgaacaggagctttgagctcctgtttttttatggaatcaaacagcgtgtaagattttggtctttttctagaaaaatagcttgaatatttgtatcgatccctgtatattacttaattgtttagcaaataaactaaccgggaattttaaggattagcccatttgctatgtcacacaatttactatagaaaggaatgcacgcacaaaccaatgaaacttggtgcccgcattttcaaaaccgggattgcgattacacttgccctttatttggcttcgtggatcgggcttcccgcgccgattttcgctggaattgcagcgatatttgcgatccagccgtcgatttaccgctcttttctcattattattgaccaggttcaagcaaatatcatcggagctgtgattgccacagtgttcggccttattttcggacccagcccgattatgatcgggttaacagcagttattgtcattacaatcatgctgaaacttaaaattgaacatacaatttcaattgctcttgtaacagtcattgcgatattagaatctgccggtgacgactttttaatgttcgcgctgatcagaacaagcacagtcatcttaggggtgctttcttcctttatcgtcaaccttgtgtttttgcctcctaagtacgaaacaaagctgattcataataccgtcgaaaacaccgaagaaattatgaagtggatcagattgtccatgcggcagtcgacagagcattcgattttgaaagaggatattgaaaaactgaaagaaaaaatgatcaagcttgatcagacatatcttctatataaagaagaaagaagttactttaagaaaacgacttatgtgaaatcaagaaagcttgtcctgttcagacaggccattattactgcaaatcgggcgcttgatacattgaagaagctgcatcgtctggaaaacgagatctatcatatgccggaagagtttcaggaaacattgactgaagaacttgattacctgctttactggcacgagcggattttgatgaggtttgtcggaaaaatcaagccgcatgatgacgcggttgaagaaggcatccggtataagcagcttttaacaaagtcatttttaaaaaatcagcagaatacggatgaggagcttattgattacaacatgctcaatattatggcaagcgccgtggaatatcgcgagcagcttgaacatttagaaacacttatcacaagttttcaaacgtatcatccgaaagactgcgaaatagaaacagaagagtaacccggttaaacagccgggtttttttatatacaaaaaaatcttatatccttcgttaaaaggatataagattgatgttttagttcaaattttgaatggtaaataagtgcttgtattggctctcatagtccatgagttcatcatgggttccgatttcaatgattgtcccgttttccatgacaacaatcttatccgcatgggtgattgtcgataaacggtgggcgacaacaaaagttgttctatccttcgccagtttgtccatcgcttcttgaatgtaatgctcactttccaaatccagagctgatgtagcttcatctaaaatgaggagcggcggatttttcaggaatacccgcgcaattgagatccgctgcttttgtccgcctgaaagcttaacgcctcgttcccccacccgggtctcatatccttctggaaaactcatgataaattcatgggcatttgcagctttggcggcttcgattatctcttcaagtgtggcatcaggcttgccgatcgcgatattttcccgaatcgtttcactaaataaaaaggtatcttgaagcaccataccaacctggttgcgaaggcttcttgcttcataatcgcgaatatccgtcccatcaatcagcagtctgccgcttgttacatcataaaatcttgggatcaggctgacgagcgttgattttcctcctccgctcatgccgacgagagctacagtttctcctctatttacttttaaggatacatcatgaagaatattttctttgtccttctcatattgaaacgaaacgttttgaaactccactcctccgcgaatctgatcggcctttatcgcatttggtttgtcagtgagttcatagggctcgtcaataaattcaaacaccctgtccattgatgcgattgactgtgtcaaagttgtagaggaattgatcagccttctaacagggttgtacattctgtcaatatatccgacaaacgcgaccattgttccgactgtcagcggtccattaatgacaaaatacccggcgcacgctatgacgatgagcggcgccaaatctgtaatggtattaacgaccgcaaaggttttcgcgttccaattcgtgtggcggatggctttatctaagaaatgaccgtttttctcattaaattgagcctgttcatgatcttctatcgcaaagcttctgatgacaggcatgccttgaatgcgttcatgcaaatgcccctgcacttgagcaagagcctgtgagcgctcccttgtcagctttcgtaaacggccgtaaaaatacttcactgatattccgtataatgggaataaaacgatagagatcagcgttaatttaacgtccagtgtgagcatgatagagattacaatcaaaatcgtcagcatatcgagccatatattcatcagccctgtgatgacgaaatcctttgtttgttctacatcattaatcactcgggaaatgacttcccctgttcttgtattcgcgtaaaaacgaaggctcagtttttgtatatggtcaaacagcttagctcttatatcataaagcaccttgctggcagtccactgggcaaaatattgccggtaatattcaacaggcgggcgcaaaattaaaaataaggcgaacatgatcgccataatcgtgaacaatgacgtggttttgtcactggccgtgccgcctccttgaataatgtcgtcaactacgtacttcagaagcaatgggagagcaagcggaatggagaattttacgatcccgattaacactgtaacgaaaatttgcttcttataaggtttgacgaattgcatgtagcgtttcataacccccacggttgattccccctctctctttatcatgatgtgtgtgagcccatgtgaaaaacctgttgtaccccgcaacaggtttttacgtaaccattattttgtatagcgcaaataccgttcataccacatatcgacaaactcgggcgcaaacggtccctgacgctggtgaatccaatggagcagcgtatttaagtagtctcttaaaatactgtcgatttcttttggataattcatggctttccgatgatcatcatattcgtcttcatcgagaatattgtaggtcatgtcaggaaaaaccttaacatctaagtcataatcaatatatttaattgcttcgccatcataggcaaacggagaactgatgttgcaataataatgaaccccgtcttccctcagcatcccgatgacattaaaccattgtcttgcgtgaaaataacagattgcgggctctctggttatccatgtccggccgtctgattcggttaccatcgtccggtcattggctccgatgacacacatttctgtactttttaagattgttgtctcattccaaattctatgaatcagcccgttgtgcttatagctgtgaatttgaatggtttctccttccttgggatagcccatatttctcccctactttctataaagccctacagttagtatgtccaaatttgcttaccgacaacgtcttttacctattataacgttacaaattgaaaaatgaaaataaaagagccattccggccggggaatggcacattcctgcactacacaaaggaagacggcttttctgagctgcgatatgaacgaatgacctgctctgtctgcttttgaaacatatcctgtatatcggcaaggtgtttccgttttaccgcaatttcagcctgaatcccacgcagccttgcatccctttccaaatgccggagttccgcctcaatttgtttgcagcggtcgagctctgattggagatcgagaagcttatccatcgttttcatctgttcacttaccagcttttcaaattcggtcatcggttcctccttcagcctgatgaaagtataaacatttcctcctttaatcatttcgatctccataaagcaaaccctttgactcattctgtagaccttccacaagttttgtcgtttttcaaacagaaaaaagcacttccacccgaagatgaagtgcttttttctgtttcagtgattagctgttttgttgtttgttttgttcagcagattggttttgctgtcttacctgctgtgcgtcagtttcactagcgaattcagtgccgaattgaccttgttgtccagctgattgctggttttgttttctgacttgctgagcgtttgtttcgctagcaaattcagtgccaaattgaccttgaccagcagctgattgttggttttgttttctaacttgttgagcgtttgttttgctgaagttatttgagttagccattgttatcacctccacggtcattagaatgtgcaggtgatcgtatagctattcctcttttttaaaaatttttaaacgagcagtgagcgtccgccgtcaacgataattgtctgtccgcggatcatgtcagccttggaagacactagaaactccacagtatcaaccatgtctttaatttcgaccatgcgtcccgccggcgtattttggcgcgcatcctcaagcagatcttctctattcgggaagtgcttcagcgcatctgtgtcgatcgctccgcctgaaacagcattgacgataatttgttttggtgaaagctcaacggcaagataacgggttaaagcctctaacgctgcttttgatacaccgaccgtggtgtagttttcaagatagcggatagagcctaatgaactaatgctgacaatatgcccgccaccgttcttctccattagcttggcagcttcctgagcgcagaaaagcaatgctttcgcattaatgttcatcgtccagtcccagtgtgtttcttctaattccatgacaggtcttagtactcctgaagcggcattattgacaaaaacatcaagtctgccgaacgtttcatcaatttgctgaaacatttctttgatttttgcaggctgtcctacgtttgcttttacgacaagcactttaacgccaagcttttcgatttcttccgctgtttctaatgctgcttttttgctgcgtgcatagttaatgacgatgttatagccgttctcagcaagtctgatcgcggccgcttttccgacaccgcggctgcttcctgttacgagtgcacatttattttgttccatttttcctcatctccttgtagcgtatagttcttttatttccacaaacaataatggcaagaactttaaagggggtcttctgttatgtatgtcggacgtgatatgagcgaattgaacatggtttccaaaaaagattggaagaacagtgaactcgcttattttcatcatgcctttcagcaaattatgccttatttgaacgaagaaggccaatcaaaataccgggaattaacgcaagaaattgaagcgcgcggcggaatgaagcgcaatgaagcggactacagccacggcacgcgcgtctcttacgattaagaatggtttacggagcagccgagatggcggctgcttctcctgccatcttccagattttttgatgtgacaccgggaacgcaaattgttcgagctcttctttcgttacttttttcagcttgctggtatccgacacttgttttactttaccgaaaaacactgaaatattccataccaggtgggtgaaaacatgctcgactacaccttgcagatcactgatatcagcttgtatgccatattcgttttctaagaaagcaatgagctgttcacgctcagttttgatccctttttgtgtttcaagattcgggaattcccacaggttggcgagcaaacctttagacggccgtttgtggatatacacttgtccgtcttcatcagtcagtacgatcgcggccatggttttgatcccgggctttttctttttgctttttaccggaagctcccgttcagtgccttcttcaaatgctgagcaatgctgctgaaccgggcaaagcaggcatgagggtgattttggcgtacagatcaaggctccaagctccatcaagccctgattaaattcagatggtttttctttggaaataaaagctcgtatggcgtcttcaaagatcgttcttgtttttggtttggcaatatcatcccaaatagatagaatcctggacatgacacgcatcacatttccgtcaaccgcgggaatgggtttattgtaggcaatgctgagcaccgctccctttgtataagggccgacgccttttaacccgccaaaatctttctcgtctggaggaacaatgccgccgtattcctgtttcacttcttttaccgcgctttgcaggtttctgactcgcgaataatagccgagcccttcccatgctttcagcaccttttcttcatcagcatcagcgagcgcttccactgtcgggaattgttctacaaaccggagaaagtaaggaatcactgtctctactctcgtttgctgcagcatcacttcagatacccacaccttatatggatcttggtcctctctccacggcaaaacgcgctgctctcgttcaaaccatgagattaaatcatcgcgaaattgctgtatgtctttttgttttaatttgtcttcaagtacgttcatatgtgtttctccccagtctttcgcgccccgcttttctttagactgttttttgttgtacactaagggcacagtacgataatatgttacattaaatagtaataaagaaaaagcggaaacatatgagaacgattgaatcagtttaaaaattgggtatatgaaaatggggaatttcttacaaagtgaatgtgcaggatcaccctgcaaggaggtcacctatggatacgggcacacatgtcgttatgggcatcgcactgggcggtattgcgacgcttgatcctgttgtcggatcagatccggcaatggctcacgctgttatgatcgcaacgcttgcgggctctcaggctccggatattgatactgtgttaaagcttaaaaacaatgctgtttatataaggaatcacagaggatttacccattcaattcccgccgttttgttttggtctgtcatcatcccggcgattctgtatttattttatcctcaggccgattttctgcacctgtggctgtggacactgctggcagtcgttctgcatgtctttgttgatatattcaacgcctatggaacacaagccattcgtccgttttcgaaaaaatgggttgcgctcgggctgattaatacgtttgatccgtttatttttatcagccatctggcagctatcgcgatttggtatgcaggcgggagtcccggcatcacgtttctcagcttatatatcatattggtaggctactacttggtgcgcctgatcatgcagctgagaattaaacggaagcttcatgagatgattcatgatgagatcgaaagcattattatttctccaacgatgaaattcaggcaatggcgaatcgcagtgacgacagcacatgctttctatgtaggaagaagcatggaaggacatgtcgtgattctggatacatttaatcgggtgcctgttcctgaaaccgatgtaatgcatgcggcaaagcaggatgataacatcgcggcgtttctgtccttttctccggtataccggtgggaagtggatacgtttaaagatcattatgaggtgagatttatcgacctgcgttatcggagcaaaggccattatccgtttgtcgcaattgttcatatcggccatgatctcacgattcgttcatcctatacgggatggatattcagcgaagaaaaacttcagaaaaaattaaagctcggctctatatagagccgggctttttacgtcttatataaaaaacagcaagcagcagactgacgagagatatgatcgccgatattttgaagtatggcggatagtaagtcagctcaatgtgattgtctcccttttgcgccttgaagcctataaaagcataatccgctttttcgatcttctgtgtttttccgttgatcttcagctcccagcctttttcatatgggatcggaagcatgatgtactggtcttttgacagatgataggaaaaggtcagtcgatttttgttccaattcagtttgtctgctttctctgttttattttgcattacagcgtttttcagcgtttggtaattttcttcatagagcgctatgtttctcagctcataggttcctttcggaagattgattgagatatggcctgatttaggcactcttaccgttatattatttactccggttttatagatcgatttgttcgatttccttgttgtgacataatcatttacctttaatgtaaatcctttgtcttttgctttgcttttcaaataaaagctgacatagtagtctcccggagcggatgatggctgtttcggggtgatgatcagctctcctccgttttctccagttacggttagcagcccgttttgatactgggcttgttttgcggtgatgtccgacttggtgatcaaattggacggttttggtgtctgctccgtttttcctgatggatcttttaatataattcctttcagcatcgcctgttctttcgcaagagcgggcaatcggtccagctcactttcgctgtatatggcatccgctgttttaacgaatggaagcatgtactgattctcataaactgcataatgctctgtttctaaatgctttttgaagccgtacgggacgctggcttcgtttgttttttcggtcatataatatttgccgtaaagcaggctgtataaattcgccctgtctcccaatgacgcgtaacggctgacgctttccctgcccatatcgatgcttaaatcattccaatagaaggccagcagatctttgtttaaaatgctggaatacgcgctgaagccattaaatccgtaaatgattggcgtattattgcggaccccgttcatccagtcgattctcatgagcgggtcatcgtcttccttctgtaaacgtctgatgagctcagatgattcccgccctctgtattcctcacttgtaagatattcttttgtcacactgtccaaatcgccgccttctgagagcgcgtatttttgataggagttggcgacaaacagcgaagaaagaatgattataccgtacacagccatttttgcccgttttttcgcaaaagctgcagcaaacaaggctgcgattgtcatgagtaagagcaatagaatactttcattcgcaggcttccatatatcgagcttatacctttggatatgatacaagtaaagaagcaggacgacagctgcggccgggagcagttctttccgtttcaattcagacagctgtgacaaaccagccgcagctgctcccgcaatggtaaaggccagaacatattcaaaccggttttgcggggcggaaaaaccgttaaagacgcttgccgcatacggactgaaatgaaacagaataaacagcaggctcaacccggcaaagagacgaaacacacggtttttgtaaaaagaaataataaacaaaaacagcagaaaagcggccggcacaatgatgatccggctcgaaaataagatattatcatcgaaattgagccactctattttctggctgtatggagggcgcaggttgtttaaaaaaccgtatactaccggcacaaacgccgccgcactgatgccaaaagaaatgaagcctgaaacgagaaataatctgatttgaatccatcttttctcttcatgtggttccaaacggatcagccatctgaacagcacatagattccgatgaatataaggtttatgtatgcaaagtaaaaattgttgattaacgtcagcgaacacgcaacgataaaccacgccggacgccgctctctaataattttttctgcgccaagcacaagcagcggaagccaaaccattgtatcggtgaaaaattcccaatacgcttcgtgacggaaataaataattgagacgccgtataacacggctcccgtgaacgatgccgccctgtgcttaagaagataatgaaaaacagaagcggacgtaaagatgatcaagctcaatttgaaaatactgataaaaacagctgactctgcccaaaaaagcgtatccgtttctccgatcagctggacggcttgaagcagccaaacagcggcagacacagcaagaaaaagaaaagacgcagaaaaataatagccgagctgactgaatgtgccgccgccaagtccgaatgaataattgtagaaaaaattcccgtgtgtatattggtcaaataataattttttaaatacgatcatttgcgcaagcccgtcacccggacctgtcatatacctgccttccgcccattctttcacaaaaaaagcgtgtgccagaacggacaccagcaaactggccgcatagatcatgatatgttttcttttcatatgaattctccagtcttgcttttaagataatagacacgcaaaaaaagcactgccaatggcgcttggtattttcagtgcatttttgtcagacgccgcatgctttttaattcgttcgtttcaggcaggtctttgttcgggatattcgcctctttgatcaaataatgcgggcgtttttttgtttcataatagattcggccgatatattcacctattattccaagacttaacagctgtactccgccgagaaataacactgctgagataatggtgaaatacccaggcacagaaataccgttagtcagaattttaacgaatgtggcaatgatataaatgatggaaagcagcaggatgaaaatgcctgtataaaaacataatctcagcggcttatgattaaatgaaacgacgccgtccattccgtagttaaacagactgctgaacgaccatttggaggtgccgttttttcgttcgacattttcataaaatacaattttctgatcaaagccaatccagcaaaaaaggccttttgagaagcggtttccttcgctcagcttcaaaagtgcattcacagcttggcggcttaacaatctgaagtcaccgacaccgtcacgcaaatcgacttccaccgctttattaatgaacttgtaatacatagatgataagagtgagcggacaaagctgtccccttttctgttcctttgggcaatgacttggtcatacccttcttcgtagcctttgataaattccttcagcaaatatgtcggatgctgcagatcggcatccatgacaataaccgcctcgccctgaacatgctcaaagcccgccaaaattgcggcttcttttccaaagtttcgagaaaaagatatatattttacccggctgcacgtcgctgccaagtctttgatctgctgaagcgtgtcatcaacacttccgtcgtttatgaagaatatttcatagtcataatgaatgtttttaaattccttttttaaagattcatgaatgagtttaacattatacccttcattgtaagacgggataataatcgagattaatccttgcttcattaaggcaccttctttttattattctttttaagtattgccttaggggagttttacacaaatcttcagtaaggctattccttttttaaagtcgtttaaacctgttttttgttacaattttatggtgacattcatgatttttaatgttattttgtcatgtttaaaacagactatgaaaaaaaacgcacagaaaaagtctgccattatgacagacggatggagagaaattttagcttattggttcttaagatattccaaaatcagctgattgacgatggctggcttttcgtggttaatccaatgggaagcttcatcaacaaagatgagatgtccattcgggcaatgcctttccgtctctttcgcaagctttctgctcaaaaagcggtcttccattccccagatcattcggtaaggtactgtttcgtaagagggtttctctgccaagcttccttttctgagggctctgtaccagttcagcatagctgtcagcgcgcccggctgcttccacgcttctttgtacctgctgacatcctcggatgtaaaaagcgcgggacggtcggataatccaatcgctttgtctaatgtatcataatcattttcccttagtgatgcctccggtatatcgggcagctggaagtatgcgatatacgagcttttcagccattgcggcggataaagcggcgttacggttttcatgacgtgcgggtgcgggatattgatcgcgatcagtttttcaagatattccgggcgtgtggaagccaaatgccatgcgacagctcctccccagtcatgaccgatgacaattgctttttcatcagtgaattgcgtaataagcccgatgatatcatctcttaatgtatcaatccgatacgaatcaattccttccggtttgtcactgagattgtagccccgctgatcaggagcaatgacccggtaacccgcatcaacaagcggtttgatttgatttttccagccgtaccaaaactcaggaaatccatggagcaggacaattaacgggccatcttcccgtcctgcggctgcaacgtgaagcgtgattccgttcgtattgacaaactggcatttaactccgtccacttctatctcctccttgactgtgcgtcatgattttcagccttttctccgttagcataaatgttatgacacaggcggcaatcagcaggataagctgaagaataaacaagtttgatcccagcagcaaacccattcccgcaatcaccaagcctgacaggatcattaatgatgcactgtaacggttcgcttcattccataatctttgatctgacattgagcgtctcgttctgtatccgtacacactgttgatcgatttgggaggaaacagtttgatcagtatgcccgcaatgatcataagccctccgccgactaaacccgtcatatcatcatctcctttctcattgttacgtgcagaaagaagaaatgtttcatgcataggcaaaaagacaagcctcggcctgcctttttatcgcatttgtaaatcctttgtgtgaatatagcctttaactccgccataatccacgaacgcccaagtgaagtcaaatccgccgttttcactgaatccccacccaagtattgtcacctctgttccagatgagagctgcttagcttttccgttttcgggcgtcggtgtatagaaggctgtctgtttcgttgttttcgcttggcttgcggttttcattaaaaagtgagttgaaatatatgctttctttcctttgaaatgaatttgagcccaatcggcatttacgaacctatcgacttttaccttttgttctgatgatacagtgccgagaatatcaccttcatgatttggctcagtccggacattcagctttcctgcttttatgatgtaagtatcggatgatggcatgctgacagatatgtcgtgaaggggcgcagcttttgctgcgggagcggaatgaagtgctgtcaaacccagtcctgcggcagctgttaaagcgagcattacttgtttctttttcatataaagctcctcctcgcattttgacaagatataagtggtattccctgattgacaggctggtgaaacatgttttgtttatgatttcttcctgttaaggtaattttaagaaaatgaaaaaacctgccggtcgttaacggcaggtttttaatgcaaaaggcctctgctttgatttaagtaatcattcacgtcgttacgggagctttgaaaaaggtggagctggccgccatagttttcaatccattgtgtgacgattttttcagtcattttttcaccttgataggcgtgtccggcttttgcgtaggttgcttcgaaatcgctccataacaattccacccacgtttttgcctgtatatagctgatcatctcgttcttttccagaagcagattagtcagtttctcaatgtacatattcatgtgtgcagtctcctttcttcaggaaaaaaataacgctttattacgtggtgttctccatatactaaccttacgtcttcatctgaaaagacgcaactttttgatctcgaacctagggggatatgacatggtccgaaataaagaaaaaggatttccttacgaaaacgaaaacaaatttcagggtgaaccgagagcaaaggacgactatgcttcaaagcgtgctgacggatctatcaatcagcatcctcaagaaagaatgagagcctcaggcaaacggtaaagaagaacagctgcatacactgcagctgttttttaccctttattgacttgatattcgtagacgctcttcttttctgataagtgtgcgaaggtagaaagcacaagtccgcatgcggtcataagcgcacctcctgcaaacagccaggaataagagcctgttccgtttaaaatcattccgccgatccatgcaccaagggcattggcaaggttaaatgctgatacgctgacagctgcggcaatggttgtgccgccctcagatgaggaaatgacctttgtttgcagaagaggcggcgtgccgaatgcgcatgccccgaataggaacgttgccacaatggctgcagccgggtaaatggcgatgtaaggaaatacagccagaacaccgattaaaccgatcattacgccgatcatcgtccgagtcagcaaaggcagcggtacctttccagcaaagaaattcccggcaacgcctcccaatccatacgcaaagagagcacctgtaatgccaaccgtgctgaatccggctgaatgcctcaaaatgggttcgataaaggtgtaggcgataaagacaccggaatagcctaaaatggtaatcgcgaaggaaaacagcacttgtttgtgtttaaaaacaccccactcattcataagcattgggatcacttttggttttctgttcggcacggcagccataaggcctaaaaatccgatgacaccaagtgccgtaatgatggaaaacaccgctctccaattcaggacatctccgagataagagccgaatggaacaccaagcattagagccactgtcagtccgccgttcattgaagcagcagctgcagcacgcttttccggcggaaccatttcacttgcgaataccatggcaatcgcgaagaaagcgccgtgaatggacgcagataaaattcttgaaatggccaataccgcaaaattcggcgccagtgcgctcatcaggttggaaaggataaatatcgccatcagcccaagaagcacaggctttctcggaagcttgacggaaatgatggtgacgagcggccctgtcaaacaaacgcttgccgcataagccgtgacaagaagccctgcggatgaaacctgtatatgaaagtcattggcaatcgacgtcaaaatacccatcaccgcgtattctgtatagccgattgaaaatgtacaaatcataagaacaaatataataaattttacagatgggtttttgatactcaacgtcatcgcctcctttgattttaaaaaacaacgagtttcatcttaaaagatttttcaagtgaattcaatgattttttctttaagaattcgtgtaaatgtgctgcaaacaaaaagaggctgatcatcagcctcctgttacgctttattctttttcttgcaatactgagattggcagcgcttcctcttgctgaggggaagaggtcctgtatccccatgcgaaaacgccatttaaataactgatggtaaactcgtcctcagtgttttccacacgatatgtttctcccggtgagtaatcttccgggttcagcaaatatgcttttgccatcgtaattttccgttcgagcactgccagttcgtttatgattccatgctgttcggcttttcttgctttttcagaaagtaatgcgatttcggtattgagttcatgcggtgtcatttgactgtatcgtttctccatttcagtactcctcttcctgcagtaattgctcgattaaatcgagtgagaatcctttgcggaataaaaattgtttgaccttcatggcgctttcatatgagccgtcatagcggtattttctaaacgctttttccgcgtgaaggcgcagcgcttctttctctgtgtcttcatcattttcatattcaatctgatccatcgccgcgctgataacatcaaatgagaagcccttgcgctgaagctgcagctgggcgcgctgtttgagttctttcgtcgaaagctttttatcttttttgagaagcttttcaacatgcttgaccgcttctcttgtctgatcttcaaaggaaaaggaacttagcgcctccttaattgtatcgtcatcaattcccttcgctcttagctctctgaacaaaacatcagggccttttccgtttgtttttttgtgagtgctgacataggctgcggcaaattcctggtcgtttaagtacttgtaatcgttaagcctatggatgacttccgcaatgacggggggcgaggtttcttttttctttaagtgatcctcgacctctttcgtcgaccgcattcgataggataaaaagtcaagcgcacggttgaagcctttcttcacttcatcgccgtattgaatctcaatgatgtcaagatcatcgagttcttttcccttcttgagctcaaatttcacgagcacatccgcgtccacgctgaaggcgtatttatcatccagaaaaatattgaagcgttccgtattctttttttgcgttgatatttttgtaataaacggcatcttaatctcccttctcaggcctgaaacgcgttttcttttattacaatgaggtaaagtatatttattagaacgatgaggagagatgttcatgaatatcgcaatgacgggcggaaccggttttctcggccagcatctgacaggcgttcttacccgccagggacaccatgtttatattttatcaagaaacgcaagggaaactgaacaaaaaaatatgacatatgtccaatggctgtcggaaggagccgcaccggagcaggaacttcctcatattgatgtctggataaatcttgcgggaaaatcgatttttggccgctggacagaaaaaacgaagcagcacattctctccagccgtatcaatgcgacgcgtgaagtgcagcggcttattcagaaacagaaggagaagccgaagacattgatccaagccagtgccgtgggcatttacggcacaagccttgagaaaactttcacagaggattctgcaacgtcagatgaggattttctcagccatactgcacacctgtgggaaaaggaaggacagcatattgaagcgatgggcatccggacagtttatgcgagatttggcgtgatgcttggagaaaaaggcgctctcccgctcatgattctcccctataagtttctggccggcggaacgatcggaacgggaaggcagtggctgtcatggattcatgtcgaggatgcggcccagatgatccgatatgcggtggaaaacgccggcatctcaggcccaatgaatgtcaccgcgcccaatcctgtggacatgaagcaattcggaaaaacgattgcacgggtgaagcaccgcccgcactggctccccgtcccggaattctttttatcaaaagcattgggtgaaatgagtcttttgattgtgaaaggacagcgcgctcttccgaaaaaagcgataacctctggatttcgttttacatattcggatcttgaatttgcactctcacagctgatagcggaccgaaagactgtataaaaacagcaggaagcgtcaaccttaagaataacatggttgaaggaggtcctttttatggaaaaaaagagggagaagcaccagcaaggcgccaacctgaaaaaaatgcaggaagttctttattcaggcgaatttaaaaaagcggaaaaagctgctaagcggaagtaggaatacatagccccttaaaaccaaatactatatttgtttgatatcactttttagggggaatttgatatgggcagaaatcatatccacaaaaaccgtgataaaaacaaacaaaagcttccacaagttcccgatgccttaaaaagggaaactgacggcgtttacgaagaatattcaaccgagcttgctgatgcagatgaccgcgaagcgcaagagcgtgcgaaagcagccgacaacagagcgaaaaagaaatctcgttaatgaaaaaccccttgtctccgtttgagacaaggggttttttacatttcagtgaatcggtcgcggatcggtgtgcgttttttcacttccggcgcctcgtcaggataacctgtttgtatgatggcggcgaaacgctcattatcctgtaaaccaaaggcctgatggacttctttgtcataaaggatttttccgcttttccaaaccatgccgattcctttttcccaagcgagaagctgaagattttgaatcaacgagcttgttgccgcaaaatcgtcgtcccgcgctctttcgttttcatcttcctgaaacacgacgaggagaaatcccggaacgcgcccaagtgtgtttttgaaattttgaagcttttcctctgtcatatccggcttggatttcttagagaacgctgcaaatgtattaatgaggttcgctttacctgtctcactggaaacgtaaataaatctccatggctctgtcactctgtgatttggcgcatattttgccgtttcaagcatgtcaagaatgactgctgaaggtactggctcttgtttaaactttcgaatcgatcttctgctgcgtatgatgtccctcagtactgaatgctgatgtatttgttcggtttgaggcataccgtctcaccttcctatgcaattgaaaatgattatcatttcataatgataacggaaagtgcatctttttgtaaaccatcatccgtattagattttaagaatacgggtttctgagtaaacggctgttcctgtcatgttcactttcacatggccgccggcttcgttcatttcgatctccacttttccgtcttttccaatttcctgcccttgttcaatgataaatttatgctgctcggcattgccataatgtttcatataagcccccatcacgccggatgctgtgccggtcacggggtcttcaatcgttcccgaatacggggatgaaaagtggcgcccgtgcaggtcgctgtcgggatggacggtttcaaaggtaaacggatggactgaagcttttggcagatcaactaacacttccggaaattgtttgttatctggcaccatttttttggaagcctccaatgatttaagcggaacgatggctgtccatatcccagtgctgccaaacacaatcggaaggtcttcatgaaaatcttcatcggtgatacccagtgcgtccgcaagttttttccgatcgcctgtaaatggtttgaattgcggagaggcctgttcaagcgtgatatgaatgcggccatctttttcagaaatcttcacaggcaggatacccgctttcgtttggatgctgtacgttttaccgctctccagcattcctttctcacataatgcgtaaagagaagcaactgtcgcatgaccgcacaaattcatttcgtgtccaggggtaaagtaacggagttcaagatcggccgactcgctttttcggataaaggaggtttctgaatacccggcacgttcagctatgatctgcatctcgtcttccgtataatcgtctccctgcaaaacgacgcctgcggggtttcctttgccgggactgcttgtaaatgcttcatattttaatacctctgcttctttcattcatctgccgccctttctttatcaatgtctctgtcagtatagcaaaaataattacgaatcttcagtcattatcaaaaaaacccattttcttttttaagaaaatgggtgtaacgattaagaatttcttgttttatagagcaaataaataaaataaggtgcgccgatagccgctgtaaagacgccggccggcacttccaccggagcaaataaggttctgccgacgatatcagctgttaaaacgagcagagctccaataagtgccgacgctgggagcagcgcgccataagatgagccgacaagccgtcttgcaatatggggcgccatcagcccgacaaaaccgattgtgccggcaactgaaactgcacaaccagtaagagccgtactcaaaaggagcaagaaaaaacgatttcgctgcacagcgcttcctgcacccgccgcaatatcttcacccagcacctgtatattcatattttttagcgcgacaaaacaaatgaataagagaatgacagataagataatagctatttttacatgctgccagtttgacccataaactgacccagtgatatacacattggcttgtgatgctcggtaaatcgggcctttgatcatcaacagggtagtcatcgcctgcgccgacattgaaaatccgattccgataagcaccagccgaaatgtggaggcgccatttttgtatgccagtaaatagacgatgagcccgacagccgatgcgccgataaatgcggctgctggaagccatgacagactgatcgtaagtgaactgctgcggtctgagaagaacatcattaaaagcacgaccgctaccgccgctcctcctgttattccgataatatccggagatgcgagagggtttctgacgagcccctgcaatatcgcgcctgccgctgccaagcagacaccggcgcataaagccgtcaaaattcttggcatgcggaacgacatgatcatcagttcatccagcttggaacctgcaccaaagaatgtttttgctacatcccagggaggaataaacctttgtccgagaccagcgcttatgatgagtacagcagctgttaaccccagtaaaaccaaaaagacgatccatgctttcttttcagccgcagtaacgccaaaacgaagtttcatagcttcgccccccttcttgcgatgtacacaaacacaggcattccgatgatggcggtcatgaccccgacaggaacttcctgaggcataatgatatatcgcgcaccgatatccgcgcaaacaagcaaaatggcacccaaaacagcggaaaatggcagaacccagcgataatcattaccaacgacaaagcgggcaaaatgcggaataatgatgccgataaaagaaatcggcccggcaatggcgacagcggaccctgcaagcatgacaacacaaagcgccatcacaaatttcagcaggcctgttttttggccgagtccttttgccacatcttctcccataacgaggagattaattttttggccgagaaagaagcagattaccagcgctgccgctgcatatggaaacatcgtcatcaacagatccagactccggccctgcacagagccagtcagccaaaaaagcacctgggcaagctcgagttcgttgacagacagcaagccctgtgtcagagaagaaaacatggctgccatggcagctcccgccagcgtcagtttgattggcgtcagcccttccctcccaagcgagcctgctgcatagacgatcgcagcggtaaatgctgcccccagaaacgagctccatactaatgcctgaggtgactgaatatgcagaaaaaacgatccggcaacaataaaaaaacctgcaccggcgttaatcccgaaaatccccggtgacgcaagcggattttttgtgagcgcctgcatgagagcgcccgcggctgcaagcgaggcgccgacgactgtcgcaaccaaagcgcgcggaagcctgacatccttgatgatgacatgctcatttgttccattgaaggaagtaaacgcctgatagacctgtctccatgacgtacctgtatagccatacacgacgcttgcgcagacagccgtcagtaaaatgaaaatcagacatactaacacaatccattttgaagatgcctttttgcagatcatgatctaattctcctagttatttactatgtaatgtttgtttttgagaataatcctcaattagggattgacactcttaacactgcttattatgatctaaatgataatgaatttcaatattgggaggaaaaagatgaaaaagcatatcagcatgctattcgtatttttaatggccgttatggtactttctgcctgtaatagttcagaaagttcaagcaacagcgaggtgtcaagcagcaaaacaagaacggtcaaacatgcaatggggacatcagacaacatccccgccaatccaaaacggattgttgttttaactaatgaaggaacagaggcgctcttagcgcttggcattaagccggtcggagccgtaaagtcatggaagggcgacccgtggtatgactatctgaaagatgacatgaaaggtgttaaaaacgtcggtcttgaaacggaaccgaatgtggaagccatcgcagaattaaagcctgatttgattattggaaacaaagtgcgccaggaaaaaatttatgatcagttaaatgcgattgcgccgactgtttttgctgaatctttggccgggaactggaaggataacctgactctatacgccaacgcggtgaataaggcggacaaaggcaaggaagtcattgccgattttgataaacgtgtttctgatttaaaaaacaagctgggcgaccagacaaacaaaaccgtttcagtcgtacgctttttatccggtgaatcaagaatctattataccgattcatttcctgggattattttagaccagcttggcttcaaacgccctgaaaaacaagtggaactgtttaagaaacaaaaggaccaatttacgttctcaaccgacagtaaagaatctattcctgatatggatgctgatgtgctgttttatttcacttataaagccgataatgcaaaagaaaatgaaaaatgggccaatcagtggacaagcagttcactatggaaaaacctgaaggccgtgaagtcaggtaatgcacatgaagtcgatgacgtcgtatggacaaccgcaggcggaattaaagccgcaaactacctgcttgatgatattgaaacctacttcttaaaaacgaaataaaaaaagactccgtcttattagacggagtcttttttgcttttgccaatcagacgtgtaacgaggaacatggtgacagaaagagatctgtttttccgatacgctaagtatttccctcgccactccggtttatatttttctttaaaggctcttaggccgctgaaactgtacatgtatctgacattattaaaaatgacagcggcaaacctttcggaccagaaggatgtaaaggcagtgccgacattggccaagggtgccatccccatattaaatgacgtacagccctcttcctttgcccataaaaacatacggataaacaatgcgtccataatgccatttggagcgtcgccgcgatagcgcatcagatcgaccgatatctctccttcctggtacatcggcatgacatttgcgaatgcaacgatctctccttctgcatttttcatataggcgatcggcgctttctgtaaataggaaggatcaaaaaatccgagcgagaatcccttctcttttttcgagccgagccattcgtctgagatttgcttcagctcctccaaaaacgcatcagaaaatgggggatgatccacatggaaagtatactcctcccgctcaaagcggttattgattgcccgaaggccggcttttttcttcccagtcaaggtaaatgtatttaaatctacatatgcttcctcacccaatttaaagaagttgtagccaaaatcgtgatacagcgccatgtcctctcgttcaatttgatagaacaaaacactgaatcccttctgatgcgcttcgttcagaaattcttccagcacgagcgggaatgattctctttggccagatggatcgccgagcacgaccagccttctggcgattttcccaaacagaagcagtgcatttccatcgctagaaaaataaaaccgcttatctccaagaaaaccaagatggctcagcgcgttgccgcctttttcattgagaaacgcagcaagacgctcagggtcagctttctctccgatcggtttcgttctcttatgatagaccactgtaaatatcaagaagaacagcggcacaatgatgatcgccatgatggttgcatgtgtaatatgcgaggtgctgtggacgaaatattcgtgacgcagcaccttcttcatccggtcccaaataaagcccgcgatcagattgtagttaaagagcgccacagtaaacagcgccacagcgaatatcaattgtcccagtgtataggatgcctgttcgcggacaaattgttttttcaatagcacaagcaatacgataatcatcggcagtacgaatatcgcgctgatgttaagcccttttaaaaagctgaacacaaagccgccgacaagcgctgtaatggccatcgtgtaggaacgttttgtccgtttataaagctcgatcggcaaaatgagcagaatgagcgctgagcttaaggacaggccgttgaacagcaaaagcgccgggcgcggaatgtgcggtataaccgtcagcctgtcaatcggcaaggaaactgaggccaagacaatcagacctgctacgaacacaataagggaaagcgagccttgcaaaattctcactaataccgcacgctgaacaacaagcagaacgtttgtcgtctcaattgccggtgcgatgcgcgggttcgtttcgagccgcttcattgtattttccgtcaggtcgccggcggcaaagaacagtcccaagataaatgggataaatgagtaggcgagcctgtacaacacaatagaagtaacgatggcctcttgatgatagccaagctgctccatccccagcaaaaataaaaggtcaaacgagccgaagccgcccggcacgaggctgatcattcctccgatcgccgcaatgacgaacaccccgaacacatacctgatatctgcatgaatgcccatagcgaacaaagcaaaatagatgacggtcccggccatgagccattcaacaactgaagctccaatatatgcgaaaatcggatttttcactttatccgcattctcttcgtccccagctttgcggtcttttattttggacaccgctaaagataacggcaatatcagtgcaaaaccgataacgaccgcccacagccaaggcttctcatgaatcacttcatcaactggcagcactctcgcagcaacgaaaatgctgaaaacagataatccgagcagcatagatgatgtgagccaggcgattcctttcacgagtgccttatggtctttcgtatgctccttatagaacatcattcttaacccgactccggctaaaccgccgaatcccaacacattattaaatgaattggcgatccaggaaaccctgaaaacttttccgtttgtgatcgataggcgcagtgagtacttcaggacgtaatcatacagcgacatagccgcaacagccagcaagccgatcaacacaagcatgaataaatccgttcgttccagtccgttgatgaccatgagcgtacgtttgaatgacagatttgtcagttcttttttcgattgataaataacaaatagcaaaacagcaataggaaaaacgatttttaatattgataaagcattctttttaatcagcaatggtctctccaatcatattctagttcgatcctctcccccaataatctccaactcattatacactaccgttatttttcggacaaagtcccgcatgcggtttctgctcactttctttcaggagtgaaaatcgagtaatatggtaagaggagtgaatgatgaggaagtgatgaaatggaatataatttacacgatacaacagtcttaaacgaaaacattctttcatcggaggaacgggaaatatgggtgctctatatgaaagtcttaacgtccgccgggctcggtgatgtgtccgagtggatgaaactggatatgagcatgccgcaaatgaaggtgctgatgctattaaacaaccatggaacattgaaagtgagcgacattgctgaaaaaatgggggcttccctgtccaatacaactgggctgcttgaccggcttgaaaaatcaggatttgtcaaacgctcacattctgaagaggaccgccgctctgtagttgttcagttgacagagaatgcgaaaaagattttccggggtttgtatgaaaagggccacctgaaattgaagcgttcattagagctgctgtcccctgaagaaaagcaggctgtttacgaagggctgtctatcctttcaagagcattagagaatgcgaaaaaagaataaatcagtaagtctgtcatccgcaaactgcgggagcaggctttttttatttgacatttagttcatttaaaatgaataatatatttcaagtgaactaaaaggagttgacgaaaatgtctgaagcattaacagagcagaaaagccaaaagtgggcaatcagcctgtttacgattggcgtgtttatggctgctttagataacggaattatttcggctgctttaacaacgataaacgagtcgttttccgtttccccttcctggggatcatggggcattaccctttatacgctcggtcttagcgtcagtgtgccaatcgtcggaaaactttccgaccgctacggcagaaaaaaactctttctcattgaggtttgcctgttcggacttggttctttgcttgttgctttgagccaaagcttcccgctctttctgatatcgcggctgattcaggcgcttggaggcggcgggattttcatcatcggcagctctcacattctcgcgacccttccaaaggaaaaacaggggaaggcgcttgggctgcttggcgcaatgaacgggatggccgctgtgctcgggccaaatatcggaagctttctgcttgattggaccgggtcttggcattggctatttttgattaatttgccgattgccgtgctattggttgttttcggcgcatgttttatcgcggaaacaaaagcacctgaggctaagcgcctcgatgcggccggaatcttccttttgtccctgtcgattttagctgtgatgtacggcatgaccaatcttgacggggcaaatctcttacacagcttggggaatccggaggtttatggatgtattatttttggcatactctgttttgcagcgcttatctcgtatgaaaagagagttgaaatgcgaggaggcgatcccattttggcgtattctctgctgcgaaaccatatgtttcagcgcacgcttatcatcggtttgttatccggggggctcttggcggcagtcatttttatcccgtcatatgtcgaacagtatttgggtgtccctgccgcaaaagcaggctattggatgacaccgcttgcgttggcttccggaatcggcgcttggcttggcggagcacttaccgacaaaaaaggtcctgtaaaaaccgttattctttcgggaatcatctcatgtgcggggtttgctttatttccgctctgggtcacggaaaaatgggagtttgtgatcgcaagtgtggcagctgggatcggttttggctttctgttaggcgctccgctgaacgtccttgtatcagaagcggcaaaaacaaataagggtacagctcttggcacgctttcattagtaaggcaaattggactgaccttggcgcctactctttatgcaggttttatcacagccgggtttgaccaaataggtgatgagatcaacagccgcttatcggacagcggatattcagaaaaggcgatgcagatgattccggagatcgacagttctgaagtttcttctttacaagaacaaatcgaacgcattcccgttcctgaagtcaaaaccgcgataagcgacgccattcatgcgagtgtcgccagcggctatgatcatttatatgcagcggctgctgtggtctcacttctggtgattgctgctatcagtattccggctttccgccggcaaaagcgttaagaccaccccatccgtctggaaagctccgtaatatgagcgatatggtgatgtgagtgccagacatacaggccgagcgcgttctccagggtaatgatctcctttgtatcagggtgataaaatccgcgcttaaattgctgatccgtcagggtgcggagcagagccgtccatcttccgtgaagctcctgcaaaagcgcgagtgagccgctcggatctgccgttttcgagtcttttagctccgaccatgctttttcatcatacggacggatagccggtgtctcttccgtcaagctcaatttaaaacgaatatagctgttcatatgactgtcagccagatgatgaacaacttgccgaacggtccatccaccgtcccggtacggtgtgtcaagctggctgtccgtcatgacctctacagcttgcttcaattttgccggcacttcttcaagtacttgaatccatttatctttttgctccttcgatatggattccctcggcttgtattctcctattgggtagcttagattgactgatgtcatgaatgttctcccttctattcaatcttctcctttattttacaagaaaaagattgtatattgtgtctttttcccatacaattaaaaacgacactagtgtcattttaataatcaggaggatgaatcatggaaaaaccgttgtttcgcaatcaaaaaggactgatgacactgttagcctcgcaaaccatttcttcacttggagactggcttcacattttggccgtgctaacattagccgcttttcagcttcatgcttctccattagatatgtcgcttttaatgatgtcgtttgctttgcctgtcattgtactcggacctgtatcgggtctgcttgccgaccgttttgacagaaaaacgatcatgtttctatctgaaatcggccgtgccctcactgttatcagctgcgtttatgtcagtgagctttggcagctttacgtattgctatccgttcagagctgtttttcttcactttttttacctgctaaaaacggaaagcttaaggaattggctccggaagcacacattcagcaggccgtttccgtcagcagcatcattgataacagctcaaaaatcttcggccctgcccttggcggcacgctgatcgctgctttctcgatacactctgttttttatataaacgccggcgccttctttctttccgctgtcattttgtttttccttcccagagatgcttttttacaaaaagccaatacacctcaagaaaaaacagcagcacttacttctatcaaggaaggccttcagtttttgaaacggatgccgcttctattaacaggcttactaacagcttgtgtcgttctctttgttttgcagattggtgattcccaagcgattattcttatccgctccttttcaggagctccgcccgagctggcaggctggtgcatggccgtaagcggagccgggatgctccttacagcggccattaccggcagacggcgaatcacttcttatttgctttatttctcagctggaacccttcttcttggactagcaactggaggtgcgccattcctaagcggtatgggaattgccggcatcactctctttatatttgcttttttcatcatgggggcggctttcggcctcgtccatattccatttcagattctcgtgcaaacaacagtgcctgtcgattacagcggtagggtgttcggcgctattcagagtgcgacaaccctcgcctctatcctcggcatggcgggcgggggcgtgctggcggaatggatcggtgtatcacttgcttttcttgtctgtggctgcttgctgatcatgattgggttgattacacttataggtaagaaaattgcagaaagcaggcgatatcttgtcaccaaaagtaacaaaggagcacaaggataaacggcaggcagagattttagaggctgccaaaacggtttttaaacgaaaaggattcgaattaacgacgatgaaggatgttgtagaagagtcaggtttcagccggggcggtgtctatctttatttttcaagcactgaggagatgtttcgccgcattattgaaacagggctggatgaaggactccgaaagcttgataaatcagctgaacaccaaagtgtttgggcctccatttccagctatttggatgaactgactgagggcctgcgagatgtagcagatacgctggcgccggtgcaatttgaatatttagtgacagcttggcgcaatgaagaacggcggcagtatttggagaaaaggtatgatctttttgtggaaaggttttcaaggctattgcaaaaagggatcgatcagggagagtttcagccggttcagcctcttgcgactatcgccaagtttttcctcaatatgaatgacggcatcattcaaaacgccctgtatttcgatgaagaaaaggctgatgtatctggacttgctgagtctgcaaaactatatttaaaaacagttctgcaagcggatgagaagtaaagaaacgcggcaggagccctcctgccgcttgtttttcaccctgcgtgatcacgcacttcgactgttaccttcttctgttttggctgataaattttccccacaaataaatacccgtatttgaacttattcagcgcccatgaggtcataatcgggccggctgtgcacacggcaaacaacaggagaacagccggtacggcaggaatttcgggcatattcaaaagcaacacgtagcctataatcataaaataggcatgaagcagataaatcgaaaaggaatagttgctgataaacatcatgattttcggcacatgcttcattttggaaaacaaatgaaaacacaggaaaatcatgcttgttgaatacagcatgatatcaggccgcttcgagctgatcatgccgatttcaccgacataagaaacagtgacaaccagcgccccagaagcaattgcggcgccgtacaccacccagcggtattggttcagcagcgctaaaaaacgcttgtattcttttccgcaatagtaggctagacaaaagtagaaaagccagcctgcgaacggaacccagaagaacggaaatgcccctccctcttcagaagcaggagccgggctggctgcggagaaatagcctaaataagcggctgtcaccacaaatgagatagacagcacccatttcggcgatgcttttttcaaatactcatgaaacatcatatgcagcatgtaaaattgaaagatgacgagaatgaagtatccgataaagtttcctaagaatacgttcgccagatatttttgcacaaacgcgagaaaggttacctctccccccatcgcactggtcatcagcagcgcatcgatggctgcgataaataaaaaaggaacaaaaatcacttttccccgcttctttaaaaaaccgtcaggcaccccatcaggataagaacgggccagtaaaaattcagagatgaaaataaaagcgggcgtgctgaacatcaggagtgtgcggaaagaatcaacagtgtgagaaatatctgcaagagcttctgcctgaagcatcaggaccattgaaatgatatggagcaagacgacacttaagcacgaaatgcagcggatcataaaaatttctttaatttgcataacagcgctccttttatttcaaattgatagaaatcgatggttgtaccttaacatgtccgctctatttgaaaaagtgcctgatgtcataaattgacgtatgcatgatagactaaggtcataagaccctatggctttctcagacgaaaaaacccactgtaacggagacagcaggttgttttttgaagatattaatttgtattgaggcctccgccattcagcccttctttgatatagccgttcacttggctattagaaagcaagccaatatgaccgatgccataaagctggatgtttcgcgctccttgtaaccgagacaagctattgatgacaatttgatcattgagactgtaaatagatgtatagaggatcttttgattagggtctgtgcccggcagcgcggttgatgacactaaaccattagcccctccaagcgttacgacattttgaatcttattgcccccgcctaaatatttaatatagtacagcgtattggcgcctcccatactatgagccacaatatctactttttttgccccagtctcttttaaaacacggtcaacatatgaagcaagctgcgggccgttatttaggttgtttcctgttttatcataaaaatcaattgcgtacagtttgttgctttgccagccttgagaaattaagtagtttttaatagcgaaaaagttgtatgatgcaccacttattccatgaacaagaacgacaggattatgtactgactcagcttttgcgccagacggcggagcggctaaaacagatagaatcagcgataaacaaataatgaatgccataagtacttttttcacgtttattcccccaaaaaattttcataccaccaatttcctattatatataaaaaatcaatatcgttactattttttctgaaaattaaatttaaatctcttttatattgacggagataaatcggataccttctgacaaaccttttatcttcatttccaaagagcccggttgtgttcccttcctcccttttctataataaggggaataggcagttagaatcacagttgagcaccggctcatctgttttgcgaaacagccagacacggaggatagcatgagagtattaaaatacgccatattagggcttttgcgaaaaggcgaattgagtggatacgatattacgagttattttaaagaggagctcggccagttttggagcgccaagcacagccagatttaccctgagctcaaaaagctgacggatgaaggatttatcacgttccggacaacgattcagggcacaaagctggagaaaaagatgtacaccctgacagacagcggaaagcaggagctgcatgactggctgatccgccaccagccgatacccgagacggtgaaggatgaatttatgctgaaggcttatttcatttcttgtctatcgcgccaggaggcttctgatttgttcaaagaccagctgcaaaaacgccaggccaagctttctgacttacagggaagctatgaaaagcttatggcttcagcagagccgatgtcattttcttcaccggacttcggccactatcttgtgctaacgaaagcgctggagcgggagaaaaattacgtttcttggctggaatcaattttagctatgatagataaggattaaccgcagttcaggctgcacccatacgaatgtacccacatgcaaaaaaacatctgcctaaacggcagatgttttttaggctcggagcgctttcagccccgctgcgaaagtgatcgcagcaaatgcaagcaaaatgccgcagattccgagaatatctgtgacgcgggcaccgttagcgataatctctgtcaacccgctcatcgcccacttttgcggaagaaattcagcgatggattgcataaatttcggttcaatgtcgatcggccaatacatcccgctcaccatacatgttgcgatgacaaacaagttgccgaacgcaagctgctgttctggcgttctgacgttggccgcaatcatcaatccaatgccgacaacggtcaatagaaaaagtgacactaatacaataactgcagccggattcccccagttgatgccaaacagccaatgggtggaaagaagcaatattccaaattgaatccagccaatgacaaagaaggacagcacatacccagcaccgatttcggctcggctgacagaggctgtaagcaatctggaccatacgccgttttttcttgcttctaaaatggttccagccgctcccatcatggtcagcatgacaaacaggatggaaaaccctgctgctctggaggctgtgtcacttgcttccgcaccctcttttttatcactgagcgtctgtcgtgttacagccggaactatatcttcatgttttttggcgaaaaccgttttatacgccgccttccagttctctcccgctgtctgagatgccgtttttgccgcggtcacctgaatattgagcgttgccaatgcgctttctgcatattgtttgaccatcggcgcttccgacagctcagggccgtgacggaaaatcagctcaggatgtttgcctttttccagctgtgtctggaacgagcgggaaatgacgatgatcccggcaattttcttttgtttcagcttttctgacgctttgctttcagacatgttttcgaatacatacatatcatcgtgtgccttcagctgccgaatataatgctgtgagagaatcgtatcgtcctgatcaacgattgcaagccgcaccttatcatcattgccgctgagcatactcccaaatacaaaggtaagcaaaagcggggcagcaaacatgatcaaatagttctgtggcttcttaaaaatgagagaaagctcaatgccgcaaatggctagaatttttttcaccttttgtacctccttatcttgtatgaagccgtctgataccaattacaagtgaacaaaagccgatcgccgcaaaaagaagcacaggcttttgaaggtcagcccagcctcccccttccattaaagaaagaaagccgtcaagcgcccagcgatttggcaccgctttggatacagactgcaagacgtccggaaattggtacagcggcagcatggacccgccgagaaccgcaagcaattgaatgccgaagccgcctatcgcatctgcagttttcatatcgctgatgcacgacgcaagcagcattgaaataccagatacagctgcggcgtaagaaagcccgagtacactcactaacagcagattaccgccccagtccacaccaaatacgttgattgtgacgatcagaaatatgaaaaattgtatgatggcaaacagatacgtcccaagccattttccgaagagaatgacggatttttgcgcaggcgtcatcagcattctggcaagcgtctccgtatccttttcctgtaaaaatgatttcgccccgactgtgatatgaaacagcataaacatgcaaagcattgccgccgaatagtattgaaaactggtaacggctttgctgccgacagatttttccgcaatagtaagcttgtcacctgtttctttttctagcgtctttgccagcttttctgcaaactgtgcagggtcaagttttccttgctttacagcttccgttttactgatgtagtccattgagcctgacgcggcttcctttaccgctttatattgctctataaatgagcttgcagctgtttcaatgatggaacttttcaatgtttgatcaggagcggcattaacaacagctgaggttttgccggcttcccaatggttcgggataacgatgcctacatcgattttcttttcatcaatcagttttttcatcttgtctttgctgccgacttttgtgacctttatcgacttcatttttttgagaacatcttttgtaaacatgtttgctgtatctgactggtctgattgaatgtagccgactttgatatcatcaatccggctgcctccgtcaacaactgatccgagcgctgcgcctaaaatacaggttaggatgagcggcattaggataagcatcataaacccttttctgtccgtgattctgattttcacatctttccatgcgatccatatgctttttttcattgccgtccctcctcaatcccgcaacgtgcggccggtcagattcagaaacaggcgctccagattcggttcctgcacctgaagagacagcaggtttatatgatgagcagtggcttcagcaagcaggcttgtgacgactttctcatgatgagccgcagaaatgtcaattttgagctctaattcatgtactgttacatcattcacatgggccagagatcggatcgccacaagaaacgcttcattgatcccgctgaccgtgagctgaatgatggtatcgcccccaaggcggctgcacaaatcagtttttgtgccaatcgcaatcatttccccctgatcaattatcccgatccggtcgcataaaaactcaacttcttccatgtaatgactcgtatagatcaccgtcatgcccgtttcgttgagctgtttgaccgtttctaaaatgtgatttctcgattgagggtcaataccgacagtcggttcatccataatcagcagctcgggcttatgcattaaagccgcaccgatgttgattcttcgtttcatccccccggaaaatgtttcaatcttatctttagcccgctcagtcagaccgacatattcaaggacctcagccgctctttttttggcctcaccgtgcgtaagtccgtacattttcccccaaaacataagattctcatgagccgtcagcgtcggatataatgcaatttcctgcggaacaatgccgattttttgtttcgctttggccgtttcttttccgataacatagccgcccaccgtgatgttcccgctgtcatgcggcacaaggccggaaatcatcgagatggttgtggatttccccgcaccgttaggcccgagcagaccgaacgactccccctttttgagggaaaaagaaatgcctttcacgattgttttttttccgtatgcctttttgatgttttctgcttgcagcacgtcgtctcactcctttttttgatccattgccattgtagaagaaagaaaggcgtgcggcatgtagcggcagatagaacatagggcatgaaaaaaaggcctgtaaaaggccttttcagagaagcgtatatgcaaaacgtcatatgtcaaaagacagatacaccatatctgaccgagtaaatggcggcttgggttctgtccctgacagccagcttgctgataatatttgaaacgtggtttttgactgtgccttctgtaatgtaaagcttttcggcaatttctttgttattcagcccgtatcccagctcagccagaacttcgatttcgcgctcggtcaggtcgagcagctcgttaggtttttctatctcatttattcctttcagctgtttttcacgcttccattcattcagcatttgggcagtcaattccggcggaagcaccattccgccagaatgaacagtcatcactgcttttacaatcgtatctgcagacatatccttcagcagatacccgcttgctccctcttcaagcgcttcagcaatcagcgctgaatccttaaaggttgtcagcatcaaaacctttacgcttggcagcgagcttgtgattaattttgttccctccaccccgttggaaaccggcatgcggatgtccattaacacgatatccggctccagctctttcgccttttcgaaggcttcctgtccgtttcgcgccgttgcgatcacatcgagctcttctcggagctggagcagggatgccagcccttctctgacgatatcctgatcgtcggtaatgatgatcttaatcatgataaactctccttttgctgcacgggcccgaagctccattttttattggcaagtgaaaattctgcatttacagtaaatccttgatcccgttcgctttcaaagcggatcattccgccatgctccgctgcccgctttttcatattcaagagaccaaaaccaagtgctgcctcaggattgcctttgccgtcatccttaatgacaaggctgatgctgtccgttgtgcaggcaagctgtatcgaacaggctgcggcgccgccgtgccgtttggcattggtcagtgcttcctgcaccgttctgatcagggtcggatggagagacagcgggatgattgcaggatcaccgctgaccgcaaattctgttgtgactcctgcattttttgcaaaagtcctctgtcagctgtttcagcgattcgattagcgaaggatcgttttcagtttgcagagtgcgtactgataagcggacatcatcaagcgcttcacgggcaagtgtttcacagacacctactgtctcatccgctttttggctgtctcttttttgccattcacgcaaaagctgcagctggacgagaagggccgtcattttatgccccactgtatcatggatttcacgcgccattctgttccgctcgtaaatggcagtcagctcttcaacctgcttcgcatataaatggagctcctgatgtgcagcagacagcgccagatgggactccgtcagttcctgaaactgctgttttgccgtatcctgcgcatccaacagcttgcggattaatttgcccacgacaccgcagaagacaacgaatgtcatgctagtcaaatgatcaatgacaaattcattgccgaacatcgcatatgtacggatgaggacggtcaaaaataaaatagaggaaagacataagacagaccatgctgttcttttaggaaacccccgcagaaaaaaggcgaccgcaaccggacaaagcataataatgaacaaacctgtgccgggaaagataaatccgaacgaaaagccgattgcaatatcaatcaggcagaaccagatggcatttgtctcttttgtcagcaaaacatgattggctgcatacatggcagcacctgctgctataaatacatatccaaaccagttatcctctttcacaatggacagatacattaaacagctcaccatcaaggtgaacattctcgtaaaaaaaagagctttcacgctcatcactcccgatacccaattcccttcttatcatacctgcctcagggcatttttgacaggagtttctggaaaataaaaaccgcatatgaactttatgtcatatgcggcgcattccctcatttatttaaattcaacccaaactgacccttggtttgccgagcgcacgcagttctcaatccagcgaatgccctcgatccctgcatcaatgtcaggataaaccaagttgttcaagatttcttcatcttcacggtttttggcgtctatcgcaatggcaaatttaagataaatattggcccatgcttcggacagcccttcgctgtgtaaggcgcccagtcgttcatcggcgttgcaaacatcatctaaatacggcatgccgcgaacgagtgtctggcccggctctccctgcacttcatacgtcagttcatttggcttgctgtcccaccactcaatgcttgcctttgagccgacaatccggattctatggccatccatacatccggcattgattgacgatgtccacatcgttccgaccgctccattttcataatgcatcagcacatgggcattatcctctagcggtgcgcggctgccgacgaagctctgtcggtcacacagcagctccttaattttcatctttggcataataagctgtgacatataatacgtgtgggtagataaatcgcccagcacaaagcttggcccggcgatcgcagggtcgacacgccatttctgtgcagcgcttatcttttcaccttcatctgttgcacaaaaaccgtgtgtgtactgcaagtcaaccacgcgaatatcgccgatcattccttgttcaatcatcgcacgcatttgaagaagcatttgattgcctgaaaaaccgtacgtcacgccgacaattttcccttttttctctgcgagcgctttgatttcctgcccctctgctgaagtgaagaacagcggtttttcacagatgacatgcactcctgcttcaagcgccgccttacaaatctcataatgagtgccgttcggagtggcaatcgatactacctctatgccatcctgtcttttcgcttcctcggcaaacatggtttgatagttgggataacagcgttccgcatccactccaaggttcaccccgaaatcttttcctctttcggcatcgatatcaaaagcgccagcagttaattgaaaagcagtattgtctctcagcgctccaatacgatgtttatatccaacctggctgagccgcccgccgcctaccattgcccagcgaagcggcttagagatgattctttctccatttagcatcatgaaaacctcctattggctgatggtttgttttaaagcttctacagaagtacggatgcccgcttcaggtgacatcgtcagatcctccatttctaaagaaacctcaccttcatatcccatcatttttacaactgaaaaaaattccttccaccactgtaaatcctgtccacagccgacagctacgtaattccacgcccggtttgcaggatctgtcacttcttttgtttctaaaagtccgttgaccgccgataaatatctttcaattctgacatctttcccatggacatggtgaatggctgagccgagctcccttgctgcgatgatcgggtctgcgcccatccataacaaatggctcgggtcaagattcaaaccgaccatcgggccgactgcatttctgagccgaaagagagtctcaggattatagactaattgagagctgaagttctcaagcgctattttccccacgccgcaggcctccgcttttttgacaagcttcttccaatatgggatcgcaacgtcttcccattgatagttgaggatatcttttaaaacgggaggccagcttactgtgtatgtgatccagttcggcactttgtcgtccgggccgccggctggcaaaccgctcatcatgatcacttttttgacgcctaataatccagccagctccatcgttttgtcagttatgtctctgtgcgatttgcccaattcacccggatctaaagggttccccgagcagtttaatgcgcaaagtgtcatgttccgcttttccagcgcttgtgaaaattcttttcttttttcgctgctttgcagcaattcatcaagattcaagtgaggtgccggcgaccagcccccggttgtcatttcaagtgtatcgatcccaagctttgcggcaaaattgagcatgtcttcaaaaggcaaatgccctaggctgtctgttacataagatagtttcattgatagattcctcctggtatctcaggttacgataagtgagttgtttgattttggatttcctgatcagcgcggcggccatactggcgaaaggaatgctcaagctgttcaagtgaccgcccttttgtctcaggcacatattttttcacaaatagaatcgctaggatattcatagcgacaaagataaaaaatgtcgccgacatcccaatatgattgagcaaaatgggaaaggtgaatccaatgagaaagttagctgtccacaagcagaaggtgctgatccccatgccaagcccccgcacatgcataggaaagatttccgagagcatcagccacgtcaccgtagaaatggcagtctgctgaaacgcaagaaacaaaatggtcaaactcagcacaacatacggcagggcgggtgttccttcaaggacaatggataaaatcccgatcagcagaagggctgtcatcgtgccaatctgtccgatgatcagcatgggccggcgacggactttgccgagaagccatatcccaaaaatgaccgcaataactgaaataacaccgtttgcaatattgccgattaatgcagcttctgtttgaaaaccggcttctctcagaatttctgtcccatagtacataatcgaattgacaccggtaatttgctgtacgatggcgattccaatcccaatgaatagaatgcgccttatccacggctcttgaaaatcatgaaagccggccttttttgctgtgccctcaatcgcatgtttgatttcttttatttcctgctgtgcctgactgtcttcacggatttgccgaagcacccgcagggcgtcacccattctgcctttagctgccagccagcgcgggctttcaggcacgatgagcattccgaaccataacacaacagccggaagtgtcgcgatgaccagcatataccgccatacatttgcgctctcccccattgtgctgccaataatggcgttaaaggtgtatgccagaagctggccaattacgatcatcagttcattttgtgtcacgattcgtcccctgcgttctgccggcgaaatttccgctaaaaaggttggaaccgttacagaagcgcagccaaccgccagtccaagcagaaaacgaaaggcaatcatcacggacgcgtttggtgaaaaggtacagccaagtgtggctgcgatgaagagtaaggctaaataaaggatcgtttttcggcggccgtgccgatcggacagacgtcctccaaacatcgccccgaaggctgccccgagaagcagggaactcgcaaccagtccttctgtaacaggtgtaagattcagctgacctgcagttgccataaaaggaagtgccccattaatgacacccgtatcataaccgaacaacaggccgccgaatgtagataccaatgtaatcgttcgtaaaagccctttatgagctaagctttcttttcctattacagcctctttcttttttgtactcacggctttcttccccttctttcaagaatggcagagcacccgacaccaagcataagccaatgcatccctccttcagcaataccccttgttgtaaccgctttctaaaaagattataagacaacgagatttctcgcgtctttatcatatgaagacattgttttgtcatttcaggacatcttattcgtgcggcttggcctgttcgattttttgaaaaggtttattgatttgaaatgcggtcatttttgagtctttataaagggagcggaaaagccctggagagctgccgattttagcggaaaagacgcgagtgaaataatgtactgagaaaccgatttcttccgctatttctttaatcgacaaattcgttgatttcagcagttcggcagctttgtttattttttcattttggacaaattctgagtagctgacgcccagttctgctgcaaataaacgtgataaatgcctccctgagatatgaaagtggctagcgacatccgtcagctttaacggctgtgacagattgtcttttatgtgcagtttcacctctgtcagcaaagcagaagatgtgtgaatgggctgcttttgtttcgggcgttgggcgtacgggagaaaggtttggattaatgacaggatcaatgcatgcgacaaatgagataggatctctttgtcaaaagcattgacaggttgcgctgcttgcagcattaacgttttccaaagcaggcccggcggttcgccatctttcaattgcattgtgataaaggggctttgtttcacttcttccatcactttgatccattcggcgcttgactgatcctcgctcagctcgaaagcgacgtaaaaaaggaacagccctgtttcacttttgatttggtgcaaatgctccggctttgacaaaaaaatcgtctgttcacgaagcggatatgtacgatcgccttcaaggtaatatccttcacctcttaccacgtaacaaatttcataaaaggaatgcttatgaagcagtgtgttatagtggttcgtcatcgctccccagtagtggacgtaaaatgaaacatccttttgctctaagcgatgcacatattgatttaatgctattttgcccgtcacaaggtggttgagttccatgtaaacgcctcctaacaagttggttctctcatcataacaaggcggacaaaaataaaaaatccccctgccgttatttcggcaaggggattgcagttaaatcacaaatgtaatataggcgccggaaacagggtctttcacacgaaagctgttttccgtctcttcaatcgaatacccggcatgtttgactcggtttgccaccaaatccagctcctcttggtggggcaggacaacagtataataatctagtccgctggcatttgtcggtttaggcggcgcatttcttcccgcccaaatgtttaagccgatatgatggtggtaccccccggctgaaacgaagagggcggacatgcccgcatagtttccgacaatgtcaaagcccagtacatctgtataaaacgcctttgcttctttcaaatcactgacatgcagatgaatgtgtccgatgattgtatcgttcggaagcgatgttttccgctcatctcctgcctcttccagaaggccctcaatgtcaacagcggttgtcgtcatgacgtagtttccttcccgatcacgctgccacgtgctgcgggggcggtcagcgtacatttcaatgccgtttccgtcaggatcagacaggtagagcgcttcgctgacagcatggtctccatgtccgatagcaatgccgtgttcaatcaggcgggcgagcgcgatcccaagttctttcctgtccggaagaagaatcgcaaagtgataaaggcctgtcacagaccgttcaggcaagacgacagcgctcggattttcttcaagaataagcagtacgcgtttcccgtcagccgttaattccgcttggcggtccgtcttttttaagacttgaaaaccgatgacgttacagtagaactgaagcgaacgctccagactgcgaattgtgagtttggcatagccaatgtgtgtatcctcatgaatgctggtcatgctgcatgcctcttttcttatgctgaaacgtttccgttctttttcctttaaacacaaatgggtccagcgccaggaatcgacttccagtaagcgccaggtgaatggatgtcaaaagcagaaggtaatcaaattctgcattgcccatgaatggcgctttcagcttaacagtgatgatggcgccgatcagtgtaagagcgaacagtacaccgacaatacgtgtagccaatccgaagaagacaagcactccgccaatcagttcaatcgctgcgatgacatacgccataaagcttggaaggcctatgctgccgaaaaattggatggtgccctccattccctgaaactttgataaaccgtgaacaaaaaagataatacctgtaataactcttaaaagtaatgtgccaatttcaaatgatttattcattttatcctccttgataaatgttatcacttacttaatgtaagctagtatatatacataacttgtttacgtcaagtaattttgttacattttacgaaaatgaaataaaagtactataaaactgtaacaaaaaaagacctctgtgcaggacaaaggtctatttctcaaattggctttcatataagtcactgtaaaatcctttttgccgaatcagctcgtcatggctgcctttttcaatcatttcaccgttttttagcaccacaatctggtccgctctttgaatggtgttcagcctgtgggcaatgatgacgcttgttcttccttccattaaacgggcgagcgcttcttgaatgttgacttctgtaacggtatcaatgttgcttgtcgcttcatccaaaatgagaagaaccggatcggcaagcaccgccctcgctatagaaatcaactgcttctgcccttgactgatgcccgaaccgttttgcgtcagtacggtgtcatacccttttggcagcctttcaataaaactatgggcattcgctgtttttgcagcggcttcgacttcctgatcagaagcatcaagcctgccgtagcgaatgttttctctgatcgttccctgaaataagaaagaatcctgaagaacaaaccccatgttttttcttaggcttgctctagtaagggttttaatatctgtaccatcgattaaaatttttccatcgttaggctcgtaaaaacgggcgagaaggttagtgacggttgtcttccccgcccccgtcggtcctacaaacgcgatggactgccccgcaggcacggtaaactgtaaatgcttcagtgtctgctgccctttatcgtaaccgaaggacacatcccggaattcaatgctgcctgtttggatgggctgatgcacggcgttcttttcatcctcgcgctcttctttttcatcaagcacgtcaaacacccgttcagcgccggcgattgcggacagcatcgtattaaactggttggccagatcgtttaaagggcgtgtaaattgtcttgaatactcggcaaagacaacgatggagccgatcgagatccagcctttcagcgcaaacaaaccgccgattgccgcaatcattgtaaagcttaagttattcaaagagttcatgaccttcggaataaacccggaaatcgtctgcgcccaaaagcccgacgtcttgagtgcagcgtttttttcgaggaattcagcagtaatctgcttctcacgtgaatatgctttgatgacctttgcgcctgaaacagattcctcaatatacccattcagatcaccaaggtttttctgctgttctttaaacagctttcccgttcggttggtgatccatttcaggctcgctgccatcaccggaataatggtcagcgtaatcaaagtaaggagcgggctcatgtacagcatcaccgcaatcgtcccgacaaaggtgatcacacttgacaaaatttgaatgactgacgtgtttaaggtagaactgacattttcgatgtcattcgtcacccggctcatcagctcgccgtgccgctgtttatcaaaaaatggaatcggcagctcatgcagatgggtgaacaattcgcttctcattctgaaaaccgtgccctgcgagatcgtaatcatccaatagttttgaaaccaaagcgacagggactgaatgatatagatagcgagcagaagaagcaaaacaggaatcaagccgctgaccgttttcccgacgataaaatggtcgatggcctttccgatcacaaagggaccaaggagtccgaatatggcgctgatgacaaccattagcatgacaagtatgagcagtccttttctttcagccaagtaagaccagattcgtctcagtgtgccctttgtatcctttgctttcgcccgctttttcgcgccttcttttttgtcaattggcagtttgggatattggaaaggcttgcggatgtcttttagcatgactcgctcccctcccttccgaattgtgactcgtaaatgcgcttgtataactgagattcagaaagcagctcactgtgagtgcctttttcaatcagttcgccgtcctcaagcagcaaaatctgatcagctttcatcgccgtggttattttttgtgtaatgatcaaagttgtgcaatggtatgtgctgattgcttcaagcagcttcgcctccgtttgcagatcaagcgcgcttgtgctgtcatctaatagaaggatagccggttttcgaatcagcgcccgcgcaatggaaatccgctgcttttggccgccggacaggttgacgcctctttgccccaaaacagtgtcatatccatttgggagctttaaaatcgtttcatgaatttgcgcaagttttgccgcatccattatttcatctagtgaagcattttctttgccccaagcgatgttttctttgattgtgccggaaaacaagaggacttcctgcggtacatatccaatttgcctgcgcagcccttcagccggaatatcttgaaccggcttttcatctatgtaaatgcggcctgaatccggctgataaagccgcggaatgagctgaaaaagcgtggacttgcccgagcccgtcgcaccgagaatcgcgatcgtttctcttggctttgcggaaaatgagacattcctgagcgcttctctgtccatttcaggatagcgaaaggatacatgctgaaactcaatccgtcctgacaaacgatcagatatggtgccttcctcccgctcgtcgccttctgtttcaagcacctcaccgattctatcccctgaagccttcgcccgggtgaaaatcataatcaaaaacggaaacatcgaaagcgcgcctgtaattcgtgttgcgtagttaattatcgcaacaacatcgccaacctgagtgcttccgctcgtaatactgtaggaccccgcccacaaaatcaaaaggatgcagagattcatcagcagcatcagtacaggcatcgtgaattccacaagctgaaaggccgaaaccgttttttccatcagccttgtgttggctttgataaatcgtttgacttcgtggctgccgcgaagcagcgctttgatcagcttgattgcaattaaattttcctgcatgatggtgttcacttgatccagccttttctgcactgagcggaacagtgccccgcctttccttaatacccatagcaaaaacaagatcaggatcggaatggtcacaagcagaaaaaacccgagtttcacattaacggcaagcgacagcacaatgccgcctgcaatcattaagggagcccgcagcataaaccgcaaactcataaaaatcatattttgaacctgtgtgacgtcgtttgtcagccttgtaatataagaagaggacgaaaactgtccaaatgtggaataggagaaggactggattttttgaaaaagcccttttctcgtatcataggaaaagctttggctgacatgggcggcataaaaggaattcagcatccccgccgcaaaggataacacggtcagcccgatcatgaccgtgccccatatccatacatgccgcagatcttgcttcaatatcccatcgtcgatgatttttgcaatcaataaaggctgcatcagttcaactgcaagctccgtcagcataagaatcagagcaattcccgccagcaatgaatatggttttaaaaacgacaaagccttttgcatgtaaaagcctccaaacccctttttactcgattgtctctttctttactttactatggcggtctttttgacggcaaacgaaaaccctcccgaaaaggagggcagtctttattgattcaatattttttccacacgctcccgcatctgcggcacgcttaatccgataattacctgaaacgccttcccgttcctgacaacgccgtgtgcgccaagcgcgcggaatacgctgtcgggttcaacctttgtttcatccttgacactgactctgaggcgggtggcgcagtttgtgacttcagtgatgttgtcttttccgcccagcgcttcaatatacagaaaagcggtgtcatcagccgtttcagcagcggaggccgtttcatccttgttttttcgttctctgtattcctttttcgaatatagctttgtttcctgctgttcatccttttcccgtcctggtgtagcgatattgaatttgaggattaaaaatctgaagacgaaaaaataaattgctgtaaacgagagcccgatcaaaatttgatacacatatgtcataccgtggctgccaaagagcggaatccagttcaaggttaccgcctcaatcagtccgcctcccatatttccgacgacgccggccatatacataactgtcgacattgtggcggcaagcacggcgtgaaccgcaaataagaaaggtgaaatgaataagaacgtaaactcaatcggctctgtaataccggcgacaatcgctgtcagtgtgacaggaatcagcagccctgcgacgagttttttctttcctttttggctgtcacataaaaagccagggcgatacccggaataccgaagattttcgagttgccgtgaagcgcgaatccgccttgcggaaagagctccttcagcggtttggcgctttgcgaatattcgccgagatgctgtgcccaatacgtgacgatcccgccttccgctacagccgggccataaataaacggcgtgtaaataaagtgatgaaggccggtcggaattaaaatccgttccaaaaacgtgtatatccaaacgcccaccgccccagaagcaaccaggaagctttgaagcgagccgattcccgattgaaccatcggccaaatataagacacagccaacgcaattgggatcataataaagaaggaaatcatcacgatatatgttgagccttgaaagatgccgagaaaatcgggcagttttttatcaaaatagcgattatgcaaaaagacgacaatcgaagaaataaagatggctccgatgatgttggtatcgagcgtttttatgcccgcaatcatcgttaacccgctcgttccgccgacctcttgattcatgtcgacgccaaatgctcctccccataccgtcaatatcgcgctgacaaaatagttgaatgtcaggtagacagtaagcgcttccaaacaggcgcgtgcctgagctttcttcgccaaagcaaccgggatgccaatggcgaataagagcggcatttggttaaaaacagtccagccgccctgctcaatgatataccagcactgataccaaaaaccgtcaggatcggcgagcggtcccatgagggttttatttttaaagagcgtgctgataccgacgataatgccggcgaacgcgaataataaaacaggcacaaacatcgcgcttccaaagcgctgaattttttgcatcataccagaaccccctgctactcattgtcatttttttctgcctctttgtaatcaacatatgcgcggaacaatgcttcgccaacgagaaaaaacggtgcaaaagcgacaatttccgttctatcgcttaatgtcacaggtttgcttgtcgcataaagattatgcggagtcagctgggcgaggacattgttttttaaattcgtaatggaaataaagggaataccctttgcagaaagcattcttgcctgaggaatcagctccggtgtttctccggaaagagaaatgatgataaacagatcgttcactttaaaatcatcgcgcatcaaattaaattcatttgtgtcttcaatcaaaataagatagcgatggcgcggaataaacattctttgcaggtcgcgggcgcatatcttttgcgcatttccagaaccgtagacgaaaatgcggtcagctgcatcaatcagctggcacatgtccgtcatgtcctttgtccgtaaaaacttcaaatttgcttcaatatcatcaagcagcttttcaaaactcatactctcgccttcttccggctgatcttcccactttaaaaagacgcgaaattcactgtaaccgctgaaaccgagcttttgggcaagccgtaaaattgaggaacgcgatacactgcaagctttggccagcgcgtcgattccaaggtgatagcatgtgtgcttatgattcaatatatattttaaaatatgaaaatcgttgtcattcaatttgctgtagtgctgattgatcagttcttcgagctgcatatcagatccccccattttctttctattatatacaattacagattcgaaaatgggggaatttcatttatgatatgcgggttgggctttgatcaagctcaggccagaagtctttgttggcctccactaaatcctcaagaatgagtcttgccacacgcgcgttcggcactgtttttgacaggatcagcgcctgccacagcttttggaacgatttctctgcccacgcttcaacagtcagcttctcaacggatacctgctgctccatgagccctttctggaattgcggaatggtgccaacggtaatcggttcaggtccatttgagccgacgatgcatggcacctcaaccatcgcagtcgggtcaaagttcgcaattgcaccgttattttcaacaatcaacagcattctttcacctgtgttgtaggcaatcgcccgggcaagatcaacgatatacgatgcgtggtcatcgattttaatttcgctgttttccgaggactgttcacgtgtgatcatgtcacattggctgaaaataaaagcttcgcgcccttccatgacttcattcgcccgcgtatgattcggatttgattttttcaccatatcatctgggaacaaataatattgcaaatacgtattcggcagtgtgtcaggatctgcagcctgcacgtcacgcgctttggcgaacgtgtcattccagcttgcctccacagcttcagcctctgttttcggaatataaccgtattgggatacatgttccttcagcttcggcattaaatcgttgccctcttgatcctgaatcgatgtccaccagccgaaatgattcaatccgtaatagcggaccttcatttcttttcttgaggataagccaagaatttgcgccatccggtcttcgatcccaaccggcatatcacagatattgagaattttagaattcggtctaaggcgtctcgtagcttcagccacaattgccgccggattggaataattgagcatccacgcatcaggcgagtatttttccatgtaatctaatatttcaagcacaccgccgatcgaacgcataccgtatgcgatcccgcccggcccgcacgtctcctggccgacaactccgtactttaacggaatttgctcatcaagcgcgcgcatcgcgtatttccctactctgatgtgcgccataacaaaatcgacatctgtaaaagcttcttccgggtcagtcgtcgctgcaaattcaatatccggcgctttttctctgataaaaacgtcacaggcgcctgcaattcgatcctgtctctccttatcattatcatacagcttcagctttctgatcggaaactcctccaaatggtccaagagcatgagtacgatccctggagtgaaagtgctccctccgcccgctattacgattgagaatgattttttcttcatatgacgacctccttgataacgtttacaattccatttataccatgagatagctcgtcccgtaacacgtttggcgcacttaggtcatttgatcaactttagtgttttttcccatagagcgggaaatttctcatttgccttatgtctgagagatttggttttttaccttttttgtaatcttaaagtctcaccaactgtgaattttaagtgaatatacgcccttccaattcttatgaaaaggttcttttgtacgattcggatacatgccgaattatttataatcatttatataaaacatccaattgtgcgtgaatttagaaaaggcaggggacaaaagttggactcatataaagtcattgagctggcaaacaagtatagtgcggccgcagaagaggtcagaagctccaaaatgctgcttgaatcccggttatctgcattgggagatgcttggcagggcaaagcaagagattcgtttgaccaggatttcgaggaaacgaaagccgcctacgatcaattcgaacaggagctgcttgaaacaagccaagagctgaaggctgccgctgtcaaaatagaagaacgaaaagctgaaattgccagaatggaagaactggagcgtaaagcaagagaggaaagacataaactcgggaggtgaacggtgtgtcaggaaacattgcagttgatccggataagctcgaacagcttgcaaatgatgtagtcactgaattaactgatatggaaaacaaatataaggacctgcatgtggagctggggcagatgattttgcaatgcgatccccgctacagcagctgtttttctggagtgggcgatgcgtggagctcaggaaaggcgctcgtcactaagctgagtgacaatgagattttcatcagaaaaacaggcgataaatttgtggaacaagatgatattttgcgaaagctctacaatgcctacgacaaatacggtacgatgacaagcttaaccgctcttatgctgacgcagggaaaatattacggattagggcttacgaaatttgtgaaacaaccaagcggcttgcatacagcccagcactcaaaactgctcttggatatttccagggccgttgacagctcacgttatcaaaaagcggcaagagtgcttttgaatcctaaatatttgttgaaaaagacaaaccgtccattttcagatttggtacataaaaagtttacaaaatactttcctcaggacacggtggatttttcaaacagcgtcagaagctacacaaaaggatttcttaatgaagccggcgtacgctccactttgaaggatgtgggaaaaacgggcttgagattcgcgaaaggaaatgccattaccgccacactgattaccggagcgaccgaaacattcggagcaggcgtgaaaattgctgaaaattatgcaaaataccaggataaaccggaagttctcaagcgtgaaaacgccaaggccgtcgggaatgctgtgaataatacgatttttgttgccggcggtgccacagctggtgctgtcatcggcggtgcaatcggaagctttgcaggacctgtgggtactgtccttcttggggcagcaggttcatacattggcggagtcgtcggagaacaaatcgccaaatatacagccggttttgctgaaaaagcagccttaaagctgaaagaaccgatccatgctgttgttgatacagccaaaaaagggctggaatcagccggcaaagtcgtcaaatcagtgaatgacggcatagatgcggcgaataaatcgatacataaagggatagacagcgcgaaaaaaggaatggaaaaagcaaagaaaacagcggattcgcttatacacggcgcaacccatttccttaaagggaaattttcatttggataggagaataaacaatgaagcagtttacaattagcatagaagaactcttgttttgcttttacagcgaagggttttttgaacagggaatggccttgaagcaggcctattttccggaaatagaagatgaacagctcggcgccttatttgaagccgcgtgccgctcactcttagccaaggatgcagcggaatatcggaaccatcaatatcggttaaaggacgagtactgtccgtttatccatgtattaaacgacgctgactatacagtgaagctttctaaatttaacgggcaaggtgccgaacagaatgtgtcatgccatgtatcaaaattcggcacctactctcacgaactcctttttgatgaacaagtccatcgcattacaaaaatggaatcaagtgaagggttacttgctaagacagatgagtttttacatataatagatacagaggataaaagagaatcgattgtaacattgacatcaaatgaatttgaaaaactcttggagggcgcttcagacaacccttcatatctaaaagagttccttgaaaaacatgaccaccaagaggacgttacccgatttgcaaatgatctggctttgcggaaagggaaaatggatacacttatgcgtctggcatatggaaaagataacactcctgaagtggctgacatggcattcgtcctgccgggggcccaccatacttggcttgtcacaggcatcacccagaatgaattttctatcctccctgctcataaggatgttgtaaatcaaatcatttcaaaatgataagaattgaattaacaaaaggagaaaagcattgaaaaaccaagaaatcattgaagtcaaaagcaaaatgttcctgagaatatgggcttttgtcggatctgccggtatgggattagcatgtttgtggctcttttatatgggtattacgtttcaaacgaaatattacctattagccattcctgctggctttctgttcaccttgttttgtttatatttatttatcatcttctttccggctttcaccccgcggggaaataccattttccgcatcaagacaggaaaaaatggagaagtgttcactgacaaagtgtctgttacgtttactgatatcaagaaaattgagatgagccgccataaatttagtctaaaaggaatcttccaagaagatatattgatccaaaccgtggatcagaagaccattcgcattcccacttggaacatcattccgaatccgttgtttttcgaagcggttgaacgctatatccttccacatctgaatgaagaggcgaaaagcaattggatcggacagtttacagacatccaacgcagtgcgtatttgaaggaatttgagaatcatccgaagctttaggggcagcacatgattgaagtaaaaagcatgatgtttctaagggcttggctgttcctcgctacagggggcgcctttattgtgggagtctggctggtgtctgaagccctcacgtttgaatctaaatatgccctgctttatttgggcggcggattactggcgatgatttatggattgatcacattctttatggcttttcctgcgttcacaagccgtggaaatgtcattttcaccataaagaccggacctagtggcgaaatcttcttgagaaagcgcagcgtgctgttttccgaggtgaagcggctttatatgggacgccatcaatacagtttgaaagggatcttttttgaggatattatcatcgagaaaacagacggcaaaatcgttcgaatcccgacctggaacatcatcacgaatccgctgtttttcgaagcggttgaacgctatatccttccccatttgaatgaagaggctcaaaacaattggatcagccaatttacagaggttcagcgaaaagcgtatttgaaggaatttgagaatcatccgaagctttaaaagctctcctcctctataatgaaagataaatgcaaattgaggagtgctcatgatgctgattaccattcttttatttctcgcggcagggcttgctgaaattggcggcggatatctggtttggctatggctgagagaggcaaagccagctggctacggaatcgccggggcgctgatcctcattgtatacggcattcttccgacgtttcagtccttcccatctttcggccgtgtatacgccgcttatggcggagtattcatcgtgcttgcggtcctgtggggatggcttgttgaccggaaaacacctgatctgtatgactggatcggcgcattcatttgtctcatcggtgtctgtgttattttatttgcgccgcgcggataacaaaatggcctgcttatgaagcgggccatttttgtttaatcctcttttaagctgttcagctgcacttcatgctcctcttgcggttcgtcaagcggataaattcttgctgttccagtttcttcatttacgtgctgaatgtaaataggaacgccgttatatgttactttcttcatgtcgggagattctacaatttctttcgccctttgaatattcatcgtaacaccctccttcaatacataacgtttccatttcctgaaggaagtatgctttatgattcagcggacaagttgaattttttcaggcgtttgtagaaagtgcttcgggggatcccgctgatttttgcggcttgagagacgtttccttttgcagattcaagcgctttgatcatcatatccttttggatttgctcacgaaaagtaagcacgccggcagcagccggctttttttctgcagagctggccggcaatccagcggcttccagtaaagcgggaagcgattcatctctcagccggccgtccggaaatctgatagaaagacgttcaaacacattaaacagctcgcggatattccccggccacttccattgcttcagcacattacaaaaatcagaaggaagatcgcctggccaatgattcttctgtttgtagtactcaaagagatccgggatatcctcggtgcgatcgcgtaatggagggagttcaattggatagacatgaagacggtaaaacaagtcctctctgatttttccgttttcggcaagctcgcgtaaatcacaatgtgtggcggcaataactctgatatcaaccggaatttctttcgtcccgccgattggcgttatcttgcgttcctgaagcacccgtaaaagtgcaacctgcatcgagtgggaaatttctccgatttcatctaaaaataatgtgccttgattcgctttttgaaaggcgcctttatagccatttcgtttcgctcccgtaaaagcgccctctgcatatccgaacagttcgctttcaatcaaatcagacggaatcgctccgcaattgacagcaacaaacggaccgtgccgtctctcactgttctcatgaagcgcgcgagccgcgacctccttccccgtacccgtttcacccgacaaacagaccgatgcatccgtcgcagctgctcgttcaaggtgcatcagcatcgcttgcgatcggccgctttgcccgatcactccattgaatcgaaacgccttctttttcttttgttccgaaagataaaaacaagtgccgccatctcctatggtgacagcattttcgattgaatagccccgttccttcaactcgtacaggtgccggccctgccaatccggcattgaggttcgaatcggcatgctcgcactgatgatgtgctgcttggtattacagagcaccatcggcacactggatgcagctctctccccaaaacggctgatcagctccagctctttctcacggcttttagctgcgagttcccgttcagcggcataggcaatcgccgtggcaataccaagcatatgaggatgcgcgcctgccgccgggcatgatatgtcaattacacccgcaaggctgccatcctcatggtgaatcggagcagctgaacagttccaaagatgggaagcgatagagtaatgctctgatccttgtattgcaaccggctcgctgatgtggagcgccgtgccaatcgcatttgttccgacagccgtttctgtccagcatgccccttcgacgaaattgatgcgtttggcttcatagagcgcgcgcggatggccgtccaatgccagaacaacaccgtctgaatcaattaacagcgccatcatttccatttcttttatggcaggcagcagtttttcgaggtaaggctttgcggtcgtcaagaagaatgaatgtttttttgactgctgatccagctccgtttgctgtaaaaccttcgggcctttttctaaataaggattgacctcagcttttttgcagcgatgccatgactctgcaatccgttttcttaatcgggcttcgtcaagcacaccgtctttcacaaaacgtttccaggtttgcaaatcgtttgggaccgaattcatttccttgatcgctcctcccttacacgccgttttcatctattgtaggggaaaaataaagcgctttcaacaataaaaaagcaggcgccttatatccatgcgcctgctttttcctttattatgcatgtaccgcaaggccgatcgtgcttaacagcgcctcatgcaatgtttccgataaagtcggatgggcggcgataaaatgctccgccatatctgccgtcatctcaccattcatgatcgctgccgcttggccgatgagctcggttacatccgggccaatcatcgagacacccacgatttcgccgaattccggttcagccatgattttgacctttccttccgcttgctgtttaatgagcgccttgccgtttgcggaaaatgaaaattcgccgatcttcacatccccgtatatgcttcttgcctgtcgttctgtcattccgatacacgcgatttccggggacgtatagatgcagcgcggcacatgtttctcattgattttgacatcccttccggaagcatgagaagcagcgatgatgccctcatggaaagcggcatgcgcgagctgaatgccccctatagcatctccgcacgcgtaaatatgaggcacgttcgtctgcatgtgcccattcaccggaatgccctttggagaaaaatcaactccggcctgttccagctgcaatccgtcaagacggggttttctgccgatcgccaccagcacataatcggccttcgttttaaactctcgctgaccgcttttccatattgccgttttggccgtttgatccacccgccctaatctggatgaagtatgcacttcgacaccgtcttcctcaagtttctcctgaaagagacgggcaatatcttcatcttcagccgggatcagccggtccgctgtttcaatgatggtcacctgcgatcccaatctggcgaacagccctgcatactcacacccgatgacaccgccgccgacaatgactagtgaagacggaatctcggaaagagaaagcgcgtctttgctgtcgaggatccattcgccgtcaaatggggcaaaaggcagctcgattggctctgacccggaggcaatcaatacttggtccgcctctctgatttcttttccgttttctccttcgatcaagagctttctttcagaaagaaaggaggctgttccctttacaacctgtatttgatttttcttcattaggtactgaacgccttggacaagctgactgacaacctgttgttttcggctttgcattttactccaatcgactgatatcgcacctgccggaagttcgattccaaagctgtcggcatgcttgattttatcaagaacgtttgcgctttctaacaaagactttgtcgggatgcagccttcattcaggcaggtccccccaagcttgcctttgtcaatgagcagcacgtttctgccctgctgtgccgcggaaaccgcagccgcatagcctgcaggtccgccgccgataatggctaatgtcatgtcgttttcacctgcttttcctataaaattaatgctgcgggttcttccaaatatgttttcatcgccttcaggaatgcagcggcaggggcgccgtcacacgctctgtgatcaaatgtcaggctgagtggcaggatcgtgcttctgacgatctcctccccttgatacaccggtgtgtcatagcttgctccgatgccgagaatgcctgtttccggcggatttagtatcggtgtgaaatgctcaactccaaacgcgccaaggtttgtaatggagaaagtagatccttgcagttcttcgcttcccgcacgtccctcgcgtgcttttttggcattttctgagatggattgagccagttcaatcagcgatagcttttcagcatggcggatgacaggcaccactaagccattttccaaggctacagccataccaaggtgcacatggggatgtgtgatgatgcgctcattttgataaaagctgttcagcacagggtgagcttgcagagcgagaacggcggctcttgagacaaaatgagtgatcgtcagttttgtgccgtatctctcttccgcagttggtgaaagctgtttttgaagagtggcaagcttggtgatatcagctttcatcgtgatcgtcagctgcgcgctgtttgccaggctttcctgcattcgggcagcgatgacctttctcatgcctgtcaccgggatttcctgcgctttctgctccgaaacaggctttgcttgatcttttttctgttcagcaagagcctttgttacgtcatccttcacgattcgtccgcctggtccagttcctttcagttgttttaggtctaatcctgctttttctgctattttcctggcgactggagatattttcattcgatcttttttggaggctgcgggtttgttttcttgtttgacgggctggacggcttgcggcatattgtcttcagcaacaggcgcccccgcctcttcctgcaccgactcattggcgtccccgatatagcagatagctgtgccgggcggaacctcttctccctctttcactttgatatcgatcagcgttcctttttcaggcgcttcgatctccatttcaattttctccgattgaatgctggcaatgctttctcccttttcaaccgggtcgcctacttttttattccatatcgatacttccccttgtttcatggccattcccaattttggcatcactacttttaccgccatttgtgtcccccctttaattcaatgccggctcgccaagcaattcaagcgtgacgctgacaattttatctggtgtcggcaaatattgatcttcaagcactggtgaaaacggaaccggtgtatgcggcgctgtaatccgtttaatcggcgcatcaagcaaatcaaagcccttgtcagcgacaagcgcagcaatatccgtggcaatgctgcatcgcggattggcttcatcaatgatgatcagccggtttgttttttctaacgatgtgaaaatcgcatcctcatccagaggagacagactgcggggatcaaggacctcggcttcgatgcccctctctgaaagctgtgcagccgcttcaagcgcagtattgacctgcttgccgactgcaaagagcgtaacatcattgccttcgcgtttgatatccgcttttccgaggggaattgtataataatcttccggcacctcgcccttcatgttgtaggacgttttgtcttcaaagaaaaacaccggatcattatcttctattgctgcaagcaaaagacctttggcatcatacggattggatggaacaactgtcttcagtccagggatgctcgtgaaaaggccatacagcgattgtgaatgctgggcagcggcccggaaccctgctccgtatgtggtgcggacggtaatcggcacttgcgcttttccgccgaacatataacggaatttcgccccttggttgatcacctgatcaaagcacgtgccgataaaatcgttaaacatcagctcggcaatcggtctcaaaccggttgatgccgcagccatagccgctcccatatagcctgcctcagaaatcggagtgtccagcactcttgtacgcccgaattcctgtacgagtccctttgtgacccctaatacaccgccccatgcttcatcatcctgcaaatgatcgaccgccgctcccccggcgacatcctcaccgatcaaaagcacattttcgtcttttctcatcgcaagcttcattgcttcattgatcgcgtctgacatgcttatgactctcgccatctcttacattcctcctttttcatatgacacatacacatctgtcagcagctccgaatcttttggatatgggctgtcttcgctgaacgagacggctttttcaatcgattcgctgacacgctgttcaatgtctgacagcttattagcatctgtttcttttaaaaggtagtttttaaaaccttgaatggcatctttttcttcaaggtgctcaactctttcatccttcgttttataggtttgggcatctccttcgaaatggccgtagtttctgtaggtcatacattcaatcaaagacgggccgccgccgtttcttgctctttctatcgcttcctcggctgcctggtaaactgctaaaatatctttgccgtcaactgtaacccccggcatgttataagcagccgcccgatcggcgattgaatcacaggctgatgcgtactcaaatggggtagcttcgccatagccgttgttttcagcaacaaatacgacaggaaggttccatacagccgctaaattcagcccttcgtggaaggtaccttggttatttgccccgtccccgaaaaagcaaacgcttacatttttagtctgtttatatttagccgtgagcgctgatccgcatgcgagcgtaaagccgcccccgacgattccatttgcgcctaacatgcctttatcaagatccgcaatgtgcatagaaccgcccttgcctttgcacaatccggtcgctttcccgaaaatttccgccatcatgccgtccaggtcacagcctttggcgatacaatgtccatgtcccctgtgggtgcttgtaatgctgtcgccatcatgtaaatgagcgcacacccctacagccacggcttcctcaccggcatataaatgaacgaatccgggaagcactccctgggcgaacagttcatgcactttgtcttcaaagcccctgatctccagcatcttttggtacatccacagcgctttttcctcagttaatgacaagccttctcgttttaacaatttcattttgtgcgcctccttctatttagggttcaccattataaatgcaagaagtgtgccagtcttttgagcccgtaaaatcagtcttctcatcttcactttggagacagtttgagacgtgtgtctcgttttgtctcaaactgattcatttgtctcgttttacagcatgcaaaaaaaagaccggatatcacccggcctttgacaatgatcgacgtatttatttccttggaaatctttttaacttcctagttcctctgcatcgtttgactgaatagctgcttttgaaagaaaatcaattgaatatttgacatatccaataccgccgtccccgtccttctgcatacagtctatcgtgccgtttgagtatgtatatcccttttcattaagcgtttttctgaccgtttccgccatctttgcggcatctgtttttgataacccgctggcgtctaactgaatcgtcatgctcataggcgctttttcagccagctttttgttccattttgtatctaacgtgaactgtccgttttcgatactcaaagcagcatcagcttttataaatcgaggaaccgcttttttcagatctgcttcgattgccttcgttgcttcttcatttacatgttttgctactgattcggtatacgcttcttcaattccatcgcacgttactttaggatgcagaaatcccttcgtacacattgggtagcgatgagattgggaggttgcttcaaatacatattcagacgttttagcgttatataccccattcgtgatcttgatttctttcttaggataggtttgtttcacataagacactagcttctgttctgcagcatttttcgaaaatggatcaccgaaccatacatgatagatatatagtccgcatccgaataacacaatggcaagcaagccaaacacaagttttttcatgttcccactcttttcctcatatgtacgtgctacagttcatgcttttcttcaacagcccggttcagcgcttggagcatatagcctatgcctttgtatgatgatagcggccagctgatatgctggtgttctccgatgacggcgtttagaacgcttcgatatttttttccgccaagcatgactagctcttcgatatcagaaaagcctttttcgtgaaattgacggcgcagctcgtccgctgtcatgatttccggatgaccggtgccaaaagtgacatcgtaatttcccgaaacgagatcatcagggcggaggaacccgtgcttcgccgacaaaatcacccactcatcgaaaaatgtttttgcataccgctcgcacgcctgatgaaacgggctgagataagcgtcctctgctcttaccggcccggcatcaggctggacatcccagatttttttcttgccgcaggggatgatgcatagccgtttcattttcctctccccctttatatgatatctccactaaatataccattattttcttacaataaattagagaaaagacaggctgagtaaaagctgcgtacaaaaaagacccggatttaccgaaaatccaggtttattttagtcaagaattgtgtaaaaatccctttattttgttagccttttttgaatcaagcactgctgttactctatcccatcaagatactttctctcaaagtcgtcgagcaatgcacgcacttcatctgttgactttgtgttcatgcattgatttcttaattcacttgcccctcggaatccgcggagataaatcttgaaaaagcgaggaagaggcttgtatggacgggcttcttcttttgaatattcatcatggagatccagatgcagccttaagagatcaagcaattccttgctgctatgctctttcggctccttttcaaaagcgaaaggatttgtaaaaataccgcgccctatcataattccatcgacgccgtattgttcagcaagtttcaagccagtttgacggtcaggaatatccccgtttattgttagcaatgtatctggtgccacctcgtcacgaagtttcttaatctctgggatgagctcccaatgcgcatctactttgctcatttctgcccttgtacgcagatgaatagaaagattcgcaatatcctgtttcaaaatgtgtgtcagccactcgcgccattcatccacatccgtgtatccaagtcttgtcttcacgcttacaggcaatccccctgcttttgcagcttgtattaattctgccgcaactgcaggacggcaaataaggccgcttccctttccattccccgccacattaggcacagggcagcccatattgatatctagtcctttaaatcctaactctgccatgccaatactcattttacggaagttttcaggcttatctccccatatatgggccacaattggctgttcatcctctgtaaaagtcaaacggccgcgcacgctatccttcccatccgggtggcaatagctctctgagtttgtgaactctgtaaaaaacacatccggtctgcctgcttcacttactacatgccggaaaacaacatctgtcacatcttccattggtgccagtacaaaaaacggccgtggtaattcacgccagaaattttctgtcataacaaaaatcaaatcctttcattatgggatacggctgaacctttatcccaaattaaaaactgaccatgcttcttttacacttatcgcatgcgaaagcatttcttatcaatctatagtaaattttgaagatttcacgtgggatgattatctaccctattttttatattctggttaactggcgctgaccttcgtctttcttagtggccttgcttttgaactttttggataaaaaggattccaacctaaatagaatatcatatgagttctccatattaccaacgcaaaataattgccctgttattgaagataagatatttaacactacaccatatccgtatctctatatcatatttgcggaaaaactaatagagataaagcaaattgagttgggggtggtataactgagtactcaagagaatgaaaaaacctacttaagctgctaccacttgtgaatcacatggagtaaagaggatgagaagagaaaataaacccttatttaaaagaattcaagaacttcaatctgaatcatttgggatttgctcatgatttagaaaataaccaacgcagcaagtggcaacctactatatatttgtatagggttataattcggtaatcctgatccagaaccataaaatagactgctgactaagtgtcgcagtcttcactcataagataattaagaaagtgtacattttctttcatcattaaataaggcatcagaagttattgctttaatttcgaatatcctttgttatccctgtaattatttgtataatagtgaaaactcccaagaaaacagtaataatattaaaccatggattatcatagaatgaaagatatgtttgaaagaaatctagttcaactatgtttgctgggaatccattcatttctctatacttaggaccccatcccgttaattctacaaaattaaaataaagctgagatactaaaaatgccaaaaatgtttgaaaccaacttcttttatatactttatccatttaattatccatttccttctctgcaatactttttagccaagtgtcaatctaaaatcattatattatgaagcatgattgtcgcaaggatataaccattgtaggtattactgtaatagttgttatcgtctcggcactattatttaattgttgtagtgctcatacgttatgcattttaaaatggggttggccatcattttcacctctttcatttattacaatgtttcaactttttacatcgaatgactcttgaaatgatatacgccatactttccttatattcctatcatcaatatttcacacgtaataactgcaagtcaatatataattttacaaattatgaaaatacatctatgattttacatcattctactcatgtattttaaacatactgggaggatatttttccggttaaataacgctttttttcacctgcttttcaacacgttttttcaattcttttcgccagttaaaataaagatctccgcgaaaagaaggaagataaaattgagaacagaccgttaggacaagagctgcgcacgaaaaagacccggaaatcggaattgtttattttaccgaaatccaggtcttattaggaaaactattttatgactgggaaatgttctttttagttagacgattttaatacaagcctcgccactgcttcaacatgcgccgtctgcggaaacatatcgacaggctgaatatagtccacgcgatagtccttcgacagcgtctgcaaatctttcgcaagcgtggatggattgcaggaaacgtagacaaagcgtttcggtttgacttttttgatcgtgtccaagaacgtgctgtcacagcccgttcttggcgggtctacaatgacgacgtccgggcggaagccttctttcgtccatttcgggagccagtgctcggctgttcctgttacgtatgtggcatttgccatgccgtgttttttggcgtttttcttagcatcgtcaattgattccttgatgacgtccatgccgcggacttccttcgctccgtccgcaacccacatgccgatagtgccgacgccgcaatacgcatcaacgactttttcttttccggtcagctgcgccgcttttttcacttcatcatacagcttgacggtctgttccggattgagctggaagaaagcgcgggcgctcaattcaaaagatacgtcgccgagcacttcttgaatcactgtttttccggcgagctgttttgttttctcaccaaaaatcactgaggttttcgccccgtttacattctgaataatggatttgacctctggcaatcgcttttgaatcgctttgacgatttcttccttgtgcggaagcgtttcttttgcggttacaagcacgacctgcacttcgcctgtttcaaagccgactctcgtcacgatcgtgcgaacgtcgccttttcgttttctttcattataaacagacacattgaagtcctctaaaatgcggcggacgatgcctgttgttttgttcgttgccggatgctgaacgatacagtctttaatcggcacgatatcatgagaatcaaggccgtataagccggcgatgatgctgccgctttgcgagcgcccgatctggaattggcttttattgcggtaattccacgggttgtccatgccaatcgtttctttgatttccatgttttcaactttaaacttcgtatggcgttcaagagactgaatgacgatatcacgtttttcccgaagctgctggctgtatgcaaggtgctgaagctgacagccgccgcattgttcataaacagggcaaggcggtgccacccggtgctcagatgccttgcggattttcttaatgcggccctccgaaaacttcggctggacctttgtggcctgcacaacaacttcttcgccaggaagcgcgccgggcacgaagacgacttttttcttaaaatagccaacaccttctccgttaatgccgagacgcttaatcgtcagcggaaaagtttgtccgaccttcagttcgacgggcgcctgtttcttttgttggttcacgttgttctctccgtttctatatgaagctttctgcggatggcagaaagtgaaatggttttttcacatctttctagtataacacgtttgcaggatttccttcattgtcagacgaattattctatactcctccacaaatacaaagacgcatagcttaaataaggctcccactccttgctcatcgccagcatgacatcctttgccggcttatcgtccagctgaaagtggcgtttgatggcattctggaggccgatatcggcaagcgggaataaattgggacggccaagtccgaacatgaggacgttttgcacggtccacgggccgatacccctgattttgatcagtttcttcataatgtcttcatccgccatatgcggcagctctgacaagctgagtgtgccttctgcgatcatccttgatgtatcaatggtgtattccgcttttctcatgctgaattgcagatcacgcagatcctgataatcgagttccgcaatcgtttccggctttggatagcaccacacgccatccttctgctcgccaaacgcatgaacaaaccgttctgttagcgtgtaagcgaaggaaagattaagctgctggtggataatgcatttcatcatgcagttgtacacgctgtagtccagaacaagcggcgtcccggcatgctcttcaaaaatggcggacaggctcgtttttgaaaaatgatccagaacgtgctgcaaatgattttcccattgaaaaatccgcttgatttccttcatcatttctccctgatccgtttccccgctgacgaggaactcaggctcgcccgcatggcctaacgcctgtacctttacaatacatacgtcccccgcttgatttctgattggcacacggacttccctcgcctctcgatcaacagcattgagggggtctaaagacagcctgtccagcacgcggtcaaaatgatacggaggcgtgacagatactttttccttccacatgagatccacccttttttccgtttttgttcagtataacatgccgctggaattaggcagagagtaccgtatacttttctcataaagaccgcatgatataatggcaggtggagggttgtttatgatcaacattaccgcaatcacaacagagcatcagctgctgaaaaatataccgatcgaacgagtggaacagcctgatattgcatggtactgggttgatttttacggcccggaggatacggaaacggcgttattgagagatttttttcattttcacccgcttgccattgaggattgcttccagcatatgcagcggccaaagcttgaccattatgacggctatcgtttttacgtgattcatgcgctgaataaggaaacacttgagacggaggaagtcgatatctttcaaggcgaaaaatttgtcgtcacctttcatttacacgaaacgcccggtatcgctaaagtccgggagcgtttgtatgcttcaccggacatattgaaaaaagggcccgggcatatttcttatatgatcatggatcagcttgttgatgaatattttcctctcgtgtataaaattgaagaccggctgaatgaaattgaagaaagccgtccccacaaaacgtatggaacgctgatgaacgaggtgtttgatctcagaacagacctattgcatttgagacggacgattatcccgatgcgtgatttgctctaccggattttaagccttgaccatgtgaaagagcagcgggaaacgaaagcctatttcagcgacatatatgatcatttgttaaagttgtctgaaattgtggaatccaaccgtgacatgacgtccgacttgcgtgacagctacgtgacgctaaactcaaaccggatgaatgcgattatgatgacactgacgatcgtatcaaccattttcatcccgctcacctttattgccggtgtatacggtatgaacttcgactttatgccggagctgcattggaaatacggatatttcgctgtacttggcctgatggccgcgcttgtgattggaatgctgatttggtttgtacataaaggatggttcaatatttttaaatgaggacagcgagcagctgttcttttttgttgtaagccgatcgctatgcatattctgttcatattgtttataatggaaaaaatattcagggagtgattagattgaaaattgctgtcatcggactcggcaatatgggacagcccattgcccgaaatgttcttcaagcaggctacgaattgactgtctataaccggacgaaacaaaagacagaagaccttgtcacagaaggcgcacaggcagctgatacgccgcggctggcggcaaagtccgctgatattgtcatcacaatgcttgcagatgatgattctgtcagcaccgtgacattcggagaagacgggctgcttgaaggattagcagagaacggcatacacatctcgatgagcacaatcagtgttgagttctcagaaaagctcgcagcggctcatgcagagaaaggacaattttttctcgccgctcctgtccttggcagaccggatgccgcagccaaagccgcgctccgtatcataacagccggaccggcggaagcaaagcaagctgccaagcctctgctcgacagcctgagccagcagatatttgacgtcggcgaagaaagcaagacggcaaatgcagccaaaatcagcattaatttcttgcttgtgtccatgctggaggcgttatctgaatcctttttaatgatggagaaatacggcttagaacaaaaacaatttttagaaatcgccagcgcgctctttggttctccagtctatcaaaattacggaaccattatggccgagcagaaatttgagccggccggcttcaaaatgtctttagggctgaaggataccaacctggcactcgccgccgcaaaacgggtttctgcaaatcttcctcttgccgagctggccaagagccattttgaaagcgggattgagaaaggcttcggggatctggactgggccgcactgattaaatgtataaaataaagaaaagcctctccgtttaaggagaggtctttctcttttacaaagacggcagcctcatttctttctcaaacatcagatcatcaatgcttttaaaagtgtagccctgttttttcagatctgtaatcgcgtcatccagcgcttctgcattgtccctcgatacggtgtgaagcaggtaaatggctcccgggtgcgcctgcttgatcatatgatcgtaggcatatttctttcccttttggttgttgattttccaatcaacaaaagcgaccgaccagaaaacggtttgatagccgaggcgtttcgtttctttcagtacgtactcactgaacacgccgcgcggcggacgcaaatacaggttgtcctgctttcccgtaattttataaacctcttcgttgactgaatcaagttcatcctgaatctgatcagctgtttttgtcgttaaatccggatggtgaaaggaatgattgccgataatatggccctcatctgacattcgtttgatcagctgaggctggtcctttacgaaatgcccggtgacaaaaaacgttcctgttacgcgatgtttttttaagacatcaagcacttttggcgtatagccattttcatatccgttatcaaacgttaagtaaatcgttttttcctttgtattccctaaataaaacgcgtcatatttttcaattaaactgttcagctgcttcccggcatctggcggctgatgattgacacttcgtttaaagccccaattaatcggctcattcggcaccgcttccgcctgtgctgcacctccggcaagcaatacggcggcgcagcatattgaacacatccacttcatggccagcgctccttctgcattttttcttattttacagatagagactttgttttatactgttgctttatgccaataaaaaaaccgcggcgggcacgcggttttattcccaatcttttttaaaacgttcgtatttggcttccaggtcatcaagcatgctgataagcctgtctatatcttcaacgtcggttgcttcagggtctaatgaatcgatgacgttcataaacatgtcaagtctgttctttaaataatcaatctgctgatctttattgtttacggcgttccccattctgttcctccattcattttttattatggtagctcattttttgccgtttttcaatcgccgcgctacttgcgatcttggcaaatcaggtctaaaattaactgttggcagcgttagtatgcccatttataaaggagttagatagtcatgacacaaaacacgaagctgcgtccgattacgcccgagtttgacccttgggaagcctatatggatgttgaccaatacggagacatgcagctgacaaacgttgaattcacaacaacgacactgtgcaatatgagatgcgagcattgtgctgtaggctatacattgcagcctaaagacccgaatgctctgccaatagatcttctgttaaaacggctggaggaaatcccgcgcctcagatccatcagcatcacaggcggagagccgatgctttcgttgaaatcagtaaaagaatatgttgttcctttattgaaatatgcccatgaacggggtgtgcggacacaaattaattcaaatctgaccctcgacatcgagcggtacgaatggatcattccgtatctcgatgtgctacatatttcacataactggggaacagttgaagattttgctgaaatcggctttgccatgatggacagaaaaccgaccttcgaacagcgcgcgcgctattttgaaaaaatgatcgaaaacagccgcacgctcgtggatgccggagtaatggtatctgcggaaacgatgctgaacaaacgaacacttccgcatattgagcatattcaccgccaaatcacagaagatatgaaatgtcagcgtcacgaggtccacccaatgtatccaagcgatttcgcaagcgctcttgaatccctcagcctgaaagagatgagacaggccattcaccgcttgctggatattcgtgatgaaaatacgtggatgctgttcggaacgctgccgttttatgcctgcagtccggacgaagacgaccaaaagctgcttcgccggcttcgcgcggcgaaaaacgtcacagtgcgaaatgaccctgacggccgatcccgcctgaatgtgaacattttcgacggaaacattatcgtgaccgatttcggtgataccccgccgcttggcaacattcagacggacagcctcccttccgcctatgaaaagtggagagagaccaagcttgcgaaagaactgagttgccactgcccgaatgtccggtgcctcggaccgaatgttcttgtcaaaaacagttattatcaggatacagacttcacaaaacgtcaagccaggagttagatgcggatgaaagaaacacttacggagatttttcaaaataaaatcgtcgatattctcctcgttgccgttatcctttggatcggtgtctttatcatcaaccggctggtacagctattttttaaacggacggactttattgaagaaaaaaggaaaaaacgattgaaagccttgtccgttctgtcacccagtatacggcaacaattggttttatcttttacgttatttctttatttgtgcatgatttcggcaagatattggccggggcgggcgtagcaggtatcgtgatcggttttggcgcccaatcgctgatcaaagatgtgctggctggtgtattcttaatatatgaacgccagctgcacaaaggcgattatgtcaccgtcaacaacttgttcaacgggacagtggaggaaatcggcctccgctcgctgcaaatccgggaatggagcgggaagctgctcaccatcagcaacggcgaggtcagacaaatagagaactataatattgattttatgcggattaccgaatcctttcttatcagctttaaagaagatccggaccgcgtgtacagcgtgttggaagaggcatgtgacatgctgaatgaagagcttcgtgattcattgaagcgggatgaattcggcaatccgacagaaccgtttcaaatccacggcatcaccgcattgaataaaatcaatcgcggcgtcgaatttacggttaaaggcatggtgaaagatgatgattatttcagtgccagccttgcagtaagacgggttctcgttcgccagctctaccaaaacaatgtgcaaatgcttgaggaagcggtccgaatcgagagaacccaataaacaaaaaaactgattccgagttggaatcagttttttatttatcttggcagtgaggaaagctgaaagccaaacgtgacatgatcttgaaccggaatccacgcgccgattccctgtgacgtgacatttttcacgacgagttttcgtttatttcctttcagcactaagtacacttctccgtaagtcacttttcctttttcattcacagccggtgcatatgcatgtagataaccgatttttttaggagcgactttataaatctgatcccgttttgtgccagccccgatgaccgtctcaaatgcaagcgggaggttcgttttcttcattgctttttgcatcatcatgcttttgacatcttcagcatttggaactttagctgtcaagccgcccttcactctgtactgctgttcctgggcataatgcatttcagccgtttctttcccgccgcggttatccgcacggtttgtattgatttttttatattcccagtttgcgactgtttcatttgattcatagccgagcgcccatttcccgagaaatattgtcgcccggtaccctactgcaagcggtgtgccggatatgttggattcattcagcattttgatgagatgcggattttcaatctttacctcagaatgatcgagcaattcctttgccagcttgctcggctgaagcattggctgatcctgtgaagcattcggatacgtgttttcctttgaaatgcttgcgacagaattaggaaccttaaactgctttttcgcgtggatgggctgaacgccgaaaaaactaaagaataacaacacaataagtgtggaatgaaatagctttttcatcatatcactctttctatggcattttcccttagtcttttcatcccgctttgttgttatccatcattttttcaggttaaagaaggaaaaagccgatcgccataatgacatatgcagcaagcagtgtcgccccttcaaaccagttggaatccccgtcattcgaaatcgcgatcatcaagagaaccgctgataccatcgcgacgagctcaggcaatgtaaatacaagcggcatgcttgtcggaaaaaagatagaacagatgacgagaaccggtgcgacaaacatagcgatctgcagcgtagagcctactgcaatttcaacagcaatgtccattttatttttgaaggccataataatcgctgacgcatgctccgccgcatttcctacaatcgccacgatgatgaccccaataaacagctcgctccacccgaactgttcagccaccgagtgaaaggtatggaccaggttttcggatatgtatgcaaccacaatcgttgccgcaaacaagacaatcgtcgcaaccttccctgaccattctggctcttcctcttcttcagtctgagcggcattattcggctgataaacgccccgatgcgtgacaagtttaaagtacagcgccgccacatataacagaatcataatgatgctgatgccgatgcttaaattgagcttgctggcgtttcccataccaacagagaatacctccggaatcacaaaggcgacaatgatggcaaaaatcagaagcccggagttatggcgggcatcatggatattaaattcctgccgcttatattttaaaccgccgacaaaaaacgataggcccgctaccagcaacaggttccccagcactgaaccggttaaagaggcaagcacgattcctgtcaggccttcttttaatgcaaaaagggaaataatcagctccaccgcattcccgaaggttgcattcaacaaaccgccgatacgcggtcctgcaatgatggacagtgattctgtcgccctccccatatagcttgcaagcgcgataatcgtcacgcaataaactgcaaatagaaccgcggaaggccaatgcatcaaactgccaatcacagaaagcggaacaccggccgccactaaaataaaaagatacgattcatggtgaaatagctccttttttatgacttgttttatttttattcttcacaaaaaccttcatgattacacgagggcaaatgtatagcgtgatataggcttttttcaggttgcctgcttttggaaaacgttgtacgatcaacatagattccatataaggagaactgacacgatgtcacgatttcatttctttatccttgtcttgctcgtttccatttccgggttttcacaaggcatgctgctgcctgtcatttcaatcatttttgaaacaaatggagaatccgctgctatcaacggcctgcacgcgaccgggctgtatatcggtgtgcttttggcttcgccgtttatggaagcaccgctcagaaagctcgggttcaagccgctgatcgtcatgggcggaagcattgtcattttaagcttattcggatttatttggcttcagtcagtttgggtctggttcctgcttcgcctgttcattggaatcggcgaccacatgcttcacttttctacgcaaacgtgggtgacctccatgtcatcaaaacaaaatcgcggaagaaacctgtctatttatgggctttcctttggccttggctttgccgcaggcccgttcatggtgccgcttgtcaagctgagtccgtcgcttccttttatcgtgtccggctgcatcagtctgtttgcgtggctttttgttttctttctacaaaatgcatacccggaaaccagtcctcatgaaaccaaatcagacaatagtttcaggcgattttatcaggccatgctgtttgggtgggttgcctttatgcctacatttggctatggctttctggaaacggcgctgaacggaagctttccggtgtacgcgctccgtttggggatatcagtagacgcagtagcgatcatccttcccgcatttgcgattggaagcattatctttcagtttccgctcggcatcctcagcgataaatacggcaggcggaatgtgctgctggtgattttactgactggggctctttgctttttcatcgccggtgtatttccttcgccctacgtgatcggcggctgcttttttattgcaggaatggcagtcggatcaacctttacacttggcatcagctatatgacagaccttcttccgcctcacctcctgccggcgggaaacctgctttgcggcattacattcagtctcggtagcatcctcggcccagttgccggcggctggtatatgcagacatttgaaagcgcaaacttgttctacttcattactctcacgcttagcgctgtgtggctggcccttgtgctgggcaaaccgaaaagctggtcaccggctgaaacctattcttcatcttcttaatcaaaaagcctcccgacatcatgtcaggaggcttttatgctaatggtagccgttttgtccgttggcgcttccgcttgttttatggctcgatttgcttttcgagttttgtttgttatggcttccgccttttttcgtatgcttggtcatcacgatatccccccgacttctttttgaaccgaagttcgtttatagggtgcgctaatggtagggattttcatcaggaagctttttacgtttatgtaaaagagcgttgatttctccgcctaggataattaaaatgccgctcaagtaaaaccaaatcatcagaacgatgattcccccgatgctcccgtaagtggcgctatagttcgcaaacgtgctgacgtaaaatgaaaacaatgtgctgacaatgatccagccgatagtcgcaaagaccgcacccggcatgacaaaccggagagacagctttttgttcggcgcaatcacatacagcgcggaaaaaacaatcaaaagcacaagcgggctgacaccccagcgaatggcggcccagacggataaaaacagatccgacgcgccgacaaagtcagaagcgagccttccaatctcccggccaaataccggcagaagcaaagccactaaaatcgtaaataccatggcaatcgtcaaaaaaatcgaggttagacgaacaatgataaaagagcggttttcttccacatcatacgcgtggttcagcgaccggacgatcgcattcattccattagacgcagaccataatgcggcgataatcccgaatgacagcaaaccgccatttcgattatttaaggtttgatgggtaatggattcaacgagtgacatcgcactggcgggagcatattgttctatgactcctaaaacatcatcggtagaaagcggaagatacgcggtgagcgtcagcataaaaatcaaaaacggaaacagtgacaatagaaaaaaatacgccagctccgctgatttactttgtccttcatgaagggtgtatctgctgaaaagctctttcaaaaaactcatgtcgtctcacctcgcatgtttgatcatttttttgaaaaatgctctttcgtttcttgcacgagttccatcacttgcggcgttgttttcttcagctctttcacctgctggttcacaaagtcgacttcctttgaaagcgttcgggcgagctttttggcctcatccacttttgtgatgacagtgttttttaacagctctgggttgcttttgtacagtgaaagtttatgcttgcatgtcagccatctcatcccgcacgcctgtcttgtcggcttatggagcagtgataacgccgcgcctgccgcagctccgagaaatatccctttcagcattaaacgttcgttgttcatgcaaattctcctttcactcacaattgtttttctttttgaatggatgcaagcaactgctcacagcccgttttgattaattggcagacctcttcaaagttccctgtgtagtaaggatcgggtacgtcagccagatctgaatcttcaacatagtccaagagccttttgatatgcgaggtgtttttaaaacccgccatgcttctgagacttccgatattttctgcatccattgcaatgatgtaatcaaaatcgtccagatcctgttcgctgacttgacgcgccagcatgccatcaaagctgattccttctctgcgcaatatctcctgcgttccctcatgcggggggttgccgatgtgccagccgccaataccggctgagtccgccttgattttcccctctaatccttttttggctgccaggtccctaaaaatcgcttccgccatcggagaccggcaaatgttacctaaacaaacaaataacacgcttatcatgatgtgcaacctccctattctttgcccctatttctctaaaaagaaaccttcatgaatatcttagtaggatgttcattttcttttcaactgatgtcttcacttttttggaataaacagcctgcttttagaatagggtttttttctgatggaattctgttagaataaaacatacctatattgcgcatagaaaggatggaaccctttgtccagcccaaatacagaaacattaactcaaatgattgaagagatttcccaaaagctgaacatgctgaacgtcggcgtaatcaaagcggaggatttcagtgatgagaagattgaagacctcacgtaccttcacagaatggtgatgaaaaaagaatcattcagcccaagtgaaatgcaggcgattgctcaagaattagcctcgcttcgtaaataatggagactggccggaaactcggcgagtcttttttatcatttccccaaaccaaaacagcaaagtgttcgaataagatttgaaggagtacaagcatgcaaacgacatctatcaaaacagcatccggaatgtatatcaactacttctttctggggatggtcaacatcattctcgcatccaatatgtcttcattaacaaaacagtggaataccgatccgaccggcatcagttatgtcattgccgctatcgggtttggcaaactgctgacatacggcatttccggcgttctatcagataaaatcggcagaaagccgcttgttgtcgcttctgcgggaattatggccgtctttttagtcggtattcctttatcaccgagctatgagctggcgtttgtgttcgctttattagccggagtcgctaattcagccatggatgccggaacatatccggccctaaccgagctctttccgtctgcttccggttcggcaaatgtcttggttaaagcctttatgtctgtgggggccgcacttttgccgcttttgatcacatttttagcagaccacagcatgttttacggatttgctttttatctgccggcagcggtctatctcctgaatattatttatttatcaacgctttcgtttcctaaaaaacataagaaaccaactaatagcggccaacaggaatctcccgttttcttgtctgaacccgtttttcagaaggaaggcaccgcactgattatcatcggttttacatccacggctttatttacggtttctcaaatctggctcccgagctacgcgcaaaaggcagccggtttagctgaatcagcatctgtacaattgctgagctattatagtataggatctctggcatctgttttattattagccgttttgctgaatagatgggtcaaacctgtcttcataacgctcttatatcctattattactttatgtacgctcgcagtcatgctgaccgttcatatcccagttgtgctggacatcactgcctttttcttaggcttttcaactgcgggtgtgtttcaaattaccattacgttaatgacagagcttttctggaagcgaaaaggaaccgttaccggaattgtagcgactgcttcaagtcttgcatcgattctgctgccgattgcaacagggcttatcgcaaaagcggggggcatcgcccatattttcatattcgacttcggcattgcggtcatcggaacggctgcagctgctttcttgtattacaggtacaagaaactgacaggtgctcaagcctaagcaacaaaaaaacggacgcccaagagcgtccgttttttcttatttctcaagcaatgccaatgactcgcggttaaatgccggtatatcgtccggtgtgcggctagtgaccaattgatcctggcaaacaaccacttccttgtccacaacgtcggcaccggcgttttccatgtcaacacgaatggacgtatagcccgtcgcttttcggccgtcgagcgctttcgcattgattaaaagctgcgggccgtggcaaatggcaaataccggctttttgtcagtcataaacgcttttgtaaattggacgaaacgatcgtcagcgcgaagctggtctggtgaaaatcctccaggaatcaaaagcgcatcaaagtctgaagaatttacgtcgtcaatggacgcgtcaaccatcacttccgctgttccctgcttgccttttactgtttttcctttttctttttcgatgacagtcagttcatgtcccgcttctttaaaggctttcgcaggctcagtgtactcgctgtcctcaaaataatatgttaaaacaactgcaatttttttccccatgattcataacctcccgctttatatgtctacataaaacactctaccccagccacactaaaataaacattccgcgattgtgacaaacgataagcataaatgcccagtatttgtcgtttgatactgctacataatactcatttttctcccttttacaataatcataaagaaacacctacaaatagttacaaaatattcttacaataggagctgtaacacaaatttcgttgaaaggtggagaactggtgagaatacagaaaagacgaacacacgtcgaaaacattctccgtattcttttgcccccaattatgatacttagcctaatcctcccaacaccacccattcatgcagaagaaagcgcggctcctcaggtgcatctgagtattttggctacgactgatattcatgccaacatgatggattacgattactacagcgacaaagaaacggcggatttcggtctggcgagaacagcgcaattgatccaaaagcaccgcgagcaaaaccctaacaccctgcttgtggataacggcgacttgattcaagggaatccgctgggtgaatacgcggtgaaatatcaaaaagacgacattatctccggcacgaaaacccatccgattatcagcgtcatgaatgcgctgaaatacgacgccggaacgcttggcaatcatgaattcaactacgggctcgactttctcgacggcacaatcaaaggagccgatttcccgattgtaaatgccaacgtcaaaacaactagcggcgaaaaccgttatacgccgtatgtgattaatgaaaaaaccctcattgatgaaaacggtaatgagcagaaagtaaaagtcggctacataggctttgtcccgccgcaaatcatgacatgggacaaaaagaatctcgaggggcaagttcaggtgcaggatatcgtagaatccgccaatgaaacgatcccgaaaatgaaggcggaaggcgcagatgtcattattgccctcgcccacaccggcattgaaaagcaggcgcaatcatcaggcgcagaaaacgccgtgtttgaccttgccaccaaaacgaaaggcattgacgcgattatctcgggccatcagcacggactctttccttccgccgagtatgcgggtgttgctcagttcaatgtggaaaagggaacaattaacggcattcctgtcgtcatgccaagcagctggggcaaatatttaggcgtgattgacctcaagcttgaaaaggcggacggctcatggaaggtagcagattccaaaggaagtattgaatctattgctggcaacgtcacatcaagaaacgaaaccgttacaaacaccattcagcaaacacaccaaaacacactggagtatgtccgaaagccagtcggcaaaaccgaagcagatattaacagcttctttgcacaggtcaaagatgatccttccattcagatcgtgactgacgcgcaaaagtggtacgctgaaaaagaaatgaaggataccgagtacaagaacctgccgattttatccgctggagcgccgtttaaagcaggcggcagaaacggagccaattactatacaaacattccagccggagatcttgcgattaaaaatgtcggtgacttgtatctttacgataatactgttcaaatcgtcaagctgacaggcagcgaggtcaaggactggctggagatgtcagcaggccaattcaatcaaattgatccagctaaaggcggcgaccaggccttgctgaacgagaatttccgctcctataattttgacgtgattgacggtgtcacatatcaggtcgatgtgacaaaaccggctaaatacaatgagaacggaaaagtgatcaatgcggattcatcccgtatcatcaatctttcctatgaaggcaagccgatcagcccaagccaggaatttctcgtagtcaccaataactatcgtgcgtccggaggcggcgggttccctcatctgacgagcgataaaattgtccacggctctgcagttgaaaataggcaggtgctgatggattacattattgaacaaaaaacagtcaatccaaaagcagacaacaactggtcaatcgcgcctgtttccggcacgaatctgacgtttgaatcctcgcttttggccaagccatttgccgataaagcagacgatgtcgcttatgtaggcaagtctgcgaatgaaggctatggtgtgtataagctgcaattcgatgatgattcaaatccagatcctcctaaagacggactgtgggatctgaccgtcatgcacaccaatgatacgcacgcccatctcgatgatgcagcgagacgaatgacgaaaatcaacgaagtacgcagcgaaacaaatcacaatattctccttgatgcgggagatgtgttttccggcgatctgtattttactaaatggaacggtttggccgatctgaaaatgatgaacatgatgggctatgacgccatgaccttcggaaaccatgaatttgacaaaggcccgacggtgctttctgattttctaagcggaaacagcgcaaccgttgatccggcgaaccgctatcactttgaagcgccggaatttccgattgtcagtgcaaacgtagatgtgtcaaatgagcccaagctgaaatcatttgtcaaaaagccgcaaacctttacggcaggtgaaaagaaagaggccggcattcacccttacattctgttagacgttgacggggagaaagtcgccgtattcggcctgacaacagaagatacagccaccacatcaagcccgggcaaaagcatcgtattcaatgatgcctttgaaacagcacaaaacaccgtcaaagcgattcaagaagaagaaaaggtaaataaaattattgctttaacccacatcggacataaccgggatcttgagctagccaaaaaagtaaaaggcattgatttgatcatcggcggacacactcacaccctcgtagacaaaatggaggtcgtgaacaacgaagaaccgacgatcgtggcgcaggcaaaagaatacggccaattcttggggcgcgttgatgtcgcgtttgatgaaaaaggcgttgtgcaaacagataaatcaaatctgagcgtgctgccaattgatgaacatacagaagaaaacccagaagcaaaacaagagctcgatcagttcaaaaatgaattagaggacgtgaaaaatgaaaaagtcggctacacggatgtggcgcttgacggccagcgtgagcatgtgcgcacgaaagaaacgaatctcggaaacttcatcgcggacggtatgctggcaaaagcgaaagaagcagccggcgccagaatagcgataacaaatggcggcggcatcagagcaggcattgacaaaggtgatatcacactcggcgaggtgctcaacgtgatgccgttcggcaatacgctttacgtggccgatttaaccggaaaacaaattaaagaagcccttgaacaaggcctaagcaatgtggaaaatggcggcggcgctttccctcaggtggccggaatcgaatatacctttacattaaacaacaaacctggacaccgtgtgttagaagtgaaaattgaatcgcctaacggagacaaagttgctataaatacggatgatacctaccgcgtggcaacaaataattttgtcggtgccggaggagacggatattctgtctttacagaagcctcccatggtgaagaccttggctacgttgattatgagattttcaccgaacagctgaaaaaactaggaaacaaggtctctcctaaagttgaaggacgaatcaaagaagtattcctgccgacaaagcagaaggacggcagctggacacttgatgaagacaaatttgcgatttatgctaaaaatgccaacacgccatttgtctattatggaatacatgaaggatctcaagagaagcctatcaatcttaaagtgaaaaaagatcaggtcaaacttttgaaagaaagagagtcagatccttcattgacgatgttcaactactggtacagcatgaagatgccaatggcgaaccttaaaaccgcagacactgcaatcggaatcaagtctacgggagaattggatgtgtcactgtcagatgtatatgactttacagtgaagcaaaaaggaaaagaaataaaatcattcaaggagcccgtacagctttcgcttcgcatgtttgatattgaagaagcccataaccctgccatttatcacgtcgatagaaaaaagaaagctttcacaaagacaggtcacggatcagtcgatgatgatatggtgacaggatatacaaaccacttcagcgaatacacgatcttaaattccggttcaaacaacaaaccgccggcattcccgtcagatcaaccgacaggcggtgatgacggcaatcatggcggaggctccgacaaaccaggcggaaaacagccaactgacggaaacggaggaaatgatacgcctcccggcactcaaccgactaacggctctggtggaaacggttcgggcggatcaggaacagacggtccggctggcggcctgcttccggacacagccacatccatgtactcgatcctgttggccggatttctgatcagcgcactcggaacggcaatgtacttacatcagaggagaaaacagaatagagcgaatcaggcataaaaaagagctgctcgctatgcgagcagctttcttcttttaaacccacttcacaacatcttcaacagcagatcttgttttcggacgagggtctctcactcggtagccgaatgccaccatcacagaaatatcgaagcttccgttttccagaaggccttcttcttcaagaatacggtgaatgtgatcgtactggaagccttcgatcgggcaggaatcaacaccgatttgcgcagcggcagtcatcatgttgccaagcgcgatataggtttgttttgatgcccagtcaaacaatgttctgtcactttcaagcaaatgcaaatcgtttttctggaattcttctgttttgcttaaatagccttcgtacacgtcttgaggcatttgttttacttcttttaaatgacgtttgatgtagtccgcattatatttgatatccttcgctgtacgcgcaagaatcaggacgaaatggcttgcggtcggcagctgcttttgcgcgccccatgtgtattcacgaagcttctcgcggaattccggattttggacgacgacaaatttccaaggctcaaggccgagtgagctcggagacagtcttcctgtttctaaaataaattcaaaatcgctgtctgacacttttttattcgggtcaaattccttagtcgcatgcctgaaattgtatgcatccagaatttgtgtctttagatctgccatgtaaaacacctctcctttagattactctcatctctattgtagccattatgataaaaagtaaaagtacgcacatttttgttggatagtatcaattttgataccaaacaaaaaagcgcgctgccgcaggcaggcgcctctctcatttcccccgccgcgcaaaatcaacaaatcggaatttgtcgagacggtgtctgctttccgtatattgaaacaaactggtatcctccaaaaagacgtagtttctcaccacgaccatatggtcatagccgcgtaaatcgagcagctctctgtcctcgtccgtacacggctcggctacaatttctttttgggcgtaactgatcgaaagaccgagctctccttctatatattcatatatggagttttcacaaatttctttcgtcaggtgagggacatgctttctgaaaaagtaatccttgtccaaaatcacatgttccccgtcaatctttctagacctgatgacttcccagatgtcgtcatccagattggcccggagctgtttttggatcagctctgacggaggctccagcccgaatttgtgtacagttgttttcgtttctttgccaagcgtttgcgcgagctccttgaagctgacaaggcccgaaacgggaaactgcattttttcacgattgagcacgacggagccttttcccctgattttctggatataaccgttttgcgcgagcatatgaagcgcctttcggaccgtttctcttgatgtaccgtactgtgcggtcaactcatgttcagacggaagaatctcctccgctttccatcggccgccttcaatttgctgtgcgatgtctttataaattgtgatgaatttattcaccttcattatggaccacccagcttagtttaacacggtttcgttaaacgataaacaatggactcatatgggcgaagcgtcatgttctgaagcccttcccttgcttcatcgttcgtcaacagcacctctgccttccattcgtcaggcgctaaagagtccggcagtgtaaaggccgcctctgtcccgtaaaaattattgatcacgagcagcttttcattgctgccgtgtctgagatacgcaaaaatgttcgggtcatcctttgcaattatctcatacgtaccctctgtcacaatgtcatacattttgcgaatctgaatcaatttttgataatggtaaaacaccgaattctgatccctcagcgccgcttcagcattgatttcccggtaatttcctgcaaccggtatccatggtgtgcccgttgtaaaaccaccattttccgtagcatcccactgaacgggggttctggaattgtcacgggatttcgcctgtaaaatggctgtaatatcttgatcagccattcctttttccttaaaggcgtgatacatgttcagcgattcgacatcccgataggagcttatgtcagtgaacttcggattcgtcatccccagctcctcgccctgataaatataaggcgtgccctgcatcatatgaatggccgtagcaagcattttcgccgatttcaccctatatgcgccatcatctccatatcttgatacgacgcgcggctgatcatgattgcaccagaacagagcgttccatccccctcctgcgtgcatccccgtttgccagtcagataggatctccttcagcttcaaaaaatcaaacggcgccaaggcccatttttcgccgttaggatagtcaaccttgagatgatggaagctgaatgtcatatcaagttctttattgtcaggattcgtataccggatgcagtggtctacggttgttgaagacatctcaccgaccgtcatgctgtcgtaatgtgaaaacaccttttcgttcatttcatgcagaaattcgtgcacccgcggcccgtcagtgtaaaaagagcggccgtcgccttcctccgcattcggaaagcgctgatctttagaaatcaggttgatgacatcaagcctaaagccgtctattcccttttcaaaccaaaaatgcatcatgtcatagacatgctttctgacctcttcattttcccaattcaaatcagcctgcgtcacatcaaacagatgcaaatagtattggcccgatgcttcgtcaagctcccatgccgagccgccgaatttcgattcccagttcgtcggaacagaaccgttttcctgcggttttttccatatataaaaatcacggtacgggctgtctattgaagagatcgcctcgcgaaaccatttgtgctctgttgacgtatgattgacaacaagatccatgacgactttcaggtctcttttatgtgcttcggacactagccgctcaaaatcctccatcgttccgtattcaggataaatcgagtaataatcacgaatatcgtacccattatcatgctggggagaatcataaatcggcgtcagccaaagcacatccacctgtagcgtttttaagtaatccagcttttcaataatgccgttcagatcgccaacaccatttcctgtcgtatcgttaaagcttttcggataaatttgataaaccacagcttttttccaccatggcgtttgttctgttttcatctgtttccaccaccatatttaaattgaaaacgggaaaagggaacgttcaacacgtcccgctccccacttgttatttatgtttgaatctcgcatacgcgtatgttccggcaaacggcacgatcaatacaatagccatcccgattgcaaacgcgccccagtactggctcatgattgagaaaatccccggcacgccgccgacaccgacggagcttgccagcacaccttgagaagaaatatacattccggccaggccagagctgaccattgcaatgataaacgggaatctgtatcgcagattcaccccaaagatggcaggctctgtaatgccaagataagcagaaatccctgatgtgagggagaggcctttttgtttctcatccttcacgataaacatcatggccagagccgccgaaccttgtgcgatattagaaagcgccagcatcggccataaaaaggtgccgccgagctttgaaccgatgagctgcaggtcgactgcaagaaacgtgtgatgcataccggtaatcacgagcgctgagtagaaaccgccatataacagaccgcccagtgcggcaaaagaaccaaacaccgagataagccctgaagtcagtacattaccgatcgcaaatgtaatcgggccgataatgataaaagaggcaaatcctgttaagagaagcgtaattggtgcgacaacgagcagctgtatgccctcaggtgtgcgttttgttaaaaatacctcaatcttcgccagcatataagaagcaagcaaaattgggagcacctggccctgatagccgactttctgcacctctaggccgaatagattccataccgggatctctccgctttgttctgccgcgccatatccccacgcattcagcaaatcaggatgcacgagcataaccccgagcacaatgccgagaagcggattgccgccgaaccgcttgacggcagaccatccgattaacgcaggcaaaaacgtaaaggccgtgcctgcaatcaggttaatcatattagcaagatccgcccactgcggataaacctgcacaatcgattttgtgctgaagaaaatgccttccgccgttaaaatgttattgatccccattaaaagacccgccgtgacaatcgcaggcaatattggaataaaaatatctgcaagcgttttcacagcacgctgcaaaggattcatatttttttctgaggccttcttcacttcatcctttgttgactcgccaatccccgtttccttaaccagttcagcatatactttattgacagttccctggccgattacgacctgaaactgtccgtttgtcgagaatgatccctttaccacatcaatttgatcaagcatctcttggtcaaccttgctttcatctattaaagcaaaacgcaaacgtgtaacacaatgagttgccgctgcaatattttcagcaccgccgactgcttcgacaatctgacgtgccgatttgttcagttcccccatgccaacccctccgtatccgtttttataacttgtatatacaacttataatcatattgtattcctgtatatacaggtagtcaacacttttttatagcgctttcatcctagtctggaatatatgaaacagacaaggttaccctaaaagtcacaagcacttattgaatatgacattaaaaagcagggtgagcctctatgaataaacgcgacaaagcgcttcagctcatcaaagagcttgaagacaatcaggacagaccgatctctcccaatttgaaggaaaacctcgaaaatctgaccttattaacagaaggctgctcagacatcgtatttagacaatttgactttggaaacgggctgtgcggatttattgtttatatcgaaggaattgtaaaatctgaacatattcaggatcacgccctccgccctttcttaatgcatttgacggatcaaatagatgaacatgaagaggcgctgcaaaatactctatcaatttcaagtgttgcattagaaacgagtatgagcaaagtggctgcatccatcattgaggggaacgcggttttatttgccgacgggcactcaaaaggcctgatcttaaatataaaaggcggacaaagaagaagcattgaagagccgataacagaatcgaccatcagagggtcaagagagggcttcactgaaagcctcagggtcaataccgctcttgtgcgctttcgcgtcaaaacgtttcagcttaaaatgatctcttttaaaatcggcacgaaaaccaaaaccgatgttgtcttggcctatattgacgggcttgccgatccaaaggttattgacaaagcaaaaaaagaatcaaaaagataaagattgatgctgtcttagaaagcggatatattgaagaatttatcgaagacgacacgtactcgccattcccccagctgcaatacacagaaaggccggacaccgtcgccgcccagcttctcgaaggccgatttgccattttcacagataatacgccctttgtcttaacaggcccgattacgttttggcagcttatgcaggccagtgaagattactatgagcgttatttgatgtctaacttaatccgctggcttcgctatatgtttttattcgttgctttatatttgccggctatttatgttgccgttattacataccaccaggacttaatgccgacaaacttaatgttcagtgtggcctctgcgcgtgaaccgattcctttccccgccatcatagaagcattgattatggaaatttcttttgaggctctccgtgaggcgggagtgcgcctgccgaaaaccatcggccagaccgtcagtattctcggggccctagtcattgggacagccgctgttgaagcgggaattgtgtctgcccccatggtgatcatcgtatcgttaacagggatcgcgtcatttacaattccgcggtttaacttagctatctccatcaggatgcttcgtttcccgcttatgtttttggcgagtatttttgggatattcggcattatgctcggcacgattatcttagtgcttcatttatgcaagctgcaatctttcggcattccttatttatccgggatttctccgtttaaacgagatgaagtaaaagatatttttgtcagggcgccttggtggacgatgaccagaaggccgggcacgtattcgcgcggcaacggacagaagggagcgaaaagagaggacccaaaagatgaagaaaacaatatataagtgtgttttgccgcttctcatttgtatccttctaacggggtgctgggaccggacagaaatcaatgacattgcatttgttgtcagctcagccattgataagaaaaaagatcagtatcgagtggccatgcagattcccttggtcggccaattaggcggacaaacagggggcggcggcggaactgccggttcaaaaacatggtatgttgattcagcttccggcactacgatcagagaagcgaacaacaagctgcaaacctccttgtcacggacaatcaatacgtcccacagacgtacagtcattattggagaggatatggcgagagacggcgttgccccagtctttgatattttaacgcgaaatccgcagaacagattaacggcgctcattttagtcagccggggagaagcgcgggacattttaaataccgatgttcagcttgaacagtttccggcggaaatgattcgggagctggccattatcgcaacgagccgccccgttttcttaagcagattcatgtctgatctagtagaaataggcagtgatccgtatgcaccggtcatctctgcatctaaaacaaaacctggagggaaaggcaaatctaatttgaaaattgacgggcttgcgatctttaaaaaggacagattgatggatattttcaaagatgaacacatgacagcagccctgatgttgctgaatcaagcccgccagccagaattcatagtagacctgccgaatcaaatggggcaagcatccattcagcttcaaaagtccaatgcatcctttcatgccgctgaaaaaaacggaaagctgtcaatgacaatcgagatcagagccaaaggaattattatggaaaaccaatcaacctatgagacgagagaaaatgaccagtattacatcattcaaaaagcattaaacagaaccataaagaaggacgtgatcagcaccgttcatcgtttgcaaaagctaaaggcggacccggccggctttcaagacaggaccatcagaagcacggcaaccacgaagaatctgctgaaaaaggaatgggaagaggtatataaggatatggaggttcacgtcgtcccaattgtgacgattgagcagggcggtgtcctatacaaaacgatcagccattaatggaggtgcgtcagcatgatcagctatatcgtacagacattgattgtgtgcattgccatatacgcatatgaatggaagaattttcgttccgctaacaatctaacaaaatgggccttcagcctgctaattgcaggaagtgcttttctatggatttatatgagagtgaatcccctgcttccgcggctggggcacctgtttaaatatattccgttttgaacatgacagaaaggatgtgctttatggacaagacctctgcataccaaggattatttttcggagctctgtatacgttagcagtcggattaaagcatgctccgattctcatgatcgaatcagcaaaacaaaatgcctggcacagctacatcctcggcgttgtcatcgtgattccggcactctggctcatgcataggctgatgaaaaagcatcaggataaaaatatctatgagctgctgagcgattcctcaccaatcgcaggccggattatcattttactgttttctttgtatttcctgttaatcaatgctcatgatatacgttttttcatcaatttgattaacattttatttctcccgagaacaccaatggctgttcttggcggtgttattatctttgtggcgatctgtattgccagagagggaaaagaaacattgaccagaatggcgcagatattcctatttccattcggcatcctggtcttgttccttccatttacgctggccacacaaattgagcttcaaaacttgacacctgtttttgaaggtctaatcccataccttcaatcaggctattacgcgtttgggacaatgggggaattgattatccttccgcttctcttctcaaaccggagcgtcccgctaaaatacaccattttcgcgatactgctgggcgctttattgctggccgtgatgttattttcttcaatttctgtctttggtcccaacctgacatctactttctttgatcctgcttatatggtcatcaggcagatccgcattacggattttctggatcgctcagacctgatcatcgcggctttttggattccggtcattatggtgaagatagcaggttccctatatatcgtggtatacggcctttcgtttttacactcaaaaatcgacccgaaagccatgtatacaccaaccggcatgttctcagtcgtatgcggcttttggtttttttaaaatacaaatcagctaatcgactttaacagaatcaaaccaatcattaatgtagtgatttctcttttgctgcctttactcatttatttgatcataaaaagcaaagcattgttcggcgcaaaagcaaaacactaggaatttttagcttcttttgttggataaacaggcttttgtttcgtttttcttatatctttcaggtagtactgttcagatgtaaagaattcggtgtacagcgcttttacctttctgctcaataacaagagcgcaatcacattcgggacaacaataaaaaccaatgctaagtccaatacgccccaaatggcttttgctccgcctgcggcacctatgataatagccgctaaataaacgaatttaatcacatgtcctgccagccgcccgaacagaaattcagcttgctttacgccgtaaaaaatgacaaccataatggttgatacgacaaagaagaccagggaaaccgaaacgaagtatcctcctccagaaccgaaatagtgctgaaatgcggccgttgtcagtgctgccgggtcatttgaggcgttcttccctgtccatacaccggatgcaaggacgataaaagcggtagtcgtacagatgattaaggtgtcaatgacaatgccgatcacagaccaaaacccttgccgcacaggatgatcagtcattgctgccgcatgtgcaatcggggctgttcccatcccggcttcattagaatacagcccgcgggcaaatccccagcgaacggtttccgccaacgcagcacctgcgaaccctccaactgctgaagaagaggtaaacgcatttgaaaaaacgagagagaaaaacgccggcactgatgatagattcatgagaacaatcaggagaccggcacctgcgtatgcccctgccataagaggcacgacaaactctgttacttttccgatccgctttacccctcctatcaccactaacccaatcaaaaatgcaattccgattcctgcgtatattttattgaaagaaaacgtctcggcaagcgagactgaaaccgaatttccctgaaccataatgctgggaatcagctccacaatcagcgcaacagagaagaatacgccgagccatttcatgcgcagcccttttgttatgtaatacatcggtcccccgacgtattcaccctgctcatttttttctctgtaatgaacagcaagaacactttcagaaaacttaatcgccatggcaaataaggcaataagccacatccaaaaaaccgctcctggtcccccaaacataatagcggcgggcacaccgacaatgttcgctgcaccgatcgttgaactgagggctgaggtcaatgcctgaagcggtgtgactgtgccttctcccttcggcttttttcctacactgccgattgtctgtttgaaaatgtataaaggatagcgaaattgaaaacctttcagcaaaatagtgaaatacaagcccgtccccgtcagcaggatgattagcggcggaccccacagccaatcagatatatgctctatccatactaatagtcgttccatcccatcacccttttttcgtttatgaatcatttcccatagatggaaaaacataaaccttttgacatagaacttggaacataaaaaggatggcttttatcaatcgccatcctgcagacaagacaaatcagctggaagaaggtctgtttcgtccaagccggtcatatactttattcttataaaaagcggatgctggctttgaaaacatgccttttttgtcgacaagcttatcaagcagcaattgcttttcagatttttttctgattaattgctcgcgttctttttcgtcatagcacttttcgattaaatggtcgatggtcataagctcttttttgagcgcgccctcgtcctctgccattcccgcgtttttcaaaatacgatagcccatgcgcagcgattccggcaagtgtgccgcgtcatccttcggcagcggcttccccattcccgggaggttttgaaagtccccgtctttgatggcgcgcttaattttatcttcagacacaatatgggaaaaatccatcatttcacctctttttatctataccttatattttatcatacaattctcaatgtaccattttattcctttatttctagaaagataccttgttttacatttggtaatatcaaagcgaaacgttgattcgacggcgtttttcgccactttctccctcatacgattttcacttttctaatctgctgattcgtgttatattggatacgttcgttttttctatcgtttcgctcgaactggatcggaaaaaaggagtgtaacaatgaaaacatttataaaagaaagaggactggccttcttcttaattgcggtcgtcctgttatggatcaaaacgtatgtcggttatgtcctgaatttcaacttaggaatagacaacacgatacaaaaaatattgctttttgtgaatcctcttagctcaagcttgttctttcttggctttggactcttgttcaagaaaaaattacagcagacagccattatagtgattcattttttaatgtcttttttactgtacgccaacattgtgtactacagatttttcaatgattttattacaattccggtcattatgcaggctaaaacaaacggcggccaactcggtgacagcgcattttcgctgatgagaccgactgacgccttttactttatcgatacgatcatcctgatcatcttggcgatcaaagtaaacaagcctgccgaaacgtcaagcaaaaaatcgttccgaattatttttgcgtcttcaattcttgtgttcttgatcaacctggcagttgcggaatcagaccgtcctgaattgctgacaagatcattcgaccggaactatcttgtgaaatacttgggaacatacaatttcacgatttatgacgctgtacagaatatcaagtccaacagccagcgcgcgcttgccgattccagcgacgtaacggaagtagaaaactacatgaaagccaattacgatgtgccgaataacgtgtatttcggcaaagcggaaggaaaaaacgtcatttacgtttcacttgaatctttgcagtcatttatcatcgactataaaattgacggcaaagaagtgacaccattcttaaataaactggcacatgataacgaaacgttctactttgataactttttccaccaaacgggacaaggtaaaacatctgatgctgaatttatgatggaaaactctctgtacccgctggctcaaggttcagttttcgtaaacaaagcgcaaaacacgctgcaatccgttccggcgattctgaagtctaagaattacacatctgctactttccacgggaacacgcagacgttctggaaccgtaacgaaatgtacaaggcggaaggcattgataaattctttgattctgcttactatgacatgaacgaagaaaacacgaaaaactacggcatgaaagacaaaccgttcttcaaagaatcaatgccgctgctggaaagcctgccgcagccgttctatacgaagttcattaccctttccaaccacttcccattcggaatggatgagggggatacagacttcccggctggagactttggtgactctgtcgtcgataactatttccagtcagcccattaccttgatcagtccattgaacaattcttcaatgatctgaaaaaagacgggttatatgataaatcgattattgtgatgtacggagaccactacggcatctctgaaaaccacaataaagcgatggcgaaagtgcttggcaaggatgaaatcactgattacgacaacgcccagcttcaacgggtgccgctctttatccacgctgccggcgtgaagggcgagaaagttcataaatatgccggagacgttgatgtggctcctaccattctgcatctgctcggagtggatacgaaggactatctgatgtccggttctgatattttatcgaaagaacaccgtgaagtgattccgttccgaaacggagactttatttcaccgaagtacacgaaaatatccggtaagtattacgacacgaaaaccggaaaagaactcgatgaatccgaagtcgacaagtcagaagactcactcgtcaagaaggaacttgaaatgtccgataaaatcataaacggagacctgctgcggttctacgagccgaaaggttttaagaaggtgaatccttctgattatgattacacaaaacatgacgaagattcttccgaaacgtcaaaggataacgaagataaataagaaaaagcggagaggttgccctctccgcttttttatttgacagcagccctcaattcctcagctgcaaattccacattcgggccaataatgacttgaaccgattgcccgcccgatttgacaaccccttttgcgcctgctttctttagcagtgcttcatccaccaaagcggtatccttcacagtcagtcgcagccttgtggcgcaatgatcaatggtttgaaggttttcttttccgccgagccctttcagcatgatgttttcatttacatcctgaacagtattttcatccagcacttcatccacatcatcgtcttcccgtccaggcgtttttaaattcaaagccttaatcagtacataaaacacgataaagtatactgccgcatagcatatacctaccaaaagcagaagcagcggtttttccgcgattccatagctgagcacataatcgatagctccggctgaaaaagagaagcctgagcggatgccgagccagttgacgataaataaagataacccggttaagaccgcgtgaacagcgtataaaagcggagataaaaacataaatgcaaactcaatcggctccgtaatccctgtgataaacgccgttaaagcaaatccaatcatcattccagccgtcgctttccgtttagacggcttcgcagtcacaaccatagccagacacgccgccggaagaccgaacatcatgattgggaaaaatccggtcatatatgtgcccgcagtcggatctttcgcgaaaaagcgcgccaaatcccctgtcactccgttatattctccgaattggaaccagaaaatattgttcagcacatggtgaaggccaagcggaattaacagcctgttgaataggccgaatatgcctgccccgatgccgccgagcccgagcatccactctccaaacgagttgatacacgattgaatcggcggccagaccactccgaatatgcccgctaaaatgatcgtaataatggctgttaaaatcggcacaagccgtctgccactgaagaacccgagatattcaggcagcttggtatccttgaagcggttataggtgtaaccggcaattaaaccggcaataattcccccaaacaccgccatgttatttgttttatcaattgtctttgttgccgcgtcaagcatcagatacgatatcgaccctgataaacccgctgccccattgctgtcttttgaaatgccgatggcaataccgatcgcaaaaataagcggcagatgatcaaaaaccgccgtccccgcctgatagacaaacgggatattaaatacatcctctctgccaagcgcaaggataattccaaccgcaggcagaaccgcaatcgggagcataaatgacttcccgagtttttgtaaaaatgaaagcatacccatccccctcataccctttttttcaaatataccatataagatatctagtgatctataccaattttcccgggggtatttcttttttcccaggtccgtgtgtttcctatttttaagacagttgtggtaagcttaatctagattatttaaaaagaaagcgggaatgacagatgattgtaacaaacgatcaagaattagaaggcctgaaaaaaatcggaagaatcgtcgcgcttgcgcgtgaagaaatgaagcggaaggcagagcccggcatgagcacaaaagaccttgaccttatcggaaaagctgtgcttgatgagcacggcgccgtttcagctcctgagaaggaatacgattttccaggtgtgacatgtatcagcgtaaatgatgaagtggctcacggcataccaagcacatccaaaattttaaaagcaggggaccttgtcaacatcgacatctccgctgaatttggcggcttctattccgacacaggcatctcatttgtgctcggtgaaggagaagaacgccttcataagctttgccaatgcgcggaaaacgcttttcaaaaggggcttcagcaggcaaaagcgggcaagcgccaaaaccagatcggaagagccgtttatcatgaagcacgctctcaaggctttaccgtcatcaaaaccctgaccggccacggaatcggccgaagcctgcatgaagcgccgaaccacatcatgaactattatgatccgtttgataatgcgctgttcaaaaatggcacagtcatcgcgcttgaaccgtttatttcaacgaaagcagaaacgattgttgaagctggagacggctggacgttcaagacgccggataaaagcatggttgcccaagttgaacacacgatcgtcatcacaaaagatgaaccgattatcctgacgaaactgtaaaacacattccgggcttccggcaggtttaacctcctccaattgcaggtaaagcatcattattctgtacgaggaggtcttgcaatgaacagagatcaagaaaaaatccaaattgaaaacgaaatgaacgcgatgcatggcacaataaaagaagacattttaaaagactttgaggaatttaaaggctacctgaaaaaacaagtcaaccgaggcaaaaagctgggattggatgacggcaagcttgtaaaaagcgctgcgatcctgggagactacctcgcaaagcatgaagagccgcaaaacggtgaagaaatgctgctgcaagagctttggagcgttgcagacgaagatgagaaagaacatttggcacagcttctggtcaaattggttgataaacaataaaacatgagccgggcgatatgcgcccggctttcttgatattgtcacagcccggctctttcagatatgctacactactattatgtctgtgaaaggagcctttatctgcatgtggtttattattttcggcatcatttttttcattgaaggcatcattatgaccgtttacggcgttaagaaaaaaaacgggatgctcacatatatcggcattgttttcgccattatgacatttggcgttgtcatgatcaaactaaccggccattaaatcatattcggcttttgctccgcatatacattcagaagaacattcgtacatctagtgcgaaaggctcagttttccccgcatctcttttcagcatctttttatagatgttacaatgccaatcgtttcgaaatcagatagggaaaggagttttctgacatgcattacggcagtaaaggctggtatgtggcagaactaaaaaagcaggggatcacgcaccatgaaggaagaaagcttcaaagctataaaacctattttcttgccaacctgcttgaatcaaagaaaaaacaatcttaaatatggcaaagccgcgcacgttgatatgcgcggcttttttctattcaaccggcagcagcctgtccttttttttcataaaggacgctctccagctttccgatagtgcagcctcacttaaaatccgttcaatggcggtgagattttttgcatcatggtagttgatgcggttcgcgaactggacggatatgcctttctctcctctggacagcaattcaaggttcgcgccgggagacaccctgccctcctccagcacgcgaaaataaaaccctgtatagccggtttgctggaccttcagcaccatttcttttacaccaaactttttcgccagctttacacacggctggcgcggctggctgacctgaacaacagcttcatcaagtctgaacacatccccgatgcaaacattctcctcagtcaggcccgcgaccgtcagattttctccaaatgcggcatttgacagcggtcttgagaggaactcttcccaaaacggataatgctccgccgggtagacacagacagccttatcaggtccgccgtggttgacgaggtccgcctgtccgtctccttcaaaattctcccgatacagcatgacggctgatttagccggccgcttcatgatgccggtttcgattttctttccgtcatattcaagcgtctgcggttttcccagattaagagaaagaactgaatagcgctcttgtttcatacaaacacatcccctttacaggttgtaaaatgattgattatcataaaaagaaaaggtggtttttacatgcttcaataccgaatcattgtagacggccgggttcaaggtgtgggctttcgctattttgttcaaatggaagctgataagcgaaaactggccggctgggtcaaaaaccgtgatgacgggcgtgtcgagattttggcagagggtccggaaaacgccctgcaatcgtttgttgaggctgtaaagaacggaagccctttctcaaaggttaccgacatctctgtgactgaatcccgcagccttgaaggccatcatcgattttctattgtttactcataaggcttatcttgataaaaatagttcggcttaacgattgagttatcataggagcggtggaagatatgagtggcagcgggtgaaattggcggaatcagccacgtccagtcccccgtcagctttctgcccgcttcttcctcctgttcttcaaaccgtttaaactggcttgccgctgtatgatggtcaacgatgctgacaccctgctttttatacgagtgcagcacagctttattcaattcaactagcgcttgatccttccataaatccgtattgtaatcagcggcgatgccgatcacggacgctacttttttgagcttgtcgtaccgcttttcatctgcgaggtttctcgctccgatctccgtgcccatataccagccgttaaatggcgcggcattataatgaatgcccccgacctcaagcttcatatcagaaataataggcacgccgtaccacttcagctccaaatcagaaaacgcctcgatgtccggatgtgtgattggaacctcaatcacaagtgaacgcggcagctcataccagacaggctgctcgtcccctttcatgcgaaaaatgagcggcagcaggtcaaaatccgttcgctctccgcgccagccgagctcttcgcaggctgctgtcagggaacaggaagccgggtcgccgattctttctccgtctgactcatatccagcgtaccggatcagctgatgattccagatctcgacttgcttttcacccttctcttccggagggaaaatcgtaatggtcggtctgattttcccgttattggtggcggtttcaatatggtgaaagagggcatcacgcacttcctccttcgtccggacgtctcgtctgtcgataacattcagcgaattccagaacaatctgccgatgcagcggttgctgtttctccaagccattttcgctccgtgctccagctcttccttcgtatgtacatagcttccggtcaggtcaatttcacttttaatgtccgcgagacggtctttcacttcctcctcctttcccaattcctgatagcatgcggcaataaacgctttcgcttcgttccagagtatttctttttcttccaacaaactctccccttcacatcacttcatgcttttcattgtatcgtttttaagcggcaagacaaatgatttttctgcaacttcctggaaaacaataaaaaacacccgcgtggtgcgggtgtcaaatagacgataaccgatttgccaattcagttaagtcacttcgaaagtttttgccggtcatcggtatgccgtgcccggtcaataacgcttccggttcaagaccggccagctttagaatggactcagcggccgtctctgtgtcaggcgtgaaataagccggcggcccgtgaagctcctgtttttgtatcaagacgtcagccattttctcctgttccactgtaataacagcatcacctgccacaagcacgcggccgtcatcgcggaataacgaaatatggcccggcgtgtgtcctggtgtcgcgatccacatccactcgtcaagaaaaggaactgaaccgtcttccggcagtgcctggacatgtgaggaaatatcgatagagtgccgcggaaacagcggcgacagcttagcgaccagcccgctcttgctgtcaggacgagccggaggataatcctctttacctgttacataaggcatttcccgagaatggatataaacaggcacatcccaatgctcaaggatctcttcgattgccccaatatggtcaaagtgcccgtgtgtgaggataatcgccttcagctgaaacccttcaccgaatctttgtttggcttcattgacaatcacgccggctgattggggcatgccggcatcaattaaaacaaatgagtgaggttcagaaggcagctgaataaaatagacattcgcaatttgcacagtcaggccgtgcaccccttttgccgcttcgaaccccgctccgcttctgactgaagtcagcggcatataaggatcactcataatgacacctccggaatgttgtatgccgttagtgtgtgtcattacgcctgaattatcatacggaaatagagatcgcaccgatcaatagagcgatagccgtcatgacgatcactgcgagaaccgcccatttcaatgcgaatttttgatggtcatcaatagaaactccgacgagtccgacaagcaaatgagtggatggcacaagcggactcagcatatgaatcggctggccgataatagaggctctggcaatttccactttatccacaccgtatgcgacagctgtttctgataaaatcggcagcaccccgtagaaatacgcgtcattcggcatcaaaaatgtgaaaatgccgcttgttaaggcaacaatcgccgggatcaatccgcccatttgttccggtatcatggacacgagcgagatcgccatttcatcaaccattttcgtgcctgtcaaaatccccgtgaacacccccgcagcaaaaatcattgaaccgatagccagcacgttgctggaatgcgccgcgatgcgctgtctctgatgctcgagattgggataattcacaatcagcgcaatacaaaacgcaatgacaaacagtacggttaaactgactttacccgatactaaacatcctattaaagaaagcgttaacaataaattgaaccaccaaagcttcggccgcttccactcatcttcaaccgcagcagccggttcattggcattggctggctgtttcagttcaatcacaccaaggcgctttcgttccgcttttccaagcacatacgcaactgccaccatacaaagcatcccgcttgcaatgacaggaatcatcggccctgtaagctcagctggatcaacccccagcgcactcgccgccctcggcgtcgcacctccccatggaatcgtgttcatgattcccatgccgactcccgcgattcctgccaagataattggccggatgcctagcagcaaatagagcggaagcatggcgcttgtcgtaatcatgtacgttgtcgagccatctccgtccaaggcgacgagcattgtaagaaccgctgtcccgacaacaatttttaaagggtctcctttgaccatgcttaaaattttgccaaccattggatcaaacaggcctgtatcaatcataattccaaaatataagatcgcaaacataatcatgaccgcagtcggcgcgacttgctgaatccccgaaatcatcatgtccccaacttcagtaaatccaaatccggcgataagcgcaaacacaatcggcgtcaaaactaatgctgttaaaacagaaagccgttttgtcatgatcaatgccataaacacaagcatcatgagaaagcctaagattgctaacacatccattcccccttaaatgaatccgcttacatttttttctcccttactcccctttttgtcttgcctttttgccatcgtatgggaaaaccaaccgcaagtaaataatttggttttttgtatttttaatttttaaaaccgttttgttctttttgatcaattttcggcatgaaaaaaatcccgggatgtcgggattttaatttcctgtcatgatgctttgataaaaagcagattgctcttctaaaaaccgtttcgtttccctgctgtttaaataaaagctttcccagtcctgttcgtttattttccgcttccattcaggtgaggaggtgaccttctttagcgcttgatcccagtaagaaatctcttcctcagacatatttttcgggcccaaaatccctctccaatgagaaaaaacaaacgggattccctgctccttccacgtcggtacatttggaaaaccgggaagtcttttatcagacgttacagcggctaacgtgatatcgccgtttcgttcatatggtttcgcttcagaaagtgtcatggaagccgcttctatctcatgtctgatcagcgcctgaatgagctgttcgctgctgtcatactgtgagaattgaatgtcaaacgggtcaatgccgtacatatctgccgctctgacgaacgagagctgatcatcattgccaaaccccggggcaaagccgattctcaccttgccgggatgcatgttgatctcattcagcacatccttgccatttgttaacgctgatccttttggcaatgcaaccgtctgccattccttggagagaatggcgagcggcgtaaaatcggacatttttaatttgctttgcccgagaagatcattgctcaatattaggctggacgtcatgctgatggtttgtttgctgcttttgttgacatatttccagcctttctctcccccgccgccggatttatagacgatatgaacatcatccttcacgatctgcttctgcctcaaaactgattggatcgcctgcgctgtgacatcccagccgccagaaggttcggcagggacgacaatttctatcggcccgtccggcaggcgcggcgcagccgcctgcctgatatcaccctgcataaagatcaatagaatattcaataggattatagattttttcatatctaatccgccgccaaataatattttctctccggcctgccgataatcccgtattcaagctcggctcttgcttcttcctttgacacaaggtactcggcataacggcgggcagttgttcgtgacgcccccattttttccccaagttcctccgctgtcaatccttctgacgcagtctgaagcgcttccttaatttttcgcagtgtaatcgaattaatgccagtcggcaaatcctctgccggcaaagctgtcttcacaccgttcccaaaaatatggtcgatcatggattggctgacctccggctgagacatgagcagcttccttttttctttatactgaagcagcacctgcctgaacttgtcagctgttacgggtttgatcaaatagtgggcaattcccgcccttagcgcttcctgcaaatgacgggtttctgttgccgctgtgataatcataatgtccacttcaggaaatcggcttcgtatatcaggaatcaacgcggtcccaagctcgtccggcatataaatatccagcagaagcaaatcagccttgtgttccttcaaaagcgccaatgtctcttttgcgttagccgccttgccgataatcttgaatccatcaagctgtttaatcaatctctcatggatttgcgcaactcgaaaatcatcctccgcaatcgcgatgtgaatcaaatggattccccctttgtttctccttcggtataaatacagtgaataccgccccgccagttttttgattcgccagttcgatccagccgcccagttcacgcactgagtctttcacattggccagaccgtagcctctcctcatcccctttgaagaatagcctctctcaaacacagcttctattttctctggcggcacaccgggccctgtgtctgatacttcaatgacaatgtcatggcccatatccgtgataaaaaacaaaacttccttcacgctttgctccgctacagcttcgaaagcgttatcaattaaattgccaataatcgtaataagatgggacaagccgatatgcgcaggaagaggcgcgagtgagctgttctcatcaatcaccagcttgaccttcttttccgatgccttgcttattttccctaacaaaatggcctgcacctgctgcgaatggatgttatggaataaaagatcatgctgttcattttgtatcgcatattcctctttaatcagatcaatggcttcatcatactccccaagctcaagcagccctaaaatcgcataaagcttatttgaaaattcatgagtctgcgccctgagatcctctgaatatttgcgaacctctgtcaatgtgtcgatcagcttcttcagctctgttttctccctgaagctgacgacaatcccatacgcctgcccgccttgattcatcactttcgtattgataataaacacttgatcgttgacgcttacttcctggttcggcagcatttctcctttttcaagcacagacatcagccctgctcccggcatgacgtcatctataggaagatggatcacaggctcgggcagcttcagcatctcggccgccgatacgttcatcatggtgacgacgccttcacgattggtggcaataatcccttctcgaatcgcgaaaagcattgcgttcctctcacgatatagagccgcgatctcatgcggttcaagcccgagcgtatcctttctgatgcttttcgccagcacggcggcgccaataaatccgagcagcagtacaagcacagcaatcacactcaaatttctcaaatgctttttgatgctttgctctgtctccgtttgcagaaaatcaacagacacgctgccgatcacttggctgtatcccttctgttcttttataatcggcgcgctccctctgatcactcttcgtccatccgcttttgtttcagaaacatgcgaaccgccaaacaaaatttctctgctgcgctccagtttctttaatccgctttttccagaggcgctgcgaatgtctcctttttcgttcaaaacataaatggcaaacgcaccagtctgttctttcatttgttcaatgacctcttgcgtctgagccgcatgtccgtcttttctctcaatgagctctttaaccggcggcatataggaaatggttctcgccgtttgaaccgccagctgctctgcctgtctccgttctccctgtgtatgctgaacggctaacgtaatggtcagcacaccaatgacaaagaccagcagagccgcaatcagccccattatttttgtttgcagggaaaaatggaaccgctttttcaccacagcaccagccgtcctttctacctagatcataccatttttcacagggaattttctcatttttcaaaatccattttcttacgaaggagtgaaaataaaaaaaggcagaccgcgtctgcctttttctttctaccatattcctagtactttccaccataatccgccgatcacaagccatacgatgatatgaacaatcgacaggataaatccgatggaccaccatttgccttgcgggatgtagcctgctccgaagaagaccggagccgctccagaaccgtagtgagtcgttgacccgaacaggttgctgatgaacgcgaggctcagcgctgctaaaagcggcggtgcgcccgctgccacgacgacagccaaaaatgctgaatacatcgcactgatgtgggctgtcgcacttgcaaagaaatagtgagagtaataatacacaacaattaaaatgatgaatgccacaatccaagagaaccctgatacggatgatttcatggcattactgaaccaagacaccatgcctaattcattcaagaagttggcgagcatgacaagcgccgcaaaccaagtgagcgtatcccaagcgccctgttctttcttgatatcatcccaagtcagaacttgtgataataagagaacggccaaaccgatcaatgcggttgtggtagcgtcgatgttgaagctgccgccaaaaatccacagcacaagcaccaaaagaaacacgataaccatggaaagctccgattttttgaacggtcccatttctttcagtttttctgttgcgattttcgccgcatccggtgtttctttgatttccggcggatacagtttgtaaatcacaagcggcgtgatgattaagcttacaagtcccggtacaatcgcggcaattgcccagcttgtccatgttaagtccacccctgcgacatcatgggccagcttggcaatcagcgggttcgccgccatcgctgtcaggaacatagcagatgtgatcagattcccctgaaaaccggtttttaataagaatgcaccgatttttctctctgttccatttgccgggcttgatccgaatgtttcggataatgatctgataataggaaatataatgcctcctgcacgcgccgtattacttggaatagcaggtgaaagtattaaatcactgaatagcagtgaataagaaagtccaagggttttttttccgaatttctgaacgaatacatacgaaattctcgcaccgagaccggttttgataaatccccgggaaataaagaatgcgataacgataagccaaatggtcttattcccgaatccgcttaatgtatcctcaattgatagtgttccagttagtgcagtaaccgccaatgcaaaaattgcaattgcacccattggcaagggcttggagataaagccgataattgttgcgacaaaaatcgcaaacaaatgccaagctttaggttcaagtccggacggagcgggaataaaccagatgattagtcccacagcgacagtaataagcaatggaacaagctttactgctgactgttttcctgcgtctttttctgaagccataaataggtctcctcctatatacttgttttccgatccccttttccattctactccttaactaagttaataaacattttaattaattaaaaaacacaaaggttagcaccctttgtgtttttcactttcttaatttaatttacccgcacccgcttgatttataacatttgatttcacattagcagaagcatcaatcgatccatgcagagacggcgtccagccgacagaagagctcagcccgtttgcagccgatgcgttgatctgtgtgccgttcagcaacgtgccggagtcatataaagccgttcccccgctgaatacgctgatcgttttagcagctgacagtcccggtacgtcaatgacattgttttgggcatagattttagatgactttccgattccccatgcatagctaaaaggataacttgaagagcttgtgcttccttcataatagttgttgtatacgtgcacttgcccgaagcggactctcggcgcgcgctggacaatatttttatagcggttatgatgcagcgtaatttttaatttgccgtcatcggaggttttgctgtcacttgatccgaaaatggagcttttatcatgatcgtgataatagttgtaggacatcgtgatatagttagcaccgttggaagcatccgtttggccgtcatggtgctgatattttcttccataatatttcggtgatgtgctgtccggacgcgaaccgtcattaaatgtacagtgatcaatccagatgtgtgtgccgccgtttatcgtgatgttgtcgtattgtgagttccagttccctgagcttccgtcagtcggatcccattgcggaaaatagtcataggcatcctggaattcaatgttgcgaataatgacgttatcactcttgatttggaagtttcctcccacgactttagcgttagtccctgaaccgacgatcgtcgtgtttgcagggatatccaccatgacccgtgctttttggtttttctgagagcgtgctctcgcttcttcttgtgttcccgacggctcttttttgccccatgtgctaggatcataggctttcaaatatttgtccaaatcatactccggatctttatagtcatttaggccaagcggcttcagattgtcatccacgttcatgtcaatcgttcccttgatataaatgatttttggcgttgtgttcgtttccttccctaatgccgagacaagctggtttctgttgctgacggtatacacatttgaggaggatgcttttgatccgcctgtcgtgccggtcgagtacgcgccccagccatcattggatcccaacgtctggtggcctaaatcagctgcgttcgcgccagctggagtcaatcctaaaaacaaagccgtagctaacatcacttttttcatccactatgtacccccattttctattttgtgagattttattccaatttatcacaaaaatataatagcaaattgagggacattcagaaccgaaaatgttccgctatcctattgcggcattctgcaaaatcccaccgcaaagaccgcaaaaaaaccaaaaggccgacattggccttttggttttttccttgctttatgcccaagctttcactttttcgttatctgtcacaaagagaagcacttttccttcatctaagcgtttttcaaattgagcggcttcatcttcagaaaaaccgatttcgtgaattttattgcggagctcgtctccttttttattgaagatatttcccaccgcgtgcttgaaacctgtttctttggctccgatcgtgttggcgttcgtgttgtcagccaggcgttccgttctgtcatcgtcgtgagctaagacgtatacatcctctttcgcaacacccattttctgcaattcctctacatctttcatgagctgttcgtcatttgtatactcttttacaactggtttcatgtcgatattcctccttcatgttttctatatttctttcatacccgatcgtctgtacctgaaacagattccagaacattgaagagaaaaacaggaggaatggtagtagctatttgttttccgtccatggtaaagtgataggaacgggacctattttcagaaaaatcaaaattaaggagaagccgctgcacggagcacacgaccatgaaacgctgcctttatccgtacgagcaggaggtatgtctaatgcaatacttttcaccagaacagcaatacaatgcttggattgtgagtgatttagtcaaacagattttccataagcgtgccggatgttcaccaggaattcacgagcttgcggtttttgccgaggaacattttcatatcgatatcgactttgttttctcgattatcatgaatatcggcgacattgaatttgcactaacagatgaaatagaaaagaaattgtccggttatctcagcactctccttccttatgtcactgctgatatgttcgaaacctctaaagccaacgcccatgcgtttttgtctcgaagacacggtaacgctgcataccacttatttgtgtctgatgatgctttcatgagaaagcagtaaaaacgcagctttctttactaaaaaaatattgacatgataagccatgctattatagtgttacatgtgataatgattctcattactaaatctgaaaaaaggaagaatgacatgcgcacctattctaacaagttgattgccatcatgagtgttttattgctcgcctgcctcattgtatccggctgttcatcaagccagaataacaacggaagcggcaaaagcgagtctaaggattccagagtgatccatgacgaagaaggaaaaacgacagtaagcggcacacctaagcgggtggttgtgcttgagctttcattcttggatgccgttcacaatctcggcattacgccggtgggcatcgcagatgacaacaaaaaagatatgattaaaaagcttgtcggcagctccattgattacacatctgtaggcacacgcagcgaacccaatcttgaggtcatcagttccttgaagcctgatttaatcatcgctgacgctgagcgccataaaaacatttataaacagctgaaaaaaatcgccccgacgattgaattaaaaagccgtgaagcgacatatgacgaaacgatcgacagctttacgaccattgctaaagcattaaataaagaagatgaaggaaaagaaaagcttgccgagcacaaaaaagtcatcaacgatctaaaagccgaacttccgaaagatgaaaaccgcaacatcgttctcggcgttgcaagagcggattccttccagcttcatacatcatcatcctatgacggagaaatctttaaaatgctaggctttacacacgctgtgaagtcagataacgcctatcaagaggtcagccttgagcaattgagcaaaatcgatcctgatattttgttcatctcagccaacgaaggcaaaaccattgtagatgagtggaaaacgaacccgctctggaaaaatctcaaagcggtgaaaaatggacaagtctatgatgcggaccgtgacacttggacaagattcagaggcatcaagtctagtgaaacaagcgccaaagatgtgcttaaaaaagtgtataataaataggacaaatgagaagcgaggggaatccttgcttcttcgtttttgcaaccagacgcagtaaggaagtgagactgttgtatcattcagccaaacggcgctcatcatcaagactgatgatgtttatcattgcactgattatttttatatttgggcttgggctgaatctttcagtaggagcctcagacatcagcatcatagattcattgaaatatctttttgtatgggacggttcaaaggaacagctcatcatctctactcttcgccttccccgcacattaatcggcgtttttgtcggcgccagcctagctgtagcaggggcgctgatgcaggctatgaccagaaatcctctggcttcaccccaaattttcggtgtgaatgcgggtgcatcgctttttgttgttgcttctctcgtcattctgccggcatcgccctattcatctgttatattcgcttttgcgggtgcggcagcaggcggcgcgattgtgtatatgattgcctcatccggcggaatgacgcctgtcaagctggcgctgtcaggaatggccgtgcacttgttcctctcctctatgacacaggccatcattattttaaatgagtcaggtgaggatgttctgtactggatgacaggcgcaatcgacggcagcaactggcaggacgtcataaccatcgctcctttttctgtcattggcatcgggcttgccctcgtattttccggttctgtttctgttctcggtctcggagacgaaacagcaaaagggcttggacaaaatatgaacggcatcaggattctgatcagtttgattattttaattctttccggcgcttccgtagccgtcgccgggccgattggctttgtcgggctgctcgtcccgcatattgtccgcaagctgatcggagaacattatcaatacgtgcttccgttttcggcactgttcggtgccattttgctggtgtacgcagatgttctggccagatggattgcatttccttatgaatcaccggtcggcattgtcaccgcgattatcggaacgccgtttttcttatatttggcaaggaaagggcgaaacctgaaatgaagaaaacaaccagaaaacaaaaacgccccttactggcgatactcatattggccgtgattttaatcgttctgtccgtcatcagcattggaatcggtgcattatacatttcacctgatgcggtagtgacgaatctgctgggactggatcattcctttgaatttatcatccagcaatatcgccttccccgcattatattagcgattttggcaggtgctggacttgccgctgccggagcgattttacagggtgtgatccgaaatccgctcgcttccccggacgttgtcggcatttcaaaaggctccggacttgcggcgatggctgtgattctcatctttcctgagtcgccggtatacgtgcttccgttctccgcatttgccggagccgccattattgctgtactattattaatgatagcccgaaaaaagagcattcagccctcttcactggctttatcaggcattgctttaggcgcggtctgccacgccggaatgcaatatatgatggtcaagtttccaggcgacgtgaatgctgcactcatttggctgacaggaagcctctggggaagaaactgggaagaagtcaagctgcttgcgccatggcttttgattctttttccgatcgtctgcatactcataccgaagctggatcttatgtcactcggggatgagcttgcacagggtctcggagaaaacgcaaaccggctgagattcatcctgattttcaccgcggtggcgctggcgggaagctgtgtagccgtcgtcggctcaatcggttttatcggcttgcttgctccgcatatcgccagacggcttaccggagaaaaagctaaatatttactgcctgcatcggcattgattggtgctattatattattaattgcagatacgttagggcgcggcatcatgcctccggttgaaatacctgccggaatactgacagccgtgatcggcgcgccttatttcttatatttattgaaattcgaagcgaggaaacagtagggagaggataccatgggaaaactggctgcagaccagctcactctttcatatgacagtacagtgattattgacggagtcgacttaaagatagaagaaggaaaaatcactgcgctcatcggcgctaatggctgcggtaaatcaacaatcctcaaatcgctcgccaggctgatggccccaaaaagcggtacagtgctactagaaggaaaagacatccaccgccagccatcaaaagaagtcgcaaaaaaactggccattcttccacaatctcctcaggctcctgaaggattgacggtagaggaattatgctattttggcagacatcctcacaaaaagctgttatccaagcatacccaagaggatcatgacatggtagagtgggcgctggaagcaacgggcatgattgaactgaaggatcggacacttgatgccctctcaggcggccaaagacaaagagcctggatttccatggcacttgcgcaaggcactgatttgcttttgcttgatgagccgaccacgtatttagacatctcacatcagattgaagtgcttgaactgctgaaaaagctgaaccgcgaccatggccgcaccgttgtcatggtgctccatgatttaaaccaagccgctcaatatgctgactatctgatcagtgtgctggacggaaaaatatacaacgccggaacaccggaagatgtgttcacccagccatttttccgtgaagtcttcggcttggaatgctgcatcatgagaagcccgatcgaccagaagccaatgtgcctgccgacgggactgtgcccgaaattacgggcgaaatgaaaaggagaggaattccctagggctgtcgagaaacgtgacagccttcattttcccttataatattttattctcacataattgatgataatcttaaaaaactcgtcattcttcttatgttctatacgagatactcttttaacataaagttaaatctgttcttattgaccaacttgttaaagttatttcatctattcgaatcttaacacatagaaaagctgaaagaattatagtaagtcatcctcgaaatgcgtgaaaagacaaaaaagaaaagcgacaaaattagcttatgtatcagaaaaagaataatcaaaacagatgctttgctattgcaggctcagcttaaaatcgaaatgctaactaactgaatcttctatatttctcacaataatatacagaagatcgtaatacctagctaagatcgagcttaatggctctttttctgattctcaatccctgataattttgaaaagcatttaaaataaaatcttgtagaaaaaacattgttttttctacaagctgaacattactacacaatgttagtatacttttatcaagtctctaacctagaatgattaataaattgctttattagtaattggcccattaattgattctctaattttatatactggaatattctttacgcatctaatccccatttcattgtgtcgacagaaaggaatatcttttgctctaaaagaagggaacattaagcctggatgagagaagaatgatcctcctttaagaacggcaaatgagttaacactattaaatggtacattctcaaaaatagggtggaaagctctctttgttttaagctcacttctagtccactcccatgttccgccgatcataccgcatactccatagggactttcaccattttgttcaaaaatatcacttgttaaatgatttaattctttatcagcatgagcttttaataaattttctctccaggactttaaagaagtaatgggttcattataaagacttccagcatattgaacctttgcaggatcaaatttatctccccaaggccagacattacccttttcgcctcgagcagctttttcccattgaaactcggttggcaattctttccccttatatcttgcgtaagcaaatgcatcataaaaatctatacctgtaacgggatgattatctaaatacctatcatcccaatatgtatttcttctatgttgtttattctgcggttcattaggatgacagaatatatgcccattttcctctatgaactcggtaaagatatcataatctttatttgtaacaggatacttatcgataaaaaatggaggtaaccatactttttgtctaggaacagcatctttccaattaaatgttttgtcaggaatttcattttcatttaaaccgaattcaaaaaagccacccggaattaaaatcatcccatcttcttctgttttttcgaattcctctattagactttgaggaattttttcttcaaagtcaaagttattaggaagtataccattttgatcaaaataattttttagcattactagctcttcatgtttttcaacaccgaatatatctaataatgtacttaatactttttgggcccctaatcccacaggttttttagggtagcttatactctcccggacatcatcaataatcgaagacaaatatgctacagattcttcaattttatgatttgcacagacatccatagctttaaaagaaactaaatcatccggatcctgggttagattgattatagtttctacagcagagaaataaggtacccatttttcaacgaaatcaattaatctataccttatgtaagtattcggataagcaatacacatcccaaacacattttccgctgctacagggtgttgaattttatttagtagagtcataattctattatcgattaaactcttaaaatcatttttttatttctggaacagaagtaataagttcttcaacttcaattaatatttctatatctttattgtaaattgatttatgatcttgcattaatagagtcaaattacgataacctcccgatttgtttgttgaaataaggaatagcattaaatgctattccctaagtgtttaccatttttcattagtataaagaaccgggctaacaatcgattttctccagttttttcttaattttctcatggttttcccccctttaataagatatgtggttccctgaatattgatagaatagtcagagaacttaaataaacaataacaataaatagaataaaagtaaatagtttacaaggaaattttttctttacttttgttgttttaaggtgtttaaatatgtttaagctctttaccgagaaaaattattccaagggaggatacatatgagtaaaggttattattctattttatttagccagaccactacaaatttaggtttttctctatatactatggtagtgatttcgtttttgtttaaaatgaccaattcgacaaccatcgcctctatggtgacattaataagtattatttttcgtatttttggaagtgctatattaccgttaataacaattcgattaaaactgcctcttacaataattatttctcaattgatacaaatgctgttattaatatgtttgttctatgctttattaagaacttactctaatcaaactctcattttagtctttattattattagctgtatttccttttttaatggatggttctcacctttaaaaagtgcaattataggggaaataatctctcctgatagaagagtaaaagcaaatggattattatctacagtggaccaaacttttcaatttgtaggctggtctttaggtggtctcataattgcatttttaggtgagggatataccattatacttactatctttttgttgtttacatctcttctttctcttttattttgtctaccacatggccacgctaattctgtcatacgtgaaaaaaattctcccaataagagtatagtaagtggttggcggtatttatttagccaaaagaaacttagaacaattattattatggatttaattgagtcatgggcaggaatgatttggataggatctgtctctttagctttcgttaacgaagtcttgcataaaggagaatcatggtggggatttattaatggagcatattatttaggttcgatgatagggggatttataatatataagctgtcggagagatttcaaaataagttaattaattttatgttaattggcgctgtctcatatggaagtttaactttaatatatggttttataagtaattcatacttagctctaattttggttctctttatggggccggcttatatattaagagatcttacacaagaaacacttattcagaacataacaaccgagcaaactcgaattaatataatgtctgcaaggtcttctttagtacagttcatttttatgttttcaattctggctataggggctatttcagatttccttggagttcgtttagtttatgtttcagcaggtattcttttattagtgtccgcaatatatggattttctcaattacaattcaaaaaaaggtaaataaacatataagcttttaataaatatataaaatttaattatgttttcgtttgctttttcgcgtgtttaattaataagtaaacattactttattgaccaaaagaaaatggttgagtaccatcaattatctgtttcagaaaaactcggcataaaaggaaaaaattgaacaaatctttgctgatgtaaaaaaatcgcatagactttgctattgcagattgatgcgaaagcaaaatgtgaacgactaagctccccctcgcagatgcttgcaagaatatgaaaaagaatcgacatacacactagccaatcttagctaggtgtacaggagctctttttctgttctgttttctaataatgataaatgactaaagagaacttttaaaacaaaagagcttgtagaaagcataagctcatctataaccttttttgtatgccagcttaccttttgtatttcctctcctgtccatgttacagtggtgtcaaccaagtgataggaggatgaaaatgacagcatctcagcagcaaattcaattagcaagacgtccacaaggtattcctgttcatgaagactttcgctttgaaaccattccggttcctgaacccaagcaaggggaagtgcttgtcaaaacgctttatgtatcggttgacccttatatgcgcggccgtatgcaggatacgaagtcatatgttgagccgttcgccttggataaagcgctttctggaggggttatcgctgaagttgtgtcagacgggaatcatctgaaaaaaggcgatatcgtcatcggaaatctcagctggcaggaattttccgctgtgagcgagtctgccttgcgaaaaattgatacaagccttgctcccgcttcggcctatctcggcattttgggaatgaccggcttaacagcatacttcggattgctggacatcggacgcccgaaggaaggcgaaaccgtggttgtctcaggagctgccggagccgtcggttcaacagtcgggcaaattgccaaaatcaaaggcgcgcgagtcgtcggcatcgcgggctctgatgaaaaaatcgactatttaaaacaggagcttcagtttgacgaagccatcaattacaaaacagcggatgatatccaaaaagcgcttcaaaacgcttgtcctgacggtgtcgatgtgtattttgacaatgtcggcggaccgatttcagacgcggtgatgaatctgctcaatgaatttgcccgcattccggtgtgcggcgccatttcttcctataacgcagaaagcgaagcagatgacatgggccctcgtgtccaatcaaaactcattaaaacgaagtcgctgatgcaaggctttatcgtaagcgactactccgatcgtttttctgagggagcaaaacagctggcagaatggctgaaggctggtaaactccattacgaggaaaccatcacagaaggcttcgaaaacattcctgacgcgtttctcggtttatttaagggagaaaataaagggaaacagctgatcaaggtcagtgatccgagctgaatgaagatgaaaacgggagggctttttgccctccttttgtgtttcgatgagatcagttgcgaagaatcagcgtaagaaaaccatcttcatcaggttccgtgtcttctaaagtgaatcctgctgcttgaaagcaagctaaactgattcgattgtcttcttcaatgcatgccacccattctcgcacgctagtaaaatcaggttcggtcatcagcttttgcagtatctgttttccataccctttaagccggtacaaaggattgacgatcaatccaatatatgtccgctcctctccgaactcaataacgaccatccctgccggcagctgtccatcatacgccatgatgacagtatcgtgtttatctttatttactcgtgcataccactcatctaatagcagcatcccatccattctccgtctggtatcctcattctcaaaccagtgttcaaggattttcagctctggctcctgcattacttgaaacctgtctattgaagccattttcccacctccgcgcaaaatcttttctattattttacaacaaaaaaagggctcttcgcccttctttttatttcgtcttcagttttccgcctgcatacacagcttcactcagctcaacaccaagcttcttcgccatttttttcagcttagattcctccaattttgtcacaaggctcagcacgttgccttcttttccggcccggcctgttcgtcctgatctgtggacatagccatcttcatctggaatatcagcatgaatcacgtatggcaggttttcaatatctaaaccgcgtgcggcaatgtcagtcgccaataaaagaggaaactctccgtcttcgaatgtggcaatgattttcgctcgctccatttttttcgcttcactgtgcaaaacgccgagttcaacgtggtgatatgccagtttttccgcatatacactcaggttgccaatgtctctcacaaatacgagtgcctgcatgccttcaagccttgacagcttttgcagcagcttcactttgtcgcgctggtcgcaaatcaggtattgatgcttcactttccctgcctccgccttgcttcgctgcaccttcaacacctcaggctcttgcgccaattcgcggagcacgtcctctgtttcctttttgagcgtggcagaaaaacatagaagctggcggtctcttaatgttgttttaatgatttgcttcatcgtttcgcgatgctccggcaggacgagctgatccgtttcatcaagcacgatcgttttcacttcatgcattttgagtttcttcgctttaatcagttcaaacaccctgcctggcgtgccgacgatgatatgcggatgtttcttcagcttttcgacctgtttcttcacattcgccccgccgattaaggaagccgcgcgcagctctgagcccgctttccaatcctgaatcacctgaaaaatctgcatgaccagctcacgggaaggcgctaaaatcaccgcctgcggatgcttttgctctggtttgatccgctccaagaccggcagcgcatacgccagcgtcttccctgtgcctgtcggcgattctgcaatgacatcctttccgtccatgatcagctgggctgcctgctcctgaacaggggttggcttttgaaagccggaagcattccaattctcttgtataaatgattgtgcattatgtaaaaatggccaagtttgcgtcattttgttctcctcaattcctgaaatctattccatagtatctcaaaacctcgcccggaacgcaatttttcttttctttcctatacctttcaacattccgaatcctcctttataatcaaaagggtgaatattacacgccgattgtgcgtgtttgataacgatagaggtgtaaacatgagtattttatctgtaaaggatttaagccacggtttcggggaccgggccatttttaataacgtttccttccgcctgttaaaaggcgagcacgtcggcttgatcggcgcaaacggtgaaggaaaatcaaccttcatgaatattattaccggaaagcttgaacctgatgagggaaaagtcgaatggtcaaaaaatgtccgtgtcggataccttgatcagcataccgtgctggaaaaaggaaaatccattcgcgacgtcctgaaagacgcattccattatttatttgcgatggaagaggaaatgaacgagatttacaacaaaatgggcgaggctgatcccgacgagctcgagaagctgcttgaagaagtcggcgtcattcaagacgcgctgacaaacaatgatttttatgtcattgattccaaggtggaagaaatcgcccgcggtctcggtttgagcgatatcggtttagagcgagatgtcaccgatttgagcggcggacagcgcacaaaggtccttctcgctaagcttctccttgaaaagccggaaattctgcttctcgatgagccgaccaactatcttgatgaacagcatattgaatggctgaaacgctacctgcaggaatacgagaacgcgttcatcctgatttcccacgatattccgttcttgaatagtgtcatcaacctgatttatcacgttgaaaatcaagagctgacacgttatgtcggcgactaccatcagtttatggaagtctacgaggtgaaaaaacagcagcttgaagcggcctacaaaaagcagcagcaggaagtcgcggagctgaaggatttcgtcgcccgcaacaaagcgcgtgtcagcacgagaaacatggcgatgtcccgccaaaagaaactcgataagatggatatgatcgagcttgcggcagaaaagccaaagccggaattccactttaagccggcgagaacgtcaggcaagctgatttttgaaacgaaggatctcgtgatcggttacgattccccgctgtcccgtccgctcaacctccgcatggagcgcggccaaaaaatcgccctttacggcgcgaatgggatcggaaaaacgacattgctgaaaagtttgcttggtgaaatccagccgctcgaaggctctgttgaacgcggtgagcacatctataccggctatttcgagcaagaggtcaaggaaacaaacaacaatacgtgcatcgaagaagtatggagcgaattcccttcttatacgcagtatgaaatccgtgccgctctggcaaaatgcgggctgacgacaaagcatatcgaaagccgcgtctccgtattaagcggaggcgaaaaagcgaaagtcagattgtgcaagctaatcaactcagaaacaaacctgctggtgctcgatgagccgacaaaccacttggatgccgatgccaaggaagagctcaagcgcgccctgaaagaatataaaggctccattctgctcatttcccacgagccagacttttatatggatattgcgacagaaacgtggaactgcgagtcttggacgacgaaagtgctttaatttataaaaaaacccgcctgctaaagggcgggttttttactgccattttttctgaacgattctcaaaagctctctgtcttttaaaatgagctgcaatggagatgtgaattcatcaagtgtcagctctcttttggcagacagctcaaaatcctcctcatcttcccaagcggtaaaccactcgaccgagaaaagctgtttttcatgacgctgtgtatgtattgatagagcgtttctaaacatttctgatcatattcgtcaggttttgccttatccatggcaaacgtcccctctacagcatgaaccatcactgaaatggcaatcgtaaatgaacggacacattctcagcttctgcaagataaatcccagccgcatcaatgcctgaccgaagcggatgccctttccgcgaacgccgttcttgctgaccgaaaaaaccggtttctaaagggagttttcagccggaaaatagtaaaattgtgtcataaaggttgtcctttcctgcaccaattcgattatgatgcattataacgaataaaaagacactgcatatgcgcagtgtctttcgttattaatgccccgccttaattccagcaagatgtttacgtcccatgagaaggacaagcatgccgacaaaaacgacgattccgcctactgtatatggtgtgcttgcagtaaagtgttctgacagcattcctgcaatccacggggcgagcgcgccgccgatgaagcggactgagctgtaggctgaagacgcgattgaacgttcaaccggcgcagaacccatcacagcggttgtcatgatcgtattcaccataccgaggacagcaccagcgacaacgatacatgtaataatcaaagtctgatggtctgtccagatccccataataacgagaatggccgcaaaggcgataaagagaacgactagcgaacgcactgtgcccagcgctttgtgcacgagcggcgccgtaaagactgacgtaatcgccagcagaaggccccagccgaagaagacatatccaagaccgtgttcatctaaatccagtacgaacggagaataagctagcaaaataaaaaatccaaagttgtataggaatgccgataccgccattgtcagcaggcctttatatttgagtgccttcatcgcatcaaacacaccgacgcgtttcgccggtttcggcagcttcggaagcatgaaagaaatcgcgattaacgcaataaacatcaggacagatactccaaaaaacggtgcgcgccatgaaatgcttccgagctctccgcctgcaagcggcccgacagaaatcccgagaccgagcgcggcctcatacaaaataatcgcttgggcgctgccgccgactgacacgccaacgatgaccgcaagcgctgttgaaataaacaaagcattccctaatccccagccgccgcgatagccgactaactgagcgattgagcttgagctgccgccaagccccgcaaacacaataataaaaataagtccgagaattaatgtccatttcgcgccgatgcggctggaaatggctcctgagaaaaacatcataaatccggttacaagcaaataacttgtaaacaagagtgatacttcactaggtgaagcatgcaattgtgcggcaatggccggaagaattggatcgaccagcccgattcccataaaagaaatcacacaggcaaacgcgacagcccataccgcttttggctggctgagcaaacccgttttctgattcacttgtgttgtcttatccatttgacctaacctccatctttattccattaaaagaaacgctacaaaaatagcgtttaacaaacttttcattcgattgattgaatggcgcgttccgctttgcctttcatgccctgcaggcgttctttaaagctttggaatgtgcggattttctcatcaatcaaatccagctggtgattcagggtttcctgaatttcctccagtttttctttccgttccttaggatccagtgacaacaaatacccctctttgtttaactctagctggcggctggtttccatgaaatgctgaagctcctgaagggaaaaaccgagcacctcttttgtgctgatgactttctcaagctcctccatatcatcctctgaataaagccttacaccgccgtctgtccgtttcggcgccggaatcaagccgatttcttcataaaaccggatggtccgctttgtcagcccgcttcttttggccacttgatcaatcttcatccattccaaggtaaatcccccttcgccgtttctgttaccattatacaccttttgaaccttaacgtaaacgttaagttttaaaaaacaataaaaaagacgagcagcatacagcacccgtctttcactttcctgtttaagctaaacttcccgccactgacagagactctttttgaaggctttcagaaagcactcgatacgcgatcactttcttcttgtactgtttcacgacgtcgatatggtcgtcgtagcggtacacgaacagcttcacgtcttttttccttttttgtatctatcaccagaggcgtgccgccgttttccggatgtaaataacgctcttcatcacctggatagatataatatttttccaggaagatagcttcgttaaattgatcaatcactttctgcttctctgcaccctcgaggcgttttccatctagagagagactcgcattttcgtcactcagcttggcgtgcacttcaaatttgccgagcagccattctatgacgcctgtaggaagacaggttaatacgattttcaccagactcatgagaattaacatcacgatcgcccatgtcatacttcatcatctccgttagttttccatgtgccgctgacacacaactttatcctaacataagcaggccggttcgtttttgtccattatgtgaaaaaaagcgcggcctgctgcggccacgctttttagctttccagttcttcgatcatgagggacaattctgtccagcggtccatcgcagcctcaagctcttccgccgttttcgcctgctcggccatcagctcttggattttgccaaaatcactgcctgctgcggcgatgtcagcttcaagctgttcatgcttttcttccagctgggcaattttatcttcgatgccgtcccattccaactggtctttgtaagaaagctttttccgtttttcttcggctcggcttcagccgttttttcctcagctgccggttttggggccgcttttttcgcttttgactcctccatatagtcgctataggagccttgaaagcgggaaatgacaccatttccttcaaatacaatcaaacggtcgacgacgcggtcaaggaaatagcggtcatgggatacggtgatgacgacgcctgggaactggtcaatataatcctcaagaacgcttaatgtttcagtatccaaatcgttcgtcggctcatcgagaaacaggacattcggctcctgcatgagaacctgaagcaagtataaacggcgtttttccccgccggacagcttgcggatatacgtctgctgcatcgaacgcgggaagaggaaacgctcgagcatttgttcagctgtaatcatatcgccatctgccgtttttacgacctccgccgtttcttttatatagtcaatgacttttaactcaccgttcatttcactatgatcctgagtatagtagccgattctgaccgtctgtccgatcgtaatatcgcctccgtccggcgtatgacggccggcaagggcatttaacagcgttgttttcccgatgccgttcggcccgatgatcccgatccgttcacctggtatgacaagttcattaaaacggtcgacgagcatgcggccgtcataagcgatcatgacgttctccgcttcaataacctgttttccgagacggtgcgagccaatggcaaaatcgagtgaacctgatgactgagggcctgtctgctctttaagcgtctctacccggtcaattctcgctttttgttttgtggagcgggctttcgctcctcgtctgagccaagccagttcgcggcgcagcaggttttgccgcttcgtttccttttgctcagcctgcgcttcccgttccgcgcgtttttctaaaaacacttcatagttgcctttgtaagtgtagaggctgcctctttcaagctcataaatgcggttggtgacacggtttaagaaatatctatcgtgcgtcaccagcatgacggcgccgggatattggcttaaatacccttcaagccactcaatcgtttcattatccaaatggtttgtcggctcgtccaaaatgagcaaatcagcgggctgaattaagtttttggcaatggccacccgttttttctggccgcctgagagctcattgaccggttttgttacgtcgttgacgcccagcttagacaatacggtttttgccaaggtgtttgcatcccatgcattgttcgcgtccattttcgcttgtgctgccagcaggtgtttctggcgctgttcattttcgggatctttccccagttcatacagcgctttttcatattcacgcaaggttttcatcacagccgattcaccggaatagatatgctccagcactgtttgccccgcaggcagctccgggtcttgatgaagaaattcgacctgcacgcttccggatttcgtgatttctccttcttcgatagattccaagccggcaatcactttcaacagcgttgattttcctgttccgttcggcccgattaatccgattctctcattctcttcaatatgaaaggagatatggtcaaataatgttttatctccgtatgttttataaagattttccgcttttaatatgctcatggttcctatcaatcctcacgtaagttcatgtgtacattttaaatcagccgctggaataaaactagtaaaacgtcagacgaatttcatggaaatgcaggataagaaaaagaccggggatgtttgtccccggtctcttactcttcctcaagcgctttttcggccattttcgcaagatgctgcgcgcttcctgaaatctcctgcatcgtggcggaaatttgttcaacagcagcggcttgtccgtctgtatgctggttaatcgactcaatggattcctccagccctttcagcaggctgtggatttttttcgtaatctggtcaatttggccgacattttcttttgaatgcgtcgctagctttctgatctcatctgcgacgacagagaatccttttccggactcccctgctcttgccgcttcgatcgcggcgttcaagccgagcagattgctttggtccgagatgcctttaacagttactgaaatatcggcgatttcaccggcgctttcgcttacttttttcgcctgagaggaaatgcccgacatttgagttgaaaacccgttaattgattcagaaatgtcggaaatagccgcggctgtttgttcaacaacagctgataagctttccgcgacatcatgcagctttgacgactcctcaaggctcgttccgaggccgacgcctccaatgactcttccattctcgtcgtgcagcgggatggcacgcgcgatcaatgggaagccgaacaattctttcggaaccatgctcgtcttcttctgattgctgcggatggcatctgtgatgatatccccttcctgcagcggatcgccggcttttacgttcagcgaaaaggttttggccggtatattcacgagcagtttttccgtatcataaatgccgattgtaatatcatcctgaaccaggctgtttaaataaggggctactttgataaatgcgtccagaatatctgcggtttctttttccgtatttatggtcaattccattcactccttttcattaataagggaagctgcgtttttcgtgctggaccgagatccatttcagcgttgtaaattcttcgaggctccactcaccgtttaaacggccgaggcctgattgcttttcaccgccgaaggctacattcggttcatcattgatggtcgtgtcattgacgtgaatcatgcctgtttcaatgcgtttcgcaaaagccacgccgcgctcaagatttgacgtatgtacggcaccgctcaagccaaacggggtttcgtttgcgatatccaccgcttcgtcttctgaatcaaacttcataaaggagacgactggtccgaacagctcttccttggcaatgctcatgaacggtttgacgtcttttaagatcgtcggttccacgatcgtcccgttaaatccgccaagcttcactggtacagcgccttcttcaattgcttgctctacagtcttcatcagcccgtccgtctgtctgctgttgattaatggcccgataatcgtatcagggtccattgggtcgccgactttcagcgattccacttttgcctggtacagctcaaggaacttgtcataaatagaagaatgaacaagcacgcggttggctgacatgcaaatctgcccttgatgtgtaaatcggctgaacaccgccgcattgaccgcatattctatatctgcatcctcaagtacgatgaaggcgctgttcccgccaagctcaagaagcggctttttaaaatgcttcatcgcaagctgtccgatgtagctgccgactttcgtagaaccggtaaatgagatgatccgcggcactggatgctcaacgaagctgtcgccgatttcagcaatgtctgtgacaacaacattcagcagccccgctggaattcccgcgttctcaaaaattttcgcaatcagcgttccgccgcaaatcggcgtttcctcatgcggctttagcacaacgccattgccggctccgagtgcaggcgccactgatttcatagataaaaagaatgggaagttaaacggactgatgacaccgacaacgcctgccggcacgcgatataatctgttttccttgccatctattgttgacggaagaattttcccctccatgcggattgggaacgttgccgcttcttttatgatgtttttgacaagaccgatttcaaaagctgctttgagccttgtaccgcctagctcctccataatcaaataaataatggcttcttcattttcttcaatatacgtgacggctttttctaaaatggttcttttctcgaacgggttgaccgcatcccattttttctttgccagcgccgctgcccgatacgcttcatctacatcgtcagcagtcgctttacggaatgttgtgaatgttttttgagtataaggatttttgttttccaatacatttgggctgctgccctcctgccatttcccgccgataaactgtttattcaactcttcatattgaaacatggtcagcatctcctttataaccgcaaatcaaaatatgggcgaatctattttttctatcggttcatcttgcataaaattgaatatacgattagtaaaaattactatcctatgatacgacaacgctgtttcgcttctatcatttaaagcagaaaaatattttattgactacgtcaaatttcgacaatataatacaacaagaactgcatataatgattagaatattttgaatatttctaggaggaacttttgatgagttcattatttagaaaaaaaccgcttgaaacattgagtgcgcagagcaagtcaaaaagccttgcccgtacgttaagcgcatttgatttaaccttgctcggtatcggttgtgtcatcggtacagggatttttgtcattacaggaacagtggcagcgaccggtgcaggtcccgccctcatcatatcgtttattttagcggggctcgcctgtgcgctggctgctttctgttatgctgagttttcgtcttccattccgatttcgggaagcgtgtactcatactcatacgtgacacttggagagctgctcgcctttttgatcggatgggatctcatgcttgaatatgtcattgcactgtcggcggttgccaccggctggtcttcatactttcaatcactgcttgccggcttcaatcttcatattccggctgcactgacaggagcgccgggaagcatggcgggcgccgtatttaaccttccggctgcggtgatcattctcctcatcactgcgattgtcagcagaggcgtcaaggaaagcacacgctttaacaacgtcatcgtactgatgaaaatcgcgatcatattattgttcattattgtcggcatcggctatgtgaaaccggataactggtctccttttatgccattcgggatgaaaggcgtcatacttagcgctgccactgtattcttcgcgtaccttgggtttgacgcggtttctaacgcatcagaggaagtgaaaaatccgcaaaaaaacatgcccgtcggcattatttcagctctagccgtctgtacggttctgtacatcgcggtatcgcttgtgctgacaggcatgatgccttatgccaaattgaatgtcggagatcctgtatcctttgcgctgaaattcgtcggacaggacgctgttgccggaattatttctgtcggtgcgattatcgggattacgacggtgatgctcgctttgctgtacgcacaggtccgcttgacatttgccatgagcagagacggccttctgcctggattgttcgcaaaggttcatccgtcatttaaaaccccgttccgcaacacatggctgacagggatcgttgcagcgggaatcgccggctttattaacctcggaacgctggcccatctggtgaacatgggaacacttgccgcgtttacggtcatttccattgctgtcattgtgttaagaaagaaacatcctgaaatcaaagcgtccttcagagtgccattcgttccggttgtgccgattatcagcgcaggcatctgcctttggttcatgtacagccttcccggcgtcacatggctttcatttgtcatctggatcgctgtcggaacgctggtttacttcctatattcgagaaaacacagcttattaaacaaataatctcttttcagccggcggtgcctcacccgccggctttttccttttttatgtgctatactttgaatacatatgagaaagggagacacacagatgaagcgataccgcactttattatttgatgtagatgataccatccttgattttcaagcggcagaagctttagccctgcgtttgctgtttgaagatcagaacattcctttaacaaatgacatgaaggcgcagtataaaaccatcaatcaaggtctctggagagcctttgaagaaggtaagatgacacgggatgaagtcgtaaacacacgtttttccgctttgctcaaggagtacggttacgaagcggacggcgctttgcttgagcaaaaataccgccgctttcttgaagaaggacatcagcttattgacggtgcatttgatctcatctcaaatctgcagcaacagtttgatttgtacatcgtgacaaacggcgtgtctcacacacaatataagcgtctccgtgattcaggattatttccattcttcaaggacattttcgtttctgaagacaccggcttccaaaagccgatgaaggaatatttcaattacgtgtttgaacggattcctcaattttcagcagagcacacattaatcatcggggattcactaactgctgatatcaaaggcggacagctcgccgggcttgatacttgctggatgaaccctgacatgaagccgaatgtgccagagatcataccaacctatgagattcgtaagcttgaagagctatatcacattttgaatatcgaaaataccgtcagctgctaatcaggctgacggtatttctttcataagaatcttttttcctcttgataaattcttcaccttatgaataatatggtggtatgctttggttatatatgtaaggaggagactcaatggctatcgccgccccgttaaaagaaaaaacagttcaaaaaccaggcaccacggtgtatccgattttgattattatcggaatttgccatatgctcaacgattcgcttcaggctgtgattccggccatgttccctattttggaacgctccatgagcctgacgtttacacagctcggcatcattgctttcacattaaacatggtgtcatccgtcatgcagcctgttgtcggctggtataccgataaacggccgcggccgtatgcgctgccagtcggtttgaccgccagcatgcttggcattttgggccttgcatttgccccgtcattcataacgatcttatgctgtgtgtttttcattggattaggctcggccattttccatccggagggctcccgtgtggcgtatatggccgccggcacaaaacgcgggctcgcccaatcgatttatcaggtgggcggaaactcaggccaggcgatggcaccgctgatcaccgcgctgatccttgtgccgctcgggcaattcggcgctgtttggttcacgcttgtcgccgcgcttgctgttatgtttctcatgtatattgcgaaatggtacgcctcacgtctcggcagccttgcccagaaatcaggcaagcaaaagaaaacggctgaaaacacggccatcaccaaatctgttgtatctgctcttattattattatatttctcatttttgctcgttcttggtatacgagtgcgatcggtaacttttacacgttttacgcgatggatacctatcacgtaagcattcagcaggcacaaagctatatttttgtcttcttgctgttcggcgcgatcggcacgtttctcggcggcccgcttgcagaccgttttggaaaacgcttcgttatcctcggttcgctgttatgctcggcgccgctggcgattgtgctgccatttgccggcccggttctcgcctacggcgtgctcgcattgattggcttggttctgatgtcgagcttttctgtaacggtcgtctacgcacaggagctagttcctggaaaaatcggcacaatgtccggtttaaccgtcgggcttgccttcgggatgggcgcaatcggcgctgtggcgctgggcgctctgattgatgccgcgggactgaccccgacgatgatcgccattgcctttctccctgtcctcggcatccttgccttcctattgccaagtgaccagaagctgagagaatggcatagctgaaaaaacccctgccaggcggcagggggttttttaatccagctggataaaatgagtgtcaggcactgcgtgcttcgggataaagccatccgcaaagtccggaaacgccgactgtatttcatcaatccatcttttcagatttaatatatagggcatataaatcatcttaattgtcgcttcgtcttcaatccggtagtaccagcaaagattaaactctttttctgtcaccagcgtaaacccagagaaatgatagaaaatcagcggcgtttcatctatatacacgcggccgtccttttgcccgaccttatagttttcgatattccaaagcgctgtattggctcctatggatttgacaacatgaacacctttaaactgctccggccatttctccacatatctttgatcaccatatgtctttcgttccgtatccatttcgaccgtgcaaaattcaatacagtcctgtctccactgccacaccgcttcatatgcttcctttgtattaccggcgccgacaaagcctgtattaaagcgtccggttcggtcgtagtaggacatgaagcgcggcgaattacgatgatcagtcaaatacagagacgccgttgggttttctgcaaaaatacgtgccggatcagaaaagaaaaatagatccgtatccatatgggcaaagtattcagcgtcatcccacttgctcatcacatgaaacaaaaaggcgggctttaacgtccagcaatattcatgaaacgttctgttgcttttcgctttcaacagctccgggtcttccatttcatgcagctgcacaaaggttacatgctcccatggaacgtgctgaagcaattcatacgctttctggtcgacacacagcacatataaatgaaaatcatcgcaatgctcatggagagaatgaatcataggcatgagcttaaagatatgtgtccttgacactatcgttgaaaaatgaaatgtactcacttataccacatccaatgatctaagatccacgtgcagcaaatcgttgacaagcgcatacagtgcgttggcaaaatcgttcacgcctagctttttcttcgccttaggcagaagcttgcggacagtttgcaaatcaaagcttttcgccgtcacccttggggatttctttcgccaatccggatcaatgttgcgctctttaacaacatgcagaagctcaagaaacagattcagcagcatatcatatttctgtgattccagcagcttttgaatatcagccatgattctgttcgtcatgtcaggcgggaacggcccattaaaagcgagatgaacgtctaaggagcggatgttattgtatttatcgcacatataggcaatgtttgcccgaatatcgtctacagacttacaattgcttggatgttcctgatgaacactgacaatatcacggcgaagcctgaaggtcaatccggcctgatgaagcctgatcccgaggtcataatcctcaaacccgtaccgcacaatgccttcgtcaaataaaccgaggtcaaccacatgcttgcgtttcacagaggaattattcgtgataaaaaagcgccatggcatatgatagcctttcaagtcatcgccgtactcatctaaaatcttcttgagcacgtctataaagtcggtatcgaggtcaaagcttttatcaagaaagcttccgtttttgatgtccgcttcctccagcagcttttgtttgtctttcttcggcatttcacctgtgagctttgcgagctgttccttatgttcttcttcaaatcgttcatagtaaaaactgtagatccgtttccaaaacaacccgcacacgacgagattctcttcgttctcatgggctttaatatgttttgccacaaggtcctttgccgcaagcatatcgctgtcatggaaaatcaggatgtctcctctggcattgcgaagcgcctgatttcgtccgtacgcaatgcccctgttttctttaatccgtgtaaagatcagcggaaaatcagcttgaaatgactcaagcatcgagagcgtcccgtcctcagagccattgtccgctacaatgacttcaaattcttcatcgcactcctgctggtttaatgacagaaggctgttgtaaagacgctccttcgaattatatgcaggaataataacgcttgctttcacttcattttcacttcctgtatttactcatttatttgttgtcatcttttgaagcaaaaccgttaaattcagggtctaacgtttgcatgtgctgaatgatatgcggcagtgtctcttgatacagttcatgcacaaacggcagatctgtgcgggttgtttcatgaatctgtttgatttcattgatgctgacgattcggtatccgctgaaatgataaaagatcagcggactgccatcctccagcacgatccggccatctttccaggaaaacgtatgctgtccataattccaatggccgatgttcacgccgggtgttgtaatgtcacacacattcggaaacagctcagacatataatccaaatagccctgatcaccgaatttcccttcacccggtgcatttttgcattcctcaagacagcgttccttccaccactccaagcaatccgtgcctgcatcatcatgcttgaagctgataaacccggaattatatctgcctaaaagacgctgcagcatgtcaatctgctctttctcaaaagaagggattacaatatcccctcgtgaaagcaacaccgagcagtccggctggttttcaaaaatcggcgatggatctgcatagaaaaagagatccccgtcaatatacgtcacacgctccagctcaggattgctgttcagcacagcttgcagaaagatcggcttcatcgtccagcaatactcactttgatctctagtttccttcagcttcagcagcaattcattttcaagagcggccaccggcacaaggttcagctgcttcatcttcagcttctgtaacacgcggtgcgtatcttcatccatgcaaagtataaaaatgggactgtcttgatcaacttgctctaacgacttaaacaaagcgactgcctgatataatcttccttttgataaaacggtgcaatacgcgctggtcacagtcttgttcacctcgtttcacattactttttgaagaattccgtataccactcaatcgttttttcaagtccctcatcaatagtgtaggccggtgtccaattcagcagctttcttgctttttccgcggataaatattgatgtttgatttcattgcttccctgattcagcaccttaggtttcagattactgttcattttctttaatattttctctaccagttcaagtacggtcagctggatctcattgctgaagttaaaggcctctccggcaagattgttttcttccattttttctgcaagaagcagataagcctgaacggcgtcttcaatatagaagtagtcccgtacaaatgtgccgtcgcttcggatttccggcgcttccccgttcagcacaagctgaatcgtctgaggaatgatgcggttgaagttcaaatctccgccgccgtataagtttccgcagcgcgtaatgcagaccggaagcccgtacgtgtgaaaataggtgtggctgatcagatctgcgcagctttttgagacgtcgtacgggtgcttgccttgcagcggcatgttttcatcgtatggaaggttttcttgatcgccgtaagctttatcacttgaagcgacaatgacccgcttaattaacggatgcttgcggcaggcttcgagaatattccaggtgccgaggatattcgcttcaaaggtagaaatcgggttgcggtttgccacgccgacaatcgcttgtgcagcaagatgaaagactgtgtcgatctcatactcgccaagcgcgcgttcaatcacagccaagtcctcaagagagccccgcacgatgttcattttcttgatatgttctccctgataaagattggattgaggcacatgatccctgactagccccgtaacgtttgcgccctgttcgatcagctctttcaccaaatagcttcctaaaagacctgtgcatcccgtgacaaatacgtttttatttttccagaaactcaaatcaattcaccataccttccatacttgttgtccttgattccacattttgttgacttctaagagatttttatacgtatcgatggccgtccaaaatccgtaatggcggtacacagcaagctccccatctttggcaaggttcttcagcggttcatcttcgaacatcgtgttcccgtccttcggcaaataatcgaaaacctttggactaagaacgaagaatccgccgttgatgattccatcacttgatgtcttctcagaaaatgttttcgccatgccatcctcaactgtcaaggtgccaaactgcgagactttgtcaatgccggtgacagtcgcggcagcaccttttgtctgatgatagctgatgagatggaaaagattgatattggccagcccgtctccataggtgagcagaaatgtttcatcaccgatatagtctttcgcctgcaagattcttccggctgtcagcgtatctaccccagtctccaaaaacgtaattttccacgtttcaggctgccccagcatctgtacctctcccgtagagctgtcgagtgtcaggctgttgtgcttccattcatagtcgagaaagtattccttgattttttctcctttatagcccaaaagcagaataaactcgtttactccgtagtactgataaattttcataatatgccatagaatcggtttgccgcctatcatggcgagcggtttaggaatgtcattcgtgacttcactcattctcgttccttttccgccgcagagaatgaccgctttcatctctacccctcatctctatgaatattgagttcgaaacctggtacatcttcacaatctatcaaggcatttccccgataatttgtccgatttcaatccggtttcaaaatctactgtaatgatatgagagaaagccagccttggtgaccaaatggaatctattttttcaagttggttgtataaccaaaaaaagagccttgagcgaaggcaatgcgcccgctcaaggctctttttcatcttatttgatttctttctccttgccgtaatgatagtctgacggatcaacggctttgaaatcatttagtttatggaacctcagcaagtctttgtacaggacactgtctgaaaggctcagctgctggttcactcttgttttcagattcttcgtttcttcattcgctttcagtttttcacctgtcttcgtatcgtaaatgatattgtcgactgatgtgtacttcggcgttacgaagtctccgtttctgaatgccaccgtatcgtcgtggtctttagagaataaatcagtaccaaagttgatatatttctgagaatcaattccttctaagtgcagaagtgtcggcatgacgtcaatttcgccgccatacgtatggttcactccgccttttttgccaggaacgcggatcatcagcggcacacgctggttctgtgcgttttgataatctgtgatctcttttccaagaatctctttcatcgctcggttatggttttcagaaataccgttatggtcaccgtaaatcatgatgactgagttgtcatacaggccggcttccttcagctccttgaagaattgctcaagcgcttcgtcaaggtaacgcgctgtctggaagtagctgtcaactgtgttatcgcctgttgtcgcttttttaagagacgcgtctttttcatcaaggttaaacggataatggtttgtcaatgtaatcaaatgcgcataaaatggctgtttaagagattcaagctttggaatcgattctgtaaagaacggcttatccttaagccccatattaatcacattttcatctgacatatcatacgtgcttgcgtcgaagaacttgtcatatccgatatgtttgtaaatctggtcacggttccagaacgatttgtaatcaccatgcaggacggcgcttgtatagccttccttctggtctaaaatcgcaggaagcgactggtaggtgttttcgcctttcgtcacaaacgcggagccttcaggaagaccgaagatcgagttatccattgtcagctcggcatcagatgtttttccctggcctgtctgatggaagaagttatcaaaatacgtcacatcttccccgccgtgcgcaagtttatttaagaaaggcgtcacctcttcaccgtttagcttgtagtcaatcaggaatgactggaagctttcgaggtgaattttaatgatatttttgcctttggcagagccgaagtactcggcgtttggtttcgcataatgagacgtcgtgtaattctcgacacttgttaaatcatcgctgcttgcataggctctttgcgtctctgtttgagccgtctgtacaccgtcataaatggtgtagttgtataaacctaaatatttcacaatataattgcggtcaaacgttcttgtcagcagttgcggacggtctttttccgcatagtgcaggttgatgaaaaacagtgcgatcccagaaaggatcactaaagatgcaaagcgttttttcattttgtattcttttaattcaggtctccagatcaataccgcaatcaaaatgataatatctaagaaatagaaaatatcatgaccggccatgatactgaaaatcccgtctcccatgtttccaacgtttccggactgtttaatgttcgggaacgtcaagaaatcgtcaaagaaacgatagaataaaatatttgcatataacacaaatgtcatcaagaaatcgataatcagcataataatggctgatttacgccctttcgccagcaaagccagtcctaaaaagaagacggcgcttgagaatgggttaaatatcaggaggatctcctgagttgtgccttttaccccaagattaaactcagtcttgtaggataaatacgtttttgcccaaaacagtataacagccagcacaaaaaagctaagtttgtaagaaaaaagtttcttcatggcaacctctactttcttaaacactttaagttcttcattcatatttacctgctctttatatcctgccttccaattccttctttccaaacaaaatcaaggcatcacacaacaataaatacaccgcggcaagccggaatatttatgtttcgcaccatatcatttttattacaaccatttggaaaccaatcactggacgaaagaaaccttcatttcgtttcacatttttttctcggaaataaaaaaggatttcttttgtcatgtgtgcctttgaaaaaagaaatagataccgagtataagaataacataaactagcaaaaacgaaaaataggttttgcagacagcccgcccttccggcggactgaagttattgtatgcatcaatgtttagcgcgatcaccattttttcgaaaggactaaaaagactggatgtctccagtcttctttatctatatccctgcccagacatccttagcgtacataccggtatcctgcagatgtctcagccagttttgcgcttcttgttccccggttccatggacagcctgatacgctttttgaagtgccgcctccacatccggggccattttgctgccatcaccgcatacataaagcctgccaccgcggtcaaggattgatattaatgtatctgcttggtcagccatgagatgctggacatatgttttcggcatgccctcttttcgggaaaaggctgtgtggacagtgacgattccgtctttttcaaaccgctcaagctcatctcggtaaataaaatcccgatcgttcctgcatccaaaatagagatgagcctcaccgagcgttttgccctcccgctttaaaacatcgcgggcttgaaggaaaccgcgaaatggcgcgactcccgtgcctggcccgaccataataattggcgtttcagggtctttcggaagctgaaaccgggattccggtgtgcggataaacatcacgacatcatcaccggcttgacgctcagctaaatcatttgatgccacacccctgtattcgccacggccgctccacgccgggccgcgcacgacaccgactgtgatcgatgcttgccgcggattcactcttggagagcttgaaatcgaatagtatctcggttttaacggccgtaaaagctctaaaaatcgttcaaacggcatgtcacacgcttcatacttttcaagcagatccagcatggaaattcgttttttcaatatttgctcctgataaacaccctctgctgacagttcttctaattcgcgcctatgcggcggacacactgtaaatgacgccagttcacgtatttgcgctcttgtggctgcttcctgcacctcgacgctgtagctgagaagatcatgcaggctgacaggacggcccaatggcagatgccccgcactgcggccgcttgccgacaatgtcacttggtcggttcccttcagaccgaatctgtgaagaatccggctgacattggtttggctgttttttggcaatacgccaagatggtcgccctcttgatattcaacatccggcggcaatgcaatttcgatatggcgagtgcttcgatcgctgtctgcggactggagttcacgattttcggcaatggatgcgtgagaggcttcgtacgatctagcgagcggagactcgcccagccctctgacaaactgaaggctcagcgtgcttcgttccttatcagcgttttcattaagctcaagtccgaatgctttgatggcatccgcccacatgctttttttccactcgtcaagctgcccttcaaaatcaccgctcacatccccttccccgcgcgcagaaaaccgagtcgcgcctttctccgcaagctgctcatcaatgaatctcggcacgtattgatacgtgctcgcccagttgtggtcgccgcagccaaataccgcgtaatggacgccctcaagctcacccggtttgatttcttgaagccactgcacgaattgtccggcattgcttggcggctttccattataagacgaggtcacaatgacaaccgctccctctttcggcagctttccaatccggtcgttcagaggtgctgtctttgtccttacgccgtgaagactggcagtatcagcaagctcccgggcgacgccttctgcggtgccggtatctgagccgtacagcacgagaagcgggcggttgttaagaccgatgaccgatgcaccctttgcttccgttttctccttttgctcatcaggcgcggctttttcagctgcctggacgtctgcatgaatggcttcctgatgacggctttgaacactgatgtgaaaatcgcccggcttaagtgttaaggtttgtttgatatcaagctcataattctcatgatcaatcaatgtgaaatattttagaatcatgcctaacacaagtgtggcttcatgaagggcaaactgcatgccgatacaggcccgttgtccatttccgaatggtttgtacgcatgatgaggcacttggtcctgatgctcaaaccgttccggccggaattcttctgcgtcctttccccaagcgtctcgatcacgatgaagctgcggaatcagcacagaaattctgtcattcgtcgtgatcggaaattttccgccaatgactgtgtcttcttttggataaaggctgaaagccggagctgtcggccataagcgcagtgattcatttaaaatcatccgtatgtatgtaagctccagcacttgtttataggtcggcgctgcatccgtcagcacccgatcgacctcttcatacgcctttttcagtttgtcaggatgcttcaataaaaagtaagtcgcaaaggaaagcaggccgctcgttgtttcatggccggcaatcaaaaacgtgatgatctgaaagcggatattttcgtcgtcgagcttttcaccagtttccggatcttccacattcagcatgcgggcgagcaaatctttttcatcctggtctccattcgccctgcgctctgcaataatgctgtcgactaacgaaaacatcgtttgaatatcatagcggaattgccgctttgttctgaccataagcttatcttgaacatcaagccgctgcatttgatgcatcgcttcatcaagcgcccgcaccatgctgttgataaacgggtggggcgtttctctgtagtaactgttaaagcggtagttaaacccgcatagcccaatggtgtcgagcgtcagccgggtcatatctcccgggacatcgactgcttcattcgggttgagccttgcccatttttgaatgagctgaacagcgatatcgaccattttctcatgatagtccttcatggcccgctggctgaacgtcggcatcagaatgttgtgcgcttttctccagttaggctcatgcgtccagctcgtaaacaatccgtcaccggaaaatgcgcgaaccttttccaaggcgccttcaatgcttttatcaaaccgttcttcatcacaaacctctttcaccaattcatggccggacactacaatggtcgtgcccgcgggtgtatggatttgaaaaatcgggccctgttcttccgccagtttgatcagcgaaagcgtcggtttgtctttatcaattaaaggcaaattgccgagcggcccaaacgtcttcggctgaggaatcgggcttgtttccttcatcgaaccattcctttccgtatgaaatgccttctatttgactacatttccctttcatggtcatgattattccgttctcccaattgacgcatgatcgctgttttttctatacttgagaagctgtacaatacgcgaataaggtgagtttatatatggattttgaaattcggtttttatccttttatgtcatacaggtggaaggcaaagatgagcaggcgaacaagcagttcaagcacttccagacccttgatacgggagaatttgaagaaagcgagctgaaggactttctcgacggggaactgaaaaaaatcgttaaacggaaagccgaccgccatccgcagtccgagcaggtgccgacgaaaatcggccattttatcgtcgagcccggccacgagctcgattccaacccaaactacaacatgttcaaccgcgcgcgtctggcggaaacaaaagaagacttcaatgagctgagcgagcagttcgtccgcacgtaccttgacacaagcgcggttcgcggcggcgtgtttctcgtcgcttcggccgtgccgagaaaatactttgatgagtcatttgtcttcattatgaaatgtgattttgagccgaaggtcgcccgcatctctgacgcgtcttctctcattaaaaaagtcgaaatggcgatcacgacaaaaaacatgaaaagcatccaatacccgtacatgccagaggaaggaatggtcgaggaaggtgaactgaaaatccaccaggcctcgcacgcccgctattttgaggactttctgaaattcgtcgagtacggagaatcgatgccagaaatcatgaaaaatcaggtcatgaacatggtacaagagcacgtctacgagacatttgaagacaacagcgaagaactcaagcagttcgagcacgacattgagatttgggaagcaagcgaaaaacgggaaatccaagagcgcctcgacacccatcaagtcatcgaagcctccgcccaaatcatcgagcacacgccagaggcccagctgaaaatgaaagtcggagaaacagagattaagggattgctagcggattttggcgattctattcatctcgcaaaagtaaacgggcgctatgtcgcgctgattgaagccgagacgatttcgtttgagaaaggcagttcaccggtggagttttataagcctgaggggctgcatgaggtgattgagcggataaggaataaaacagagcaagactaaaaagtccagaaatcactttctggacttttcctatttaatacccttccctcaacaccgcatagcactccccaatcagttcttccgctcccggctctcctttcagcctgcggcggacgatttcagatgataggttctggactttgagcgctcgtggggctcttcttttatagtacgcctgtaatgctgtttcgtggtcggcgtggttttggagttcttcggcgaggacgatggcatcctcgatcgccattgccgctccttgtgccagggttggcgcaccggcgtgggcggcgtctcctccgatgatgacgcggcctttatgccatggctcctgcacggcgacctgctccagtttgttaaagatgacaggatgctgttttgacatgtgctttgtgacaaaatccagcccccgaaaaccagaaagaatctcttttactctatcaaaccgggtatcttcctcatcccagtaatcgctcgtgcaaggctggaggacgaagacatagccagcgtgttgtgccaatggcaccaccccgatttgtgtgtctccgcttctatacatgaatgttgcgtcctcgaatgtgtaatcaggaagttcgatataaaagcgccacgctcccatgccgagatgctctttttccgtttccttttgcagcatcttatcacgaacaacggagtgaatgccgtcaaagcccgccagaatgtcagcctgcatcttttctccatcttcacataaggcagtgaccgattcagcagtttcttcataggcgacaacctttttcccccacttgatgtctacacccactgcctcggcatgcttcatgagaatgtcatttaacgttttgcgcaggatattattgcgtcccggaagtgaatcgtctaaaaaggattcactgacttgaaacagcaaattcccctgttcatcaaacgttttaaaccattctgtttgaaagccgtgcttacagcaatcttcgaatacgcccagttctttcaacaccgccagtgcgttttgcggctgaagaatccccgcacctgtttttcgattttctgaagccgcttcacataaggtgacggaaaaccctgccttacggagagaaatggccgctgacaagccgccgattccgcctcctgctattaacatatgtttcatatcaataaccaccttttcagctctatatgtattagttaggcgcctaactatattaccttactatgtcccaagaaaagctgtcaatcatctccaagccaagttgcgttatggttttccctcctttataatcgtgtcacaacgaatgtacgggagctaattgcgatggaattaaaacatttaccgaaatataagcatataacagagcacgccgaaacgtatgccaatattgacgccggctctcttgaattgtttttatctctttttgatatttcaaaaaaaatgaatcatgtgatggagcattactttgctggccgagggctttcagaaggaaaattcaaaatcctgatgctgctctttgatgccaaggatcataggttaagtccgacagagcttgccaagcggtcaaatgtcacgaaagcaacaattacaggcctgctagacgggctggcgagagacggttttgtcagccgcaggcatcacacagaggataaacgaaaaatcagcattgaactgacaacagaaggcaaagcacgcctggagcaatttctgcccggccatttcagcaaaatatccgctgtcatggaaaactacagcgacgaggaaaaagacatgttcgtgaagatgcttggtgatctttttgaaaggctgagcgtgtttaaagactaaaaaacccgtccgatccggacaggctatagcgtcttttcttctgcagccggatacgcatccggctgttttttctttatgaccgtaacaaatatgccgccgatgacacatgcaatgccgatgaaatgcacaaactcaaatggctccttcaatatcacgcctgacaaaatgacagctgagaccggaagaacggatgtgaaaatgcccgatacacccgccggcaccttcgtcaccccgctataccataagtaaaacgccaaaacagtgacaaaaagcgcgtaatacagcacatacgaccaatccaaaacagtcggcacgctgtaatcaaatgaagaggcctcaaacaaagcaaacgggagaaaaaacaggaagccgaagagcgatacgaaggtcgaaatcgccagtgccgaaatatgcggggatagcagcttggccatcaatgtaaacaacgcttcgccaatgactgcagcaatgatcagcatgttcccgaataaggcgtgcggcgtcccgtcttggctcccggctccaaacaaattaatcgccattacgccgcaaaccgccagcaaaatgccgatcagcgtctttttctcaattttttctctcagcaggaaaaaggataaaataccgatcaacatgggggttgtgcttgtcaaaatgccgctttccgttcccgtcgtatattgaaccccatacagcaggcaaatactgaacaaaaacacgcctgtgaatgattgcaccagtaatacgaacacatcttttttcgtcaaagccggaaaccctttttcaatgcaaaacagcagcatgagcaatacgacagaagcgatcaaaaaacgcaatcctgaggaaagaaagaccggaatccgttcgaccatcagcttgccgacaacgacagaactgccgacgatcgccatagctgctgccagagatacatatgcgcccatttgttttttcaccaatactccacctgcctttttgatgtatggcaaaaagcgcctatccaatgacagacgctttttcattaatcatcactgctcaaaatgccgaagaagcggagcaggttgatgaacaagttgataaagtctaggtacagcgataacgccataaccggaatcaagtcttccgtaatgtggcggtgcttgatttggttcaaatcatacaaaatgtaaagggaaaagacgatggttccgatcacggaatacgccatcatcgccgctgagtttaacgggctgaaaatgttgaaaatccctaccactgcgagtgcgagcaccgcaaccagcagaaacgaccacaggaaggataaatccttcttcatttttgcgccgattgtgcccaagacggcaaaaatgacaaatgtagagccaaaggcttcgagcacgacataggcgccggcgatggaagcgtaatggctgacgatcggaaataaggtaatgccggaaacgaacgcgaatgtatatacaaacgcatacccgaccgcttttcttctgcgcatccagaaggccagaataatcatcgccacttcaagaatagaaagcggcagcatcaaagcgacaggaacaaattggccgataaaaaggccgacagtcgcgatcagcaatgtgaagacaaagactgtcaaaatgcgttgcatgatcgattgcttactctcgtgaaccgtagcttgcatgtcaaaaatcctcctaaaaaatgatcttaaaggtctattatataaaaattggatgaaatatgtatatgttttaaggagaatttaatgaaaacaaacgccctttacattatcattttgattctttccttttcagcgaaaaacggtgcttttctattttctcaatttgggtaatctgagaatcatgaaccgtaatctgaaccgtgccgaaatcgagtgtttccagcgagctgatgattttttcaatcacttccggatcaatcgttgatttagaaaccaaaagaccttcccccctgttgaataggttttaattcacagtattcttataagaattataatattatgtttttttcgataaatcaatggtgatttctgttcaaatcaaaaaggcatatgatcacccggtgacggacaatcatatgcctggaaacttcctatttgttttcttccaattcctcaacaatacagcggacacccatgttttctaatgcctgcttcagcgtgccgtacgtttcatattcactaaaatcaagccccaattgaatcgatgtttgggccacatccgggcgaattcctgaaaatacggctttgacgcctaataagaaaagtgttttagacaggttgtacaattgctgagccaccatggtatccacaatcggaacacccgaaagatcaacgacgaggcttgtgatttttctctcgacacagcggaccggcactgtttctaaaatgacctgtgccgttttgtatcaatggagccgataagcggcaatatcccgattccatcggcaatggaaatgaccgggcagccaagctctgagatcagttcctgctgagatgtaagcctcatcagcatgaatttttggtactgctcggagaattcaataatcagcttatcgaacgactgattcacaatgcggttccatcggtctgcatcctcatttgtcacaatctcctgattctcttttataaatgtggcgactgcgtcccagaatgagattcttgaattggatatggcttctacgacctcatgcacttgaacatcctgctctaccctgtttttcgcaacgttttgcgcccattttgtcatgttttcttgaaaatcggtttgatcctccagaaatgcgcttgcgattgttatattggtaaatgtatgctgctcggttaaaagtgttttcgtttcttcacttaaatggctggcggaatatagctcgccttttagctggcaacgcaaactgaaccatttctcagtaatatccgcagtgttgtctatgatatattgatataataattgatcgatattcacggtctgtctcctttttcgtaatagaagcactttcattataaaatgataaatcggaattgtgaataagactagagaaaaatcaaatgattctgctctctgagagcattccagcttcatatccttaggcgaatgcaccaataagagtccgcccgcataaactgcaatgtacagtttacaatgagaaaggacgttatcacatgtattatgttgatccttatatgtttgcggggcatttttatgagccttggcctgcttttgaatatgaataccgatatccatggcctggcattggcagcggcgctgttccgggctctggcggcggctccggtcctggcattggcggtggtgctgttccaggctttggcggcggctccggccctggtattggcagcggtgccagcccaggcttcggcggtgcgccgcagggacctcctccttcccaaataccagcgaaacccccaaaaccgcagggttctcaaggagccgttttgttagttgaaccaatcaccattcgtccttgccttttccgatttacctatgtctggttaaccaatggccgctcattttggttttacccgatcatccttggcagaagatccgtcggcggcttttattgggattcctcacggcgccgctgggtttatttcgccttagacacaaatcacatcgatgttgtaagctgctcattttaataatcagccggtttcccggctgatttttttatgttacttcggccgtaaacaggttatagtattattatcttttcaacttggaggtttccctatgatcaaacaaattggcactgttgctgtatatgtcgaggaccagcagaaagcgaagcaattttggacagagaaggtaggctttgatattgcagcggatcacccaatgggacctgaagcaagctggctggaggttgcgccaaaaggagccgagactcgtttagtcatttacccgaaagccatgatgaaaggctcagagcaaatgaaggcttctattgtgtttgaatgcgaagacatctttggtacatacgagaaaatgaagacaaacggtgtagaatttctcggtgagcccaatcaaatggagtggggcaccttcgttcaatttaaggacgaagacggaaatgtgtttttattaaaagaataaactgttgcgcacggcggttcgattccgccctgcgctttctttgacattgagaatgaatttcatttacaattattcatatgtgagaatgattggagtgagacaaatgtttgtacagttgagaaaaatgacggttaaagaaggctttgcagataaagtcatagaacgtttcagcgctgaaggaatcattgaaaaacaagaaggtttaattgatgtgacagtgcttgagaaaaatgtgcgccgcggtgatgaagaagttgttgtcatgattcgctgggaatcagaggatcactggaagcaatgggaaaaaagcgatgcgcatatcgccggccataaagcaaacaaaggcaaaccaaagcctgactatctgatcagcactgaagtgagcatgtaccatgtacgtgctgtcaaacaagggacatacaatcaataaaaagcttgcgccttgctgcaagcttttttctaagagtcatgttgatctgctttgttcgtacgttacagtatacagcggcttatttttatgccattctgcaaataacacgtcctctgtcttatcaatgttcttctttttcaattcttgtttcagccactgttcatccacacctgcttccttcaaattatcccgcacaatctctccatctatgattaacgtgatcggcagagaaacggacttcgaaggaatctgcaaatccttatttgtcggtttgtcaaagtctgattttggaagcacgctgaccatcccgtttgtttcaagaatcgcatattctacttcttggatcgaaaagctcccagcttgcctcaataggctttgcagctggttaatgtctatcttatttttcttcattactttatattgaagctcccctttgcggatgacgatattcggctcgccctccaagaactttcgcgatgatttcattttttgcgtgataaattcaataatataaatcagcacgccccacaatagcgaagcaaaaataatttctttgattttgatttcatgatcgtagacggcatttccgaccaattcacctaaaattaaagcagaaataaagtcaaacggcgtaatttgagaaaattgggttttcccgagaagctttaagatgataaataaaatgcctaaaccgcagaccagttctaccgcaacacttaaataatttcccatattgatagcacctacttcttgattatactatcagtatggtcaatgctttcctttctaaaccggaaagagctaatcggcaagctcagctttgcatgatgcattggagcatgtcattgaaaagctgctctgcatcactgcggtcaatctggacaagcgggtcattgaggaaggcttgaaacgcgaggccagtatcctttgttaaacctgcgtccgccactgcctcctgattggatatatgcctagccgccagcatttccacacctttcggaagcgctccggacaaaatcggctggacacggttccttgtgatgaatgcgtttgtttcgacaatggcttgtataggaaggtttaagacctggccttgattcggcatatttacatttgtgacgagttcacccaatccgagaagagccgctatgatgttcacgccttcttctcccgaagctttctcagcaacgccccgttgttgcacgatcaaccgttctgtttcttgtcgtttctcagctctgtcttgttttctgaatgatataggtgtgagatgaaatttccatacttcaggctgtttgaggtatgggccgggaagaaactctgccagatgcctgtcacccgcagcagggatggcgccatacgtttcaaataaatcaaacgcaacacggtgtgccgaacaaaagacgctgtccctccagcattccccctccagctcatatcctgattccccatagtgcgcgctgaattcacggaatataggcaacaggtcaatatggcggtaagaggcttttgtgatccatgtaaaatggttaatgccgagcacattaacgcggatatcctcacgccgcggcacctcaatccccagcctttccgtgaccatttccgccaatagcttttgcgtcccgaatacctcgtggcagcagccaatcgctttgatgccgggaaacactttatacagcactcttgtacagacagacatcgggtttgtataattaatgacccatgattcaggtgcgtagtctcttattgcccgggcaatttccgcaaatatcggcacagcacgcaagcccctgatgatccctccaggcccgacagtatcacctacagactgataaataccgcagcgctcaggcaagtgcacatcgacttccatatcatccagtgatcccggcaaaatggaaataatgacgatatccgcggctgataacgcctttttcaaagtagaaacagcctcatatctccatctgccgttcccgctgtgattgccgatcacttcatttttctgagcggcttcaaaatcaagatcatagagcgccaccgtgcctgacatccgttcatcaatcgacaaatcactcatcaggcttctggcccagccttgggaccccccgccgatataggcaatcttaatctgatctaatgtactgatatgaaacactccctttctcagcctttcaccgaaccgatcagcattccttttgcaaagtgtttttgtaaaaatggatagaccgccaaaatcggcagcgtcgcaatgacaatgacagcgagtttaattccctgctccggcggaactgcattttgcatcgtatcaccattggtcgccgttaaatccgataaaattgtgacttggcgaagcaccatttgcagcggccattttgcactgtcattgatatataagagagcgtggaagaaatcattccaaatcccgaccgcataaaacagcgcaaaggtcgcaataactggctttgacagaggcagggcgatccgccagaagacgccgatttcggaacagccgtcaatttttgctgattcctccagctcgcgcggcagctgctgaaagaagtttttgataataataaggttgaacggattaatcgccatcggcagaatcaatgcccaatacgtatccaaaaggccaagtgattttacgacaaggtacgtcggaatcatgccgcctgaaaacagcatggagaaaatcaccagattcaacagcagattccgtcccttcacatgccgtttcgccagcggatacgccatcgtgaaggtaaaaaacagctgtacagccgtcccaaccaccgtgatgaagatggacacgcccatgcttcgaaggaacgtcggtgtcgaaaacacatacttgtaagcatcaagtgtaaaggttttcgggaaaataaagaagctccgctgggcgagttccgcttctgtcgcaaaggaaccggcgataatatataaaaacggcaaaatggtaatcgcgccgacaccgccgagaaacagaatgttgcagacgtcaaacacccgtccggctttggtgttgtgcatcgtgtgaatttcagccatacctctccctcctctaaaacaatccttcctgatcaaactttttcgcaatgtaattggcgccaaaaatcaagataatcccgacaactgatttaaacaaaccgaccgccgtgctgtagctatacgccccttgggtaatccccatcatgtacacatacgtgtcgaagatgtcagccacactgcggttgagtgagttcgtcatcaaatacacctgttcaaagccaagattcaaaaagctgccgattcttaaaatcaacaaaacgataatggtgcttctaatcgccggcagcgtaatatgccacattctcctgaaccgccccgctccgtccatgatggccgcttcatactgctcttgatcaaccgtagcaagcgctgccaaaaatagaatcgttccccagcctgtctccttccaaatgctttgcatcacaatcattggccggaaccagtctgcatccgacaagaaagaaatctgctcacctgtcaggctcataatcaatttgttgatcacacctgtatcgacagtaaagaaaacgaaggtgatgctgaccacaattgtccatgatacaaaatggggtacgtaaataaaggtttggatacatcttttatacacggcctttcttacctcattcaaaagcagagccaaaatgagaggcgcgggaaaggcaaacaaaagatccagactcgccagcatgagggtgttgcgcagcagccggaaaaaatccggattcataaaaaagtctttgaaataatcaaagccgacccattcgcttttccagaagccgagatatggcgaatagtctttaaaagcgatcagcacaccccacatcggcaagtatttgaaaatcaagaaataaagcagaccgggaataagaagaagataaagccatttgtcccgtttgagcgcagccatccagctgatgccttttccagcggtgagaacaggtgcatctctcttcttcggcactgtttccatatctgttctcctttcgtgataccggggcgcccgccgaaaggcaggcgcatcggtttattttgacgattggtacaatttgttcaagtccttcatcagttcattgccgccgctttttttccaaagctccaccgcatcatcgaaccctttttcatcaatttctccaatgataaattgtgttctcgcgtcgaggatgatgttgtcaagctgggctcctttttgggtatagacatcagatacaagcgactcagcagggttaaagacggctattttttctccttcggttatgatgtccttgcgatgctggaagagcttggttttctggtcttcgatgtaatactcgcttttcggaatcgacatgctgaactgtgccaagccttcatgctcatacaggagagatttattgtttttttcaagtgaggtgaatacgccgtccttgagctcgtaattgcggcccttcactccgttgttcgtgagaatctgcgcttccttatcattcatcttatcgaggaaggacagcacctctttcagctctttttcggttttgacgcttgattttggtatcgtgatcatgcctgaataaccagatgtcgggaaggtgcgcttgccattcggtccctcaagcgagccgacgatatcaatgatatccttgttcgactcatccgcctcctccatcgcgctttggatttgagacgctcttgagcctgtatcaacgatgacacccgcttttccttttacaaccggatcattccacttcgcagaatccatgacagcaaagtccttattgatcaagccctcatcatagagctttttaaaaaacgtgagcgcatccatgtattccttcgttgtaaaatctggaatcagctttccgttttcaacaccgtagcggttcggagcgccgaaccagatttgcagaacatcccatgggcttccgttgccgagtcccatccatttcggcacgaccatgccgtacgtatcatccttgccgtttccgtcaggatctttttccttaaaggctttcagcacttcatagaaatcatcaagcgtttccggcatatccagaccgacatttttcagccagtcggttctgatgatcatacacgccctgatcagatccctcgttctgtagattccgtacacctcgccgttcaccgagctgttcttcaaaatcttttcatctgcctggcttaaattcttgtagtcttttaaataaggagacagctcccaaaacgcccctgctttgacagatttgataaagccggctgacttatctttaatgacaatcgcgtgaggcatctctcctgaagccatgacgatgttgaatttgtcgttgtaggatgaatcaggcacccatgtgaccttaatctctttgcctgtgtatttttcgagcgcttttaatgaagggctcttatcacttgggctttccggcgataagagcggcgccataattttgatcgtatctttcgaaccgcttgctgaattggatgtttccgaatggctgcatccggcgatcatcatggcagcaagcggcaaggccatccatttttttcgcattcttattttcatgttgcgtaagtcccccttttttcaatttgcatttcccctttgcccctctcaatataaagcgcttacataaattcttgcaatcttcattttttgcaccatttctcctatgaaattccggctgttatccttttttgcccgatgtttctttttttgccggaagggaatctccgatcagttccagcgccgctatgacatttaaacaccattgagagacagtgttcgttgtcacccatggaagctcctctagctgcgtccatgtctcgatgcgctccggtttgatcggaagcggcgtatggctgagcttatcttctagcaaaagattccacgctttggcggcgagatgaggatcttgcttttttcttgcggcgtaggctgtcataccggcggcgaacatcggccagtgaaaatgcccgtcatgaagagcgcctccgctttttttcgtttttcctcatcactgagtgtgtaaaattcgccgaattcactcagcatatcctcccattcccagtcatcaagaagctcagccagctccatccacacttgcggcgcgccgaaggcaatgatcatatgatatccgcccgcaatgccgtctcccatatgatgaagcatcgaggtcgccggatcatattcaaatgtcgggccagataataagcggagcggcagccgcttcagacagttgattcccgtttcgatttttttgagatattccgaattttcggtccgctcccattccgccagccagttcgagcaaaacgccgcccagtccggtcccgttctggcgtgagtcgggtgcttgcctttctcgtaaaaagcgcgcatcggatcggttttgacaagggcataatcggcatccttcacttctgtcaaaagatctcccgtccggtcatcacccgtcagataataatagaatttatgaagcccggccatgctgattctcgcttccttgcagccgcatccccagtgcacaacattatgccgtgagccaagcccggcatattcaccgaggtgaaagctgtccgtttcactcgtatggcgggtcatggcttctgccattcggaagatatcctctctgcctgagcggaaaaacgcctgccacagccatagggtcggaacgagctcattgttttgccatgcgtatccgccgagatcgtaccgccacatatgccggatcgggtcatacgtatgcatgacatcgccataatgccaaaaaccgtaccatctgcgttgctctacttcctttttataaaacagaaaggccgcatcaagctgttcttccagctcttttttgagcggatgggatgtgtcaatgatgctccataccccgagtgcttttgattcgtaatagacgtccggctcgcatacaatgagcgggggcgcctgccatttgtcagccagcgcattgaggacttcgtcagacggcatgtgcgaaaagcacgccaggcttatttcatttgtgttcgcaatgcctgtcggatcagagcgcatttcatcaaagccttcatacgcgctggccacgtgagtgtttcctgtataatgccgcaaatccatcgcttcgccgtccggaggccaaagccagatagtcattttggggcggctgccggcaagacctgtgatttccagtgctgaaggatatttctcaaagaaataccgcaggccgagagccacaccgccattttttccgcccgcatagcagagccccttcgcccggctgccatgcagcattccaacccacgcataatcttttccggtccgttttgacaggctgtaatgatcgctggaatcttgcacgatcttgacatcgtcccaaaccgcattctgtgtgccatgtgcaaaccattccttatgctcttcatctggagacagcatttcgccattgatttgtttttcataaagcggatatcgttcattgaatttacgtgtgccaaacagctgggcgggttctttatacatccctttctctcccgcaaagcggaaatggcggttgtacggctctccctccaaaaaaaggtcgaattcgatgccgagccccttaacgaattctagtttaccgctcctgtcaatcagctgcgtgtgcacaaggccgatctcagacagcccggcataaaacgttaatcggatgacaaacggcagccattcctcatacgttttatgaagcacatgcactccctcgattttgactactgctttgacaggaccactctgctcaatcgccgcccgtttgataaagctgacagacctttcatgcaaaagaaccattttcgccgctgactcttttctcgtttctcttatcgcaacgagcctcccgcctgcggcgatcggctttccattgatctgcaatgattgaatgaaatcagatcctgttttatgaatggtacaaacgagtgctcctgtatccacttggatatcatgctctgtctcaagaatgctgagcgattcagttggctgcggcacttctcttttgtgcactgtaaagctttggttttcctgaccgccaaacaccgccgcgtgcttcgtccacttgatgctcccgtccggccaataggccgacggttcgctttgcacatatcgcgtttccgcgttttcattcataagcgccagacggtctcctttttttaattctccttttttccatggcatgccccacgtcacgccgcttgtcacctttggctgtcctgataaccatttgatctttttcatctgtctctccctccatagaaaaaagctgattcgatacaaagaatcagctgtgattgtcaaattgaatcacacggtattcatgcggtccgaccgccagtctccccgccttttccaagcggtgcgtcaacaaatccgttcccgattccggcaatgtcacgctcccgccttttccatccatattcacaacgatccacacaaggccgttttcgcctatacgcggggcaacgatcgtgccgggtgtcacatccgaccggctggaaataacagcttcctccgcataatgcctgacgagcgcttccagcatcgcatccccttctttcccggatggaagcgagcccagcatgacaattttcccctcgccgtaattccgttccgtcagaaaagcatggcccgcccccggtcctgcttcaaccgtgccaagggtgtttccgctctctgtgtcaaacaccgcgctccacagtccgagcggcgccgtgatgccaaacgcttttcctgtattcacgttctcattcatcggaaaggtaaaaagtgttttgatccctgacgttttctcaagttcgccaagtccgcaatcggtatgaatggtatgctcgcatgtgcgtcctcctgtcagcggcccggtgatccagatgccgcccgcttcagcgaatgccgaagcttttttgataaattcagaagacaaatacggcacaaatggcgtaaacagcaagcgatagccgtccagtggagcgccttccggaataaggtcacggtgaatccccgtgttgagaatacgttcataaaaatgcgtcacaagcgaacgatgccggagtccccggtgaggctcagttttaataaatgcttttgctctgtcagagtaagtcatcgccgcctcggcttgaacgggttcagtcgatagaataataggctcgatttcctttcttgcccgctcaaccgccagcacattttgatagccgatggtgggttcgccccaggcactgagaaccgaaccgtgggaaatctcgctgcctgaacgctgctgtcgccatagccagtagcaaaacccctggctccctaaggcgtaggacgatacggcttcggcctgcaaatacccgtctgcgtgcgggtaagcggagctttcaagcgaggcggcatacgacggactcgtttccaaaatccaaaacgggcgcccttgtttcagatttctccataaatcacagttcaataaaaaggcagaggcgttttcctgcgaagcgtacgtgtcataggaggcaaaatcgagattctgaaacattcgctcattgtccacgctgaacatgactgatccgttatgcgtgatcggcgcatctgaatagcagcggatgattttggcctgttcatccgcaaacgaagcgatcatctccatcgaaaacagctgatacatagtgcgtagagaggcatgatgcagaaacggggccggtcccggctgcgggacttgctcaaacgtctgataggtctcgctccacacatcggttccccaagcttcattcaagcgctcaattaccccgtagcgatttttgagccagtcatgccataggcgcaagcatgtctcacacatgcattctgcaacatggcatttaaactcattgtctagctgccatccgatcagccccgggagccggccaagctccttggcgatggctgtggtgatgatggcggctttttttcggaaatacgggttgttcgtacaggcatgctgacgggagccatgccccatgatctctcttttttcattggcatgcatgcgttcgggccggccatgtgagaaccaaatcggcggggtaggcgtcggcgtgcacataatcgtttcgatcccgctatcatacagccgggcgatgatttctttgaaaaaaccgacgtcaatttttccttcttcaggttccatgactgaccaggcaaattcgccgatccgcacaacatttacgccaacttcacgcatgatgtcaatgtcctgctgaatcgtctcttcatcccataattccggataatagcaagcgccatgatacagttttctcatcacattttcacctttctttgatgatcgattctgtcaatggcaggccgagctcctttatgccttttgccacaagtttcgccatttcatttgcgcctttttttgtaaaatgcgtgtaatcgttaatcccttctgaaatcataaaataggtgtacactttttcctcgcccttctcagtaaagaaagcgagacttttctccatcagatcaatgagctggacattctcctcagcggccgtctgcttcatggcaatgcagtaatcaggaaaatcgttcaaaaacacgccgttttcgtaatgaaagcgggctacgggggtaatgagaagcggatgggcgcctttttcccgcgcgcctgcgatatactgctttaaatattgtttataagtagtatagggctcggtgtagcgctccggcttattttttgacgcgtcattatggcccatctgcacgaacagccaatcatccggctcaatcacatcgaggattgcctgaagcctgccctcttccacaaatgttttcgagcttcttcccccgatcgctctgttgatcacttgaatatgctccggcagatgcgagccgagaaactgcccccagcccccttgatttgtgctgtctccatacgtttgaacagtcgaatcgccggcaagataaatatgatttgccattttttcattcctcctcgttttttatacagcttccatcacggatagctcttcccttgaaaaaaccggtgcgtacagcgcttgagcattggttcgtcctgccagttctctaatcatcttggcgtagcgttcagcctttgcgtcttatcccttagtcctcctacagcggcgcctccgctttgcttcccactatgtacagggcgggcttcggcggttttttcattcccgttccgaggtaaaagctcgtgtgcggcggctggttgtaggcggtattctgccaggcgatgccgagcctgtaaaccggatcatgcatcagcgtgtaaaagcagtggcgggtgagatgtgttgttgtatagatacggagcgcgctgctgtcttccgttctccatatcacttcttcccgccagtctccgaacaggttggcctgaagaaccgggtttcctttcgtgccgttgttggacaacacgccggccggctgaaatatcgtcttcagacagccgttttcagcatcccatttttcaatctttggcctgccgatcgttccgtcccagtcatgatcaagcagttctctgaccaaatcaccgtcccaccagatggcgaaattggctgaagagggcgctttgtcgctgattttttcgcctttgctcgtgaaaagcccgtacgacatgccatcattgcccggcggatcaattccccagacgagcgatcctttgtagcttggatcaatatgagccgccatgccccggccaacgtcagttccagcatggacgccccataatatctcaccggttccggcatctcgcagcgacagtccgtacggcttcgtggcgtcctcatgcacctggaacacttcaagcccttttcgtgacgggtccagatcccctacatgcatcgcgtctccgtgcccgaggcccgttgagtacaggccggttccgtcatgatcgacagccattgcgccgtatatgatttcatcctttccgtctccgtcgacgtccgccacgctcaagctgtggttcccctgtcctgcgtatgcttcatgtcccggctggttggagtcaaatacccatcgttttttgagccttccgtttctgaaatcgtatgccacgagcacggttctcgtatagtagccgcgcgccataacaaggctcggccgctccccatccaaataagcggtcccggcgagaaaacggtccatccggtttccatagccgtctccccaatcctccagcttgccgcggggcggttcatattccacggtcgtgagcgcctcaccggtttctcctttaaacacggtcaaatattccggaccggacaaaattctgccctgttcgtttctaaaatcggcctgctcatcaccgatgatatgtcctttcccgtctgttgtgccgtcagctgttttcatggcgatttctgcttttccgtcaccgtcaaggtcatacaccataaattgcgtgtaatgagcacccgctctgatgtttctgccgaggttgatgcgccacaaaaaggtgccgtccagtttataggcatctatgagcacctccccggtataaccgtcatgagcgttgtcttttgaattggacgggtcccacttcaggatcatttcatattctccatccccgtctatatccccgacactggcatcattggcgctgtaagtgtacggctttccgtccggcgtcacaccgccttccggtttggcaagaggaacctccaggacattttcctgccaaacacgagctttcttggaaagcttttcttcccgtcctttattgacagccgccacttgataaacagagtcagccgttccgttttgatcgagaaaattagtgctttcagcgattggatcgcgggtgatccgctttccatcccgataaaggtgaaaagccgtcgtctcatgatccgtgccgagaaaacgccagctgacaaacacgccctgttctgtctgtaccgcaatcaaacctctggtcaggtattccatttgcctcttttttggtttcatttgatgggaacgggctgcgcgcagcccgttccttccccctttcagttaaggcgtatacatatttggttttggctgttccgccatgccgtctcctaaaaagaagcttgtgtgcggcggctggttataggcgatattttgccaggcgatgccaagccggtacaccggatcgtgcatcagcgtatacagcctgtgctcagtcggaatggtcgtcgtgtaaatgcgcagagcactgctgtcctccgttctccacaccacttcctcgcgccagtcaccgagcagatcagcctgaagcgttggtgttgcttttgtgccgttgttagccgctgcgcctgatgcagtcagcatatttttcgatacgccgttttgataatcccacttatcaattcggttgctgtccagctgttcccggagcagatcgccgtcccaccagatgccgaagttggtcgaggacggaaccccgcttccgattttgacccctttcgctgagtagagagaaccgtttgcccacacctcctgtcccggataacgcgggtcaatatcagcagccattccccggcctacatccttgccggcataaacgccccaaaggatttttccagttgcagcatcccggaaagataagccgtattttgcatttttgtcctcatgaacttgaaacacctcaagccccggccggcccggatcaagatctcctgtatggagggcatccccatggcctaagccggtcgagtacatgcctttcccgtcatgatcaacagccattgagccgaaaataatctcatcttttccatccccgtcaacgtccgcgatgctcaggttgtgattcccctgtccggcaaacgcttcatttcctgactttgaggagtccagcgtccaaagctttgacagctttccgtccctgaagttataggcaactagcatggttttagcgtaataccctctggtcatgatcaggctcggccgctgtccatcaaggtaggcaatgccggcgagaaaacggtcaacacggttgccgtagctgtctccccaatccgacacattgccgcgcgccggttcaaaatttgcggtgacaagctctttcccggttgaaccttgaaacacagtgagatattcagggcctgaaagcacacgcccctgttcatttctgtaatctgcattggcatttccaattactttgcccgtgccgtcttttgtcccgtctgccgttttcattgccacttctgcttttccgtcaccatcaaggtcatacaccataaactgggtgtagtgcgcgcccgctctgatgtttttgccgagattgatccgccataactttgtgccgtccagtttatacgcgtcaatcagcacgtcacccgtatagccatcctgtgaattgtcttttgagttggacgggtcccatttcaggatcagctcgtattgcccgtcaccatccacatcgccaacacttgcgtcattagcgctgtacgtgtaagattcaccctttggcgtcgtgccgccagccggtttatccagcgggacggaatgatacggctgcgcccatacggaggctttttcagaagccggctgttcggtaccgtttacaacagcccgaaccgtatacgttgagcccgccgaaccgtttttatccacatagttcgttgttttgacaggcgcagcattcagtttttgcccgtctctgtacacattgaacaaaacagatgcgttttcggttccaagaaaccgccagctgacaaaaatgcccccgtccgtcttgaccgctacaagcccccggttcagcgcttccatctgccgcgctgccccttcagctttcacaggacatacagaggttcccatcaccaacaagaccagcaacgtaacagcggtaaacatgcgtttccttcgtctaatcatcagacagctccttctcatttatctgtaagcgcttacttaaattggattttatgcgctttgtgagctgtcttcaatttcacttttttgcatctgcctatttcggacactgcacttttttgcttatttgtcatttttttgttacccggcttgatggtgctgggcctccgtcttttgaaatcccctaagagcaaaaaacatcaacacaagcccaaataaacacgggccgtaaaatgggatcaggccaggaagcgtatacagcaaataaaggacaaatccgcacccgatcagcatacagccagttgtcagcggtctcatggcgccaaacagcagtgcctgcggaatatatttgcgaagcgggagctggtaatgcacataaaggggaaacacatacatcagcgcgatgatatacaaaagccctgcaagcagcgtgcagcttgttacggcaaaggacagccaattcgtactggcagaaaaataatgatagttggcagacaatatgagcaaaagagccgaaaacgccaatccgatcgcattaaccttgagaaactcttttttataggtatcgagaaataacgaaaatatcgggacatccttttgccccatcagccatttccttataacggcacacatcgcagctgtgctcggcgcccatccgaaaagaacgccgcccaaaagtgtaaacaacagccacagcccgttgagccatgctattttcaccaccgcttcgcagcctgcataaagcgcatccgttacagtcgtcttcatcttctcaccgcttgatgcacggcaaaatccctgtaaacggctttcatgggggccatctgccggaacccgatttttcctttgttaacacaggcccatatgtgctgccgtcgtccatccactcaagaatgggcagaccattgattgaaaagtgcacatagcctttgtctttgatcagcttcatacgatacggagaatcagcgtcgtctggagaaggcagcggatcggcccccattgcggcgagatggaaaccgcggctttttcttaaattgcaggtgcggaacgctctttcctccgcgtattttctgcggaaatacgacaggtggagggcattgatatctcctgaatgatactcagggtatgttcctgttcttttcctgagacttgggtcaaacaaatcctcgccgcgaatacccgcagcggcaaaaaacagcatacacagtccaggctgctcgatcggagagaagtcccatgtcacaatgatgccgtctggaaaggtttccggacaccaaaagacaaagtgcgcttcatcctggacatgtgacaggtgcaagctgtgatcgtcaaatgagatctgtccgcctccctccatccgccaatccttcacatcgcttttagaccggagcggattgcggtacaagcaagcgccttccttatacatgttcttttccctcccggctcacaaggtggtccttaagcggaagtccgagctcttcaatgccttctgccacaagcttcgcaacctccattgcacctttttccgaaaaatgcgtattgtcctcaatgccgtccgggtaattcggatgttcattcggctgaaaccaaacgaacaatcgcttcgactcctccggcccgtatgcttcatacagcacctttgttttcgcaagcagatcaatcacaggtacatcgagctccttcgccagtgctttcatcgcatcgggatactcaccgagcgtatgctcgatccgtccgttttcatcaaagcggcggcgctgcaccgatgtgacgaacacaggatgcgcgcccttttcgcgtgccgtatctgcaaacaaggtaagaaactgctgaaatgtggagtacggcttcgtcccccgcggtttttggtcattgtggccgaattgaatcaacaaataatcgccttgtgtgatgtgctcggcaattgcttgaagccttccttcctccacaaaagaattggtgctcgctcctcctttggcatgattgcggaccagcacaccttcagaaaacaattgcccgaatacctgcccccaccccgccatcggcgcttcatgaggcgggcagtcactcacagtggaatcccccgctaaaaatacttgaatcggtttcttcatcacatgttctctcctttcacggcgtttcctgatacatttgcctgaagacacccggcggcatgccgacctgttttttaaaaatccgattgaaataattgtggcgatagccgacttcttcagacacatcatgaatttttttattcgtattgaccagcagttctttcgccttttcgattctgatctgggtcacataatcgataaaattaatgccggtcacttgcttaaatgccttgcttaacgtataggaattcatgccaagcgcatcggcacagctttccaatgaaatgtccgccatatactgttcgtgaatcatcgcaatcacacgttctgccagctgcttttgctgtctgttttttctgccctcaagcttggaaaggtaaggcgtcaccactacatccatcagccaggccgccgcttcgttaggttcgcgcaattctgaaatatcaagaaacggattccggtgctgaaacagttcgctgggattgagcccggaatgcaaaatatcctcctgaatgcgggaaaacagctgaatcagggcggaatgcacatgcctgtctatggccgctttttccgacagttccttcatacatccatctatcagttccttggcttcctgttttctttccagccggatggtctgaacaatttgtttttccagctcaaaagggtaataaggagcgaactgctcatcccgagggaagtcggcctgcaaatcaatgacctgatcccggttagcaaacttcctgcgggatttgccgcatttcacatcctgaaataaagaaggaatttccgtgacacgctccgtcttgctgctcaatgtcgaggtcaggcatagtccggttacatctccaaattggcgtgccagctccgttatatacgccttcagatcagagctgtttgttttcatcacaagaacggtgacagaaagccggccgatatcaagtatggagagctgaaaaacgcgtttagccgccaattcctcagcgatattagtcagtgtaaacacggcaagctgttcatcaccttcacggaagatgcttttttcacagcggagccctgtcacctgtagatcaagcacatgaaacacgtttccgccgatgttccagccagcctcctccatccgaaatctgaggctttcctcgttgtcatagtaaaaatcgctctgtaagagatgctgcaaaaaactctttttcatatggggcgtctgccgcaggagctgctgttggagcttccggctttcaagggatagatcctgccatctcttttcaatccatttgaattcatcctgcccggacgcctgccatgttttcttctctcctccggtaaacaagccaagcaaatgctggatgggacgatagattttttttgatgcataccatgtcatgcacaccgccaaaccgatgcaaatgaccagcatcacgatgatcacttttgataaaaacaccatcggcgctgtaatagctgaaagaggcgccgctgacacaaaggtccattgctgatgcatccggttcatttctccaaaggagacagaatacaccttgccttcccattccatctgaaaatggccgttctcagcaggctgtttttttatctcatgaagtaaagtcttttcaaaatctttttccccctcatgaaacagcacctctcgattttgatctaaaagcaacgcactgccatcaggatagggggacaagctttgcaggattgattccatttctttcggatcaaccgccagcatgatcgcgccgaacggtttctccgccgcgcccggaatgagctggatcagcatcgcttggtttcccgaccgtttccaataaatgctgtggtctgaggcaagcagcgagcgatacttgcgaagcgcctcctgttctgtcaaagcgctgtattcagggctcagcacaagtggccgggggctgttcagaaagatggaagcctgctcgatcagcggctgctgatcccgcaaaagaaacagctttttcgttaattgataggagaacgtaaagtctttctccaaatccctctcggccaatccgttcatcagtgaagaatcgtaggccatctgggtgagtgccagttcaagcactcccagcttctcatccattcggctgacctcacgcgccacctgtgtttcatgcgatctctgcagctctttctccaccttgtcgatcgaaagaaagtagattgcgccgccagtcagcaatccgggaatacaggcaatcagcaaaatgaagacaaagtttcttttgaaatacgttcccttccagcgagaaacccgttccttctgttgaggctgttttttcatccctctccccccgccgctatctttactgatacaagcgttttttcgttttcaaaacatcagcaagaaacgtcagcgcaagtccctgcccccatccttgtattcgtttgtaaggcacctgtttgtatccttcggcatttttcatgacggctgtcccggccgataccctgctgacccgtccgtcctcttccactgcatccaaaatggcggcaagcgatttctgcacatattttgtatacagctttccgctcgacatcagagcagaagcaatacccgctgatgccgaaacctccagataagaatccggatcatccaaaattgtatgccacagccctgattcatcctgaagccggacaagcgcgctcagctggtctctgagcgatccgtcgatgatcataaaggaaggatgtgtcacctcaataagcgggagcgcctttgccatcgtgagtgccgcccagccgttcgccctgccccaataaatccccgacagatgattttgcgctttgttgtcccaggcgtggtagtacaaattcgtgacagggtcctgaagcacatcctcatgtccgtgaaactggcgcaggccgtcttcaaaataatcctcacgctccatgacccgcccgattctcagcataaacagcccagccatcatcagcgtatccgcccatgcctgttcagggaatacgtattctgccgcattcaccgtatgctgaaggataccctcgccaaagcgcggcgccttatgcagcacatattccgccatctcggccgctgtttccaaatacacgtcatcacctgtcaccttgtggaggaacaaaagcgtatgcccaatggaaactccgttgatcgaaagcggcggcagcccatcctccagctgttcatccacccacgtttttaacagattgatatattcctcgttttccgtcgcttcataggcctccgccacaccgtaaaacgcaacgccgcccggccaatcccacgcaaaatccatctgaaatgtccgtttcacgatccggtcaataaccgacgtcaccttttcttcatcaaagataagctgtgccatctgcaacactcctttttattttaatccggtcgtactgatgccctgaacgatatatttctgaaacaaaaagaaaacaagaatcacaggcaataacgagacggctgacatggcaaacatcgcgccccagttcgaagccgactctgtatcgagaaaaagcttcagcgcaagtgaaacagggtaaagctccggcttattcaaatacaagagcggctgaatcagctcctcccacttccaatagaaggagaaaatcgcagacgtcgcaagcgcgggggcaatcagcgggagaatgatccgccaaaagcaggcaaagcgtccgcatccgtcgattcgcgcggcttcatccagctcctcgggaatcgtccggataaactggatcatcagaaagataaaaaacgcatgcccgaaaaattgcggaacgacaattggtttaaaggaattcagccagtctaatttcgcaaacataatatactgcggaatcatcaacacttcatgaggcagcattaacgtccccatcatgcacgcaaaccaaaatttttttcccttaaacggtatacgcgcaaatccgtacgcaatgacagccgatgacatgacggcaccgattgttgacagcccgacaataatcgccgagtttttaataaacgtcagaaacggctgtcccgcaatgcccttccacccttcagcatagttactgagaataaaagggtctggaatgagagaatgtgaggttgtaaaaatactggcgctttctttaaacgagctgacaaacagccaaataaccgggtacagcagcaacaccgccagcgttgccgtaaaaacatggaacagtatgcgtttgggactgacgcgcccggctttttttctctcaaaaaccggggcttctctgacaggctggttgaccggctccatccgtcattcctcctttgactcgtaatgaacccaatatgacgatgttttaaacaatatgagcgtaatcagcccgacaatgacaagcatgacccacgccatcgccgatgcgtagcccatttgaaaatagttaaacgcacgctggaacaaatagagcgaatagagaagtgtcccgtcaagcggcccgccctcgcccttcgaaatgatataggcaggtgtaaatgtcataaaagcagaaatcgtctgcatcactaggttaaagaaaataatcggtgtaaggatcggaagcgtgatcttgaagaaacgctgcacccgatttgccccatccacacttgccgcttccaaatacgaagacggaatgtttttcagcccggccaaaaaaatcagcattgacgacccgaactgccagacggacagcagaatcaatgtccacagcgcacttgtcggattctggtaccaaagaattttttgatcaatcccgacaaaaaacagcagcgcattgatgaccccgtcattgccaaaaatattgcgccacataatcgccacggcgacgctcccgccgatgatcgaaggcagataaaagagcgttctgtaaatggccgttccttttgctgcattgtttaaaatgacagcgataaaaagcgcgaagccgaggcggagcggaaccccggcaagcacatacgtaaacgtcaccttcagagactgccaatacttttcgtcacccgtaaacatttccttaaagttgtcgagcccgatccatttcggcgccgtaaacaagtcatagctcgtgaaggacagaaacagggacgcccccatcggaatcaccgtaaagcataggaacccgatgataaacggagaaataaaagcatatcccgccagattgtcttttcttatactccggctttttttcattgcgtcagccccatttcccgtcaattattcctctctaatatctcattggcctttttccggaacgttttggcggctttttccggcgataccttctgatacagaatctgatctgacgtatctttcagcagcttgatgacctccgcgcttcccacaggctctggcggatcggctttgctgatgttttttgacgcggtttctacatactccacgatgttggtttcttcctcattcagcttcggtttaatcgcatccgccaccttgtcggagactggaacgcctcgctcgcctttaatcagctggttcgcttcctcattattcacgaagaaattaataaatttcgctgcctcttttttatgctcagagcttttcggaatggaaaacagcatactgggcttcagtgtcagcgccttttcctgcatttgctccggcggcagatagagagacagcggcgagtctgtcagccgggcaaagcccaaatattgattggagtagttccatgtaatcgctgatttgcctttgacgataaaatcgtcttccatccctttaatctgtgcgctttcatcaggtgttggggacgttttcgctttcactagcctcagctgccgttcaaagtaatcgacaaacagctgatcatcttgatacgcgaggccagtgccgtcttctttataaaagcgctcaccctttgtgcgcaaataataagggaagaaaatatcaggcggatgcattccgttggaaccgtagacaccggctttttcctgaagatcatacgccagcttctcgtaatcctcccacgtccagttttcctgattgatagacacaccggcttttttcagcaaatcttcattggcaatcacagacagcacgttgacacctagcgtaaatccataaagcttattgtcgatttttccgcccgacagcatattctcgtcgattgaactgacgtcaatcgttccatcctttgtatacggcgttaaatcttccagctggttcttctttccgtattgggctaagtaagcggtatccatttgaatgacatcaggaagctggccggcggcagacatgggcgcaagctttttccagtagtcatcccagttcgcaaattccgcttcaatatggacgtgcggattctttttctcgtatagttcaattaccttagttgtataatcatgccttggctgcccgccccaccacgcgattctgagtgtaacatcttctttttttcccgaggcctcttcacccgctgaacatccgctgaacaaaaagacgcagacaagggataacagcacgtaacaaatcttcttcaaaccaatcccccctttaatgtaagtgcttacattttattttaaagcgttcggatagggcgaaacactcaaaaaacagtggcgaaagtcaaaaaaacagagatggctatcctgcggaagcgcctccctgttttcttctgaattctgacggtgtcagaccggtatattttttaaaaacaagactgaaatacttcggattatcgccaaacccgatttcttcagcaatttctgaaacgctcacgtccctccttattttcatctgcttcatcgcatgctcaagacgcacccgtgtaacatattgggaaaatttctcgcctgtttcctgcttaaataacttcccgagataatcaggattcataaacagcatatccttcgccgcccattttaaggacagattcggatttccgagctcgtcggcaataagcctgatcatttttgaaatcactgcgctcccatgcaggtcaccagacgcttcagctgtgtcacgaaacagctgccccgcgtgccggagttctcccgcctgactgatggccatcttgcggtccgcaaaaacctccgccaccttttcagcggcgttctcctctacggcgagcacggtccattcaccgctgctgcaaaccgctgtcagtgccgatccgagtgcctctctggctgcagcatcaatagattgttccccttttaagatcaagaggcggatcttttttccggcaagtgaaggcggcggagaaagctgggccacaccggcgatcaagccttccaagtattgatcggctgcaaaggaacggatatggtccagctcgtgtttcagatgggctgttttctttttgtgcacatcttgccgcttcagctcagcaatgatttcctccagcgagctgataatctgctgttcattgcagggtttcagcaaataatgcttcaccccatatttcatggcttcctttgcgtactcaaactctccaaacccggacaggacgataaattgcaccgacgggctgacggctgacacctttttgatcagctcaagcccgtccatgccgggcattttgacgtctgtgatgacgatatgcggctgcttatgtacaatcttttcatatgcttcatgtccgttctgcgcttttccgatcaatgaggcgccaagcgactcccactcaatgattcccgccattccatcaaggataatcctctcatcatcagccagcagtattttatacatcacaccacctcatttcggcacggtattgtgatcacaatcctcgtccccttttcatgctcactatgaatccgcaatccgtatggctctccgaatgtcaggctgatgcgctcgcgaatattccaaagtccgattcctcttccacccgttgattcaagaatccgtccatccatgccagggccgttatcttcgaccgtaatacagacacagcccttcgcctttttcgcctgaatccggatggcgcatggccttgtaaagggttcaagcgcgtattgaatcgcattttccgcaagcggctggagcgtcagtttcggaatgaggcaatgcttcacctcatcgtcaatatccaacgtgaatttcaggcgctcttcaaatcgaaatcgctgaatggtcatatagtgacgtacaatgtccgcctcctcctgaatggtcacgatatccttcttcatatgtatgctgtttcgcagaagaaaaccgagcgattccaccatttttgagatttgcttttgctgattcgccttggccagccaattgatggactcgagcgtgttatataaaaaatgcggattgatctgggcttgcagtgctttcaattcggtttctttaatgatgagctgtttttccacattttcttccatcagctcattaatccgtttcatcatgacagtaaaatggcggttcagcatgccggcctcatcctgtgtatgttccggcagagaaagcgacacacctgcttcaatgccgctgtgctgtaccgatttcatcgcggtcacaagctgttcaatcggctccgtgatgctgttggcgattttccttccgaaaagcaaaaccacacagaaaaagagaagaaagcatgtgccgatcactgttttcataaaggaaatttttgcgaacatctgatcaaaggggataacgttatagtagctccaattttggtaggatgattgaagataagaaataaagtaacgtttgccattcttttttatcaagtcataaccggggtgcttcaacgtctcttttgctgcctcaggaacatgcgctgatgcatgtgccgtatacaccaaattaccgccttggtcagcaatcataatgtctccgactgaatcgccccaatccttcggcacatcacgaatcatctgttttacattgacctggatcagtaccatgcccaagccgttcagactcagctggtgataggacctgatctgccgtgctgaaatcaggacggggtctgacccgccgagcgtcatccaaagatttcttccacttttcgctttcgctcgcttaaatacctcttcctgctcctgctgcaaaagatctgaagaactgcttccggctgaatactctgagccgcgggcatcaatcacatgaatggaatcgatgtacttttcatcgctggcatatcccgcaagctgatcccacagctcctgcttcatttgatattgatcatacgtatcatcccgattttgcatgctcaggatgcgctgaatctgttcgtctgtaatgatttcatatgacacatcctctatcttcttcagctcgtcttcgatcctttcagaagacatccgaagcacctccgaggacttgcggtaaatctgctcatcatacacatgaaaggcatactggaccccgctgtatacaaacagaaaggatacggccataatcaacgatagaaacacaaacagcttatccttaatcttcatccgcctgtaccagccagcaactcttttcttcatgccgccttttctttctcctgccgctgatccattgaccgaaacgctttaaaggacagcttcgttaagatcaggctgagtaaactcccgctgaaaaacaatagaaacgtgacatgaaacagaacgagacaaagcacaccgacagcgcccgctgccatcaaaagcgtcaccgccggacgactgaaggcaatgaaaaagctgatgctcagcacctctctgatttttacgtcaaaatgagaaaatacctggaacacatacagcacaacaaacgcgaaaatcaaactaatgctcacgaatacattgacgagcacaggctggtccatctgagccgctatccgcatatccgcaaacagaaacagggcagccgtcacaacgataagcccgaggatctgtgatgcccgccattcctttttaaacgtccgaaaaaagacagaaaacaccggggcatctgtattccccttcgcccattctctcgccactgtaaacatcgcggcagtagcgggcatcagcccaaatacaaccaggcctgcaagagaaaacaaaatccaaagcacattcaaataggccagtctcatcacccacgtacaaaaatgattcagcccatttgccacactgtgtatcatcaacatcaccttcctgctttggaaaacgctttcattttaaagtaatatgtatttctcctttcgaaagaaaattcctgccggtctgtgaaaatttcgacctgttgagagacggcagcagccttatcttttcctgtaacgccggatggccttatcgatcaaatatccggcaatggctccgaaaatgacattgaatccaagcattccgagcgcagccccttcccagccgcgtacatacacgaggctgtaccagatcgcaaacacaccaaggacgatcagcccggccaacatccattccggccgacttttgtcaggaaatctcatccgcatcaatacggatacgccagcaaacagacaagccgtcacaatccctgtcacaaataatattgaccacacatcgcctgcctcccttttagaaaaagacaaaaaagccccctgcaaaggacgcttattctgccgtaatctctttctcaaacaaatgatatccggacgcatcagcacccatgaattcatatcccatacgccgataaaaggaatgcagggcgtcactatcagcgacacagtcaagccggatccgcgttttttccggaaagtgtatgcccgtctccgcccactgaaggacgcgggctccaagcccctgtcccgcaaaccggcggcttactgcgaggcggtgtaaataaatggactcctcatgcccatcgtctccccaaagcgtccggtcccactcgctcggtgcaggcagcagcatcacgacagccgcaagctcttcatcttttttaaacacaaacacatgtcccttttcaattgaccccgtgatatcatgtatatcttgccctttgagaagtccgctccattggttagaaccccgatcccggagccattcagctgttcggacgagcaacccggtaatcgattctgcatcctcatagacggccggacacgcgtaaaatccatctgcaatcgtttcgttctcaatcttaaaagctgtcataaaggcctcccaatcaaaaagtaagcttgcacacacaccttgattataatgcagaccaaactgcaaaaacagaccattttctctgtatgtaaaagggtgtatgaaagagaggccaatctgcctattagaaaatcttctttttatcccgttcttcttttaaaatttcaaccgcttctctgaagcgcatagagtgtacgatttcacgctcacgcaaaaaacgcagggaatcgtttaaatcaggatcatccgaaatatcaatcagccattgatacgtcgcccgcgccttttcttctgcggcaatatcttcgtataaatcggcaatcggatcgcccttcgcttggatatagctcgcggtaaacggcacgcccgccgcattatgataaaaaagcgcgctgtcgtgattgacgtaatgatcgccaagcccagcttcacgcagctgctccggtgtggcgtctttcgttaacttatagaccatggtcgcaatcatttccaaatgggcaaactcctccgtgccgatatctgttaaaaggccgatgaccttatcaggaatcgtataacgctggttcaaataccggagagccgcggccagctcgccgtccgctccgccatactgctcaatcaaatacttcgccagcgtcgggttgcacgtactgaccttgacagggtattgcagcttcttttcatacacccacattcaggcattcctccttatacttgccacggccatggcccttttccccaatcccaatccttgcccgcggggctgttgccgaactgcagaagcggtccgtaagaggattcgaactgtctttttaagtgccttgaatagccggaatattgattgaattgcttcaacgcatcttcatcatgaggatgtgtatttaaataaagactcagctcaacaagcacaaaatcagcagcctgtatttgctctagctgacgataatattcggcgtcaaccttttttgccatgtgcgtctccccctcgataagggttttcataaaaatcatagagatccttccaaagggtgcctttcctcaaagcctccatcggcgaaaactgctccatgtgctcaggctgaaaggtcatataaaggttagggggcgttctgtaatatttcttccctatgggcggacagggatcaaaacggctgtgaaagggcgtatatgatttgacaggcgtaaacggctgcatatccttcattccggctcctcctttctcaaaaacaatgaccttaataggtatgaggcaggaggcatgattatgactaaaacacgacttagctttttcaataagaagaccttcggaagcgccgaaggtctttctagactattcagtccaaaatgaggtccaatatgcagcatgagcagccgcaaactctgacagcgaacgaggttcttttcccgtcacacgcttcactgtatccgttacccgatgttccgcaccatggctaattgcctcatcaagcttcgccataaaatgggcataatccgcgggcaaacctcctgcctccattttatgctgcagctcggaacgagaaatgctgacatgctccacccggcgtcccgccgcagctccaatgatctccgccgcttcggcatagctcagcgcctcgggacctgtcagaatatgatgtgtttgatgaggaacatcatcaatcaaagccctgacggctgtttctgcgatgtcatcagcgtcaataaacccaagttttccttcacccgaagccgttgtgatgcgcccctccgtttgaatagacatgcggtgctggacattgatgaaattttgcataaagtatgagggccgcagcaccgtccattctggaaactcgcgcactgcctggtgaagcgcgccaaacacgggaccgttctcggagacaacagacgcactttgcatcactacccgctttgcgccgagacgctttgcttcctttaaaaagggaagcacatagggagccggatcaaatacaccgaccggagcaacaagatagatctgttttacctgttccagagcaggcgtaaaactggaggcgtacttccaattaaaatacacatactcagcatcagcaagcgcgccctttttccggcttgcaatacgcactctgtatcccagctttattaaacggctggcgattcggctgccgactgtgccggtcccgcccgtgattaaaatcggattctgtttcatcatttcccactctcctctgtttgcaaaaatgatcctccaaaggcctcttttacaacaagcggattccaataatccctataacgcacaatgcggccgtctctcgtttcgatgacactgatatagctttggcgataaggcagtccagtctcaatcacatggccgtcacattgaaactccgcaatcaccgtattcgagtctgctgaacggtacactgtcggagcggtaaatgaagaaagatgaatctgcttaggataatctttaatataatcgtaaatggccgcttttccttctattctttttggtgatccctccggcgcataaggaaactcaaatacagcattctcatcccaaagctccgtccagctcttcatgtccttctcaagcatataagccataaactttctcaatgtttcacatgctttttcaaactcattcatcaacattcatcatcacctcatttttatttctagactattcagtccaaaaagtacatacatgggcaaagaatcctttaccacatgttaatcaagcactgataaactcacgtcaacatggtcctgaagccgatccatatctgccgtcacttttgcaataaatgtcagtgacagcctgctctgattcaggtaccgagcaagcgcagatatatcagtatcttcgccattcaattctccttgatccttcgctcttaaaagcccgtgataaaaagcgtcctcaagctgcttggattgtctttcaaaataccgggcaagctcagggtcatgcgggatctgttcaatcgcgctgttaataatgtagcacgccttcgcccgttccggatccctcagggcattgacaccctcctgaaaaatatcacgaatggcttcctttacagatcctggcgcttcaagcctttccataacggcagcgtttttcccttcaagatacgatttcacagcggacaaaaacaaatcacgcttcgttccatacgtatcatacaaactttggcgcgcaatgcctaaatgagagagcagatcctgaagagacgttccttcgtagccatactctccaaaaacctctatcgccctgtgaagaacaagcgccgtatcaaattctttattcctccccaaaaaatgatcacctcctgaaacaaatgttaccattttccagactgaacagtcaagaaaaaagctaaaaaaacactcttgatctgcaagagtgtcctctttttatcatcatcttctttatttataaccgtcttttccccagtggcccatatggtgatgatggtggccataatgaccatcatgatggtggtgatgattatcctttccaacatggtgatgatggtgatgaagattatcttttccatcatgatgatggtgataatagtggtgatggccatcattttcatggtgcatgctcggatagcttccagttcccggagagcctccatagccgccgcttgggtaaccgccgtacccaccatatcccggatagccgccgactcctccatgtatgccgtgatctgggtagccttgcatgccatagcccgggtggcctccatacatgccatagcccggatagcctgtgctttgcatgccatagcccgggtggccaataccaaagccctgataatgaccaaaaccaggtccgccatacatatgtcttgtatcagtcatatttactctctccttcacataggttacagtccagagtatgagaatatcttatagatcgtataggcggccgcctacatacagctaaaacaatttccgggacaaaaaaagcaggccataacagcctgctcactccttactcacctaaatcaacgttatgatatacctgctgaacatcttccaaatcttctaatgcatcaatcaatttttcaaactgttcctttgcatcatccggaagcgttacttcactttgcgcaagcattgtcagctccgctactgtaaattcctcgacacccgcgtttttaaacgcctcttgcaccgcatggaattgatcaggctcggcatacacgatcgcgctgtcatcctcttctaaaatgtcacgtacatcaacatccgcttccatcaggatttcaagcgcttcgtcagccgttttgccttccacaccgattacagccgtcgcgtcaaacatgtaagcaacagatccgctcacacccatgtttccgccgtttttcccgaacgccgcacgcacttccggcgccgtacggtttacattattcgtcagcgcatcaacgataatcattgatccgttcggcccgaagccctcataacgaagctcatcgtaattctcttccgctccgcccttcgccttctcgatcgcacgttcaatgatgtttttcggcacgctgtaagtcttcgcacgttcaagcacaaccttcagcgcctggttggattccggatcaggctcgccctgtttcgccgccacataaatctcacggccaaacttcgcataaatccgactcgtatttgcgtccttagacgccttcttctctttaatattgttccacttacggcccatgatgttccactctctttcatatatatcaatctaaatactgttattcactttatccattatacctcaaatggtttggttgtttcgagtgtcttgcgttagaaatagaaggaatgccgcgatgtggaaaatggaacgtcttccgtaaagcaagaaaaagccctagctaagggctttcttctgatcactaagtttgtaaggggaatgatcgatatacgtcgtatttcgatctgtcgattccttaaatccaccggagtttgtcagggttggaaacgacatgcttccgaaaactagagtaacagccagacacatcatcacttttttcttaataggcatataaacactctccttttagaatatcttcttgggctttcagcactttccgataaaacgcagctgcttgttcaaagtgacagctgctttcaaaaacagcggcagcactccgggcacatgcttcaatgtaagcgtgcaggttctttttttcgaaatagcttaaaagatcatgaatttttcgttcatcaacagtctccttgtacacggcctgcaagaacagaaacaattctttataaaatttgtgagaacgtgctgtgatatggtctaatccttcctctatgaactgaaacgccttctgtgtttggcccgctttacataatgtccagcttaatccaaacaagactttcggaagcagatcaggcactttctctctgcttactttcgccgctttttggaaatgttctacagccatctgatcgtctcctgatctgtcatagctgtttgcaatgttcaatagagaaatggcgataaacctgtcattttgaatgtccattgccaattccagcgccgcctctaaatgcgggagcgctttatcataatgtttgaaatcatcatagttgccggcgatcacaaacaagctttgtatcgttctaatgctgtatagaggatggttttgataaatgtccaaggcttgaagaatatgatacatcgacacatgggtttgcttcatgtgataatacgcttctgccactttaaaatggaattccgctttctcaatatcatctgacacaaacggcagttctttctccgcctcgcgataatatccgatcgcttccacatattctttttggtcaaattcatacatgccgcggaaaaacaaagagtagtatttcaaaagacctgtgagttttttctgaggggtctcgatcgtttcaagaagctctgtcactgtagggcgattcccgtatgtttttcccggctccaaataatcaagcatcagctggtgccgaaaacacatcagagaataatagatcagtaaatcctgatcttcttccatctgctgaatgtcctgctcaacctccgctttcagaatctcagcatccggaacactgaactggcgaatcattttataccattcattaatcttaacaccaacacgcgaagacggtatggcttgactcaacggcttccctccttctctatgagatatgtcatattctatcaatcccaaattttgaaaacaatatagaaggaagaaattgttttttcatcctgtcaatttgtttttttcataaaaaagaaccctttatgcaagggtctttgtcattctatttcatatagtattcacttattgtcaaccacaacaaaatcctgaaccttcacctgttcctcaggcaaatcaaactgataaagcatctccttagaatggatatcaaacacacccacgtatccgccgatgccctttttatgctcttcctgggcaactatatacaatagattccccttaaacttcgcctccatataagggaatttcaagctgtatgtgtgaatagaaaaatcctccccatattccagcaagttcgctccaccctctttgtcctcgtacgccacgtaaaaactgccgctttctttgtcatagtacacagtatctgcatattcaagatcttcaggatacgcaatatatgtcgtcttccatgtccctttttcaatcacagtcaatttatgatccgagctcgcgacgataaattcctccgagtctgcgaattgatcagcgtatgaggctaagctcagggtctcaatcatttcctctgtttttctgtcaatcacgtaaatagacatgctttgaatgatataaataaagttctcatcactggcccccattgtgacaagcggaggcaaggtaagggtatattcctttttcgtttttctgtcgtttatgtggatctcatttcccgtcgtatcaacattataggcctcaatagtgacatccttcccctcataccaaaacgcaaatggatctgacagcggatgctctttgatcacatccttctccagcgtgtagtaaaaaggctcgtgttccgccaataatacaaggtctgttgatgcataagatttcgtttgaatataaggcacatccgccaccttaaacgtacgcctgttaaaccgttcgcctgtagaggttgaaagcagcacgctttcttttatgaaaggattggagtaaataaaaaagatgcggtcttcttcggggtgaatggcggaagattggacaggaatactatctttattgcgtaactgaacatacagaacaaacaggatgacacataccattaaaactaataaaccaaatgtaatccgttttttcgtcatcaacatgctccttaaaaaacaatatagaatacaaacttccaaaaaatgtgtagcaatcaatatcatttcgaccatgtttcctccaatccctccacgaataaagacacatgccaaatgactcatttttccaccaaaacacgttctcacccccaccttatcccgacccgtggtaaaattttgatattgagcgaacaaaagaagggaaatggtcatgaaagtatttgaagcgaaaacactgctttcggaagcgacagaccgtgcaaaagagtacaaagaactaagaacgcaaatggtcaacttgagaaaagcgttaaaaggagtcgctgatctcagtgacagtgaattctcaggaaaaggcgccagcaacatcaaggcattctatcacgaccacgtcggcgtcgccgaccagtggatcgactacatcgacatgaaaatcgcatttttcaacagcatcgccggagccgccgaagacaaaggcctctcagacgcatacatcgaagaatccttcctggagcacgaactggcaaatgccaataaaaaatctaaatccatcatgtccgaacagaaaaaagcgatgaaagacatcctaaacgatatcgacgacatcctcccgctcgacctgttttcaacagaaaccttcaaagacgagctggccgatgccaacgacaaacgcaaaaaaacactggaaaaattggacgccttggacgaagacctgaaaacagaatacgccctgtctgaaccaaacgaacaattcatcaaatccgacttccaaaagctccaagaagcaacgggtaaaggcaaaaacgccacacccatccactacaacgccaaggcgtaccgtgagagtgacatacataagaaaaaaggcgacattgaaaagcggactgaggcttacttgaagattaagaaagaggaagcgaaggaacgcgagattgagaaactgaaagaaagactgaaaaactacgattatgcagatgccgatgaattctacgaaatggcaaaaacgatcggctatgaaaatctgacagctgaacaacagagatacttcacccaaattgaaaacacgcgtgagcttgaagcaggcttcaaaggggttgccgtcggcctttatgattccgggaaagacgcggtcgtaggcctgtgggatatggtcacagatccgggaggaaccgttgaagcgattaccggagcgatggctcacccgatcaaaacgtatgaagccatttcagcggcaatcgaagaatcgtatcaaaaagacatggtgaatggtgacacctactcaagagcaagatgggtgtcatatgcggttggcactgttgtcacatcaattgtcggcacaaaaggcgtaggagccgtctcaaaaactggcacagccgccaaagtgacgaccaaagtcaaaacagcagcaagcaaatcagcaacagcccaaaaagccataacagtctcaaaacaaaccgttgatcacatcaaacaaaaagtaaacacaggcattgaagtatcaaaaaaacacgtcaaaaccaagttaaatcaaatcggagatctcacacttgcggatattctcccgtatcatccccgtcatgatttagtgccggcaggcgttccttacaacgcagtcaacggggtcacgcttaaagaaggactgcaaaaattcgccaaggtcatcctgccgaaaccatacggaacgtcatcaagcggaagacgaactccagcgccacatgtaccgccggtaaccgtcaaatacggcgagcatttcgcaagatggagcagaaagaaagtgctgaagcctaatatcatctacaaaacaaaagaaggctacacgtacacgactgacaactatggtagaattacaagtgtcaaagcagacttgcagctgggagaagcgaaacgaaaccaatatgcacaaacgaatgctggaaagccccaggaccgaaagcctgacgatgacggcggccatttaatcgccacccaattcaaaggctcaggccagtttgacaatatcgtgccgatgaattctcagattaataggagcggtgggaaatggtatgagatggagcaggagtgggcaaaagccctaagcaaaaaaccacctaaaaaagtagcagttcaaatagaaccagtctattctggggattcacttagaccatcatatttcgatgtaacctacaaaattgggagcagaaaagaaataagcgtctctattaaaaatcagcctgggggttagaagaatggaaactaggaagatgcaagatttgtatcaacttattggagaaaaactcaatgacatcatacctggtgaatggacaaagatatatctttatgcagaagtattagatgattccacaatggttctttttcatttcagaacaccagaaaataatcaaattatttattcacaagatatacctagccattacaacgtaagcaaggatattttcaagacgttgttaagagaactaagagaactttttgaagaattaagaactgaacacagaaataataacgatgatgtttggactaaccttacactaacattggatcgtagcggagaattccaattagattataattatgatgatattttagcctcagaattagatggatatgaaagaatcgcaatatgggaatataaaaaccttggtattttgcctgaagatgaggatgataaagaatttgtaattagttacctcggtctataattaaaaaatggctcagccctactctgctgagctattttttataaaccaatctaaaataaagatattttagaggttttccatatgaatatattgttataaatacaattaataaactctataatgagactaacttttctcaagacaattatctatcattatgcaaacaacctataacattatcagaagaaataaagtcatttgtaaaatcaatggagatacaatctattggagggcaaacaatggataaactgacaaaagaagagttgatctttcttgtaaaggaattaatgaacccaacattagatgatgagaaagtcagtgaatatctcgatttattagagaaaaatgttccttatccggcaccaagtgatttaattttctggagcaatgaagattacacagcggaacaagttgtaaaaattgctctaaattataaagatgagtagtctatcaaaccattaaacagatatagcaactctcaaatagaatagagatttaaaaggagcatcaccttgacagtaagaaaagaattaataaaacaaataaatttaacaatcactgtaataaaaacaataaatcaaaagaatccaactccaatggtgaaaaacatattaaaaagatatgaagaggcaaaagaatttatccttcaatcatcggatggaaaattcgaagaagacctctctaaagttagaaataaactagacactctgacgagagcatatctagaatcagctaacgactacatgaatccgatgctcaaagaaatgcataagacagaaaaactgctaaaagagtatgacgaaactactcagtcgtaataaccgcaatcctaacttcacgaattgagtttccgctaaccttcacacaaccaaatataacgcaaaacacccaaactcccttttgcggacagcaccgaaaattttttttgcggtcgctcaaccccttcctattaatactcgcaacacataattctacaattgtgacaaactccaaagcggaacaagttattgttatggcatcaaattttttcatagtctactataaaattattattaatactaaaatcctaatatactaatttagtcataaagatgaaccatcatcacaatctcatctattacagcttgtaaatcttcaagtgtgacaacgaaccactctttaggaactaacatctttccatttgcccccaaaatagaaacatccaaattattatttgctagcgcatgatggattgccgtctcaaatttgctagcattcatattgaacacttgatatgtggttacaatttctactggagcataaagataagttgattgattttctgcattcctgattctattttctactgaaccagttgtaaaaccgatcttatataaattcttaatggaactaatttgcggatctgtactcaaagattttagtacgtaaataaagccagtcgaaacatcatcttctctaacattatccaacaatgtatcttcattgtcggtcacacgtctaccatgtttatataactccgctgataaggaacgtagtaacatatctgattccgttccattttcaaatatacatcgaagtctagcattggtttttccctttgcttttttacgttctcccacatcttcaacataaagaagaactccttttaatatataaaaactatttgactgtatgtcttgttcatttttgaaagttaaaatttttcgtttaccctctgtaatttccttgtggcacttcttgaatagctcttcaaactttccaaaatcttttatttttttacgctttgcaacgtattcaggcattgtcgtaaccttttgaagtgaacttgtatcaaaaattgacctagttatatcattatttaaattatcacctaataatgcagatgagccactttttagaatatcatcaattgaagaaattttaggaattgttagttccttcgatcttacttcaagtaatccaatttcatcatactctttcaaatattccatacgatcaggatctttccgaatcccaattaatcgacttgctaaacttctttcagttaaatcagtagggactttttggggttctcgcccattttctttgacgaattcaataatctccaaaaacttttcaacttcaggatcatactgggctttttgtgttttcttaggtggtgttgtgatttggtaaaacagctgactttccatgatttcattaatagaatggtatctattacttgccattttcacgtttcctcctaagctcttgcatgtataatacagcttcacccatacgcctttcaagtgggtcttcagattttgaatcaggtcttctaccagttgaacgataaaattcctaaacctttggccatatgaatactagttcatcttcatcaaaattaatacgttttgcatcaatagtttcctgaatcagttttagcactggtgagttcaattctttcgatagaacctcaaatgctttttggaacggattgatggaatcaatcagattgatatctaaatcctcaatgtttataaacttatctgccattcttataaattctttacttcctacaacttcagacttagcacctttcataactgtatctagaacaacgtgctgtctaacttcctcaatttcctcatctgataaatttggatatactttttgaataactttcggaatcaacactttgttcaatactttgggatctacttctccactaaatgttttttggacttgtgaatcttgcatgatttttgcttttaaatcattaatatcattttcaataatctttttgacattttctgttgatggttctttcaatcccttaacgaataattctcctgtagtagaagatttttcactttcatttcttctacgtttaaatttaaagtcaggtgtaaggacctgctccatcaaaagtgaggcagaaatagctttaagcattgtattcactgtataagtcactacttcatcctttgcatcaggcattgcgattaggttggtaaattgagcataggttttattgtaactatcacgtgtacagcgcccaattatttgtactatttctgtaagtgagccacgataaccaactgtcaaagtatgttcacaaaacggccagtcaaagccctctttcgccataccaagagcaataattatatctaaatcgtctagggcttcaatattacgcaaatacgcaacgacattttctcttccaacttggtcatctactaaatctgcaattttcaatgttttaccgtcagaatgtcgcttaacataaataattccagtatcatcatcttgatattcaacttcaccaatcatatcaagtatcttaccaacttcatcgtacttatcctttgtcgattcccctgagtttacatttggaatatgaacgattgttttcttatttgtatccaatacttcattaatagctgatgtgtactggccttgatagaagtgatatcctataccaaatccctttagatattcatatccatcaagttgttcataataggaataagttaccttgtcaaataattcctcatcttctggtaataaaattggtacagaatctccacggaaatacgacccagtcatcgctacaatatgtgctgatgaattatgaataatacttcttaacaattcacctaatcgagaattgacatctgccgatacatggtgaaattcatctattgcaagtaaacaattatcaaatgctttatcatcaattttttcaaacgcaaatcgcaaagtagagtgcgtacatattaacacctgatcgtccgattccataaaacgaacaaaagatttaaccttagagttatctccgccaacagttaaattatttctaggatcaactttccaattttcaaagaaaccataactttttaaatccgtatttttaaatgaagaacctatagagcgttcaggtacagcaacaatcactttcctcaaaccttgatttatgagcttatccaaaccgataaacattaaagctctagatttcccagaagctggcggtgctttaactaagagatattgtgagttacgtttttcaaaagctcttgcctgcatttcacgcataccgtattcatttgttttcttacttttaccagtttggttataattaatttcaattatattttccatacaccttacacctaccgttctgtcatttcttgatacaatttaagcaatacttctaagcgttcttcatcagattcaaattgtttttgacgatacgctctttctacaattccatccaacttttcatgtgctacttttaattcaattggcattgttgaagggttataaagctctgctaatgtaccaccctgctcttcacgaagatcaagaatttcaagaattgcttcttcaatttcattcttccttcttgttgataattcaggaatagggaaagtgttataacataaacctgcagagtacctatagtcagtttttaatcttccggctacagcttttacccaagtcatatgcatccgtgacatcaaaatgcctagaaggtaaatttctgcatcgtaaattacataaattagatttgacaaaattgtatctgcacctgctaatcccattggaatataaaatctattttcagaagacacagatggaacaacaatggaataattagttgtttcatgagtatctctaaacttccacggagttaatgcaagtttattcgttcctttatctgttgatttttccctgtgatttttttgaaattgagattctttcttgtattagaggattagactttattttttcatattttgcttcattaagccataaacaataccgtaaaccaccattaataaactctactgaacctataaactttttaaaatagggaactaattcaggatacttattgattgcgtctgtatattccgtaatggtaaagagtaatcctccgccatcattaggcatgttcccaaaatgcagtttgggtaagtctgaaattggcttcgtcctagaagaaacaagaatattttcaccatcagttaaatagggactaatgttagaaactagctttttcgtttcatcaacaaataaatacttgtttactttggtatctaacgggccaaaacctacaatcacaacaattaccgcagcattatttttagcattattcgcccatttaaaagatttataggcaaaattgatttgaattccaaacttgaataactcattccataagatagaaacctgttccccttgagtaactgaatttgttgatacaaaggcaacttttgcatttgtagttgaagcgtatttagcaccaaagtaaaaccaagcagaaatataatcaagcattttaccattcttgacttttccaaaaattgataacatatcagatttatgttctttgttttgtttttttgaaccaagatacggtggattaccaaaaacatatacttcttcagatccttgtgcgggacaaacctcagtccactcaaccctaatagcatttgcacaacgaatatcccctgctgtatgaagtggtaacgttgggcgtactgcattatgaacttcattttttaattcttcattcatttgatgttcagcaatccaaagtgataattttgcaacgtcatgtgcaaaatcttcaatctctattccgtaaaattgagataaagttactgaaggtacataaagatactctcccaagagttcttgaagtcgttttataatattgatttccatacgccgtaattctttgtaggtaataatcaaaaagttccctgaaccacatgcaggatcaaagaatttaattttgccgattcgtgttagaagattttcaagttttgtataatcatcgtatgcatctaaaaaagactgattaagtttatctaggaaaagcggtttaataaccttcattatattggggacacttgtgtagtgcatacctaaataactacggctttcttcagaagcaacagcttgaatcattgaaccaaagatatcaggattgattttagcccagtttaataattcaccgcactcaataattaactttctggatttggcagaaaattccaactctgtatgtggttcagtaaacaactggccatttacatacggaaactcttttaaataagatggaacatcgtctcgttcatttttatctaacacgataaataaatcagcaaataatttatttagatttgaaccatcttcttcagtcaaagtcttaattaaattcgtaaaactatttcgtttgaagatgtcagtatcttctgcgaaaaaacaaaacagtaaacgaataagaaataaatctaaccctctattagtctcaataatattgttttctttacgaagtacatcatatatccgtgcaaaacgttcggctgctttaatatcagcggggttttccttttcaaactctactttctcaatacctttccaagcaaggaagaaatcgaaatactgaggaagttcttcaaatttaacatcaagagcctctaatgtttttgtatctttcgctaatactccatcatagtcagtaactaataaatatcgtggcttagctgaaagatattcaacttgttgttctatatcaataagggcgtcaaagagctttcctttcttagcctccttaaaccacaccttattctttaagtgtacttcaccaacccgttttgtaaggttttgatttccttttttcaagcgcgtaattgtagctcgtggaacatcatatacaccgagtaattcatacaagaaatctgaatgatcttctcgattcactatttcagcaattttatcttctaaatcaatgagcgccatttcgtttcccccattaaacttttgattacttttataaaaatttctcaagatattgaataattaattcacaatatttatccatttatagcttcagcagctttcttctttttagctcttacaagtgtagaaactgatatcccagtcatatcttcaacttgtttatacgaatgattttctagtaatgttaatgcatgattgatttgctgctttgtgaactttttgggtcttccttctcggaaatccggattctgcttggccaacattttaccttcttgagttcgttctacaatcatatctctctcaaattcagcaaacgcagagaaaatagtaaatattagaatcttttcagaatatattgctggaaaaggctttgatgcaatagcaaggggattgtataacgaaggggtcactagtccctcgcagcttgcccgcaaaaagaacgctactgacaaatggcacggatcttcaataagaaaaattctcgaaaatcctcactatactgggacactacaacaatgtagagaatatagaccgagtgttaccagtaaaagaagaaggtcagttaacctagaaaaccaaataattattgaaaaaagccacgaaccaatcatacctttagaagactttcttattgtacaagagattttaataactagaaaaagaaggagacctcaagctgaagtacatctctttacaaatactgcggtttgcaaagattgcaggaggtcaatgcattttaaaaagaatcgaaaaggttatgtttgtggaagttataataaacatggtttaaaagcatgtagtgatcattacgtaagtgaaatagatttaactgataaagtaataaccaacctaaataagatatatttgaaattcagtaaggaaaattattttaaagaattaagtgaaaaagcgttaaagtacaaagaaaaaatcgaatctaagataatcgaaattaatgaaaaattaaacgataaaaagagagataaatccaatttagttatctctcttgctaatggtgttatatctaaagaagattaccaattagccataaatatcaccaatgaagatatttcaaattttgaaactacccttcaccaactatctaaggacctagaatttcaaaagattgaaaaagaaataattgattttaaaaagagcttagataaattcatgaaggaaggtacacttacccccgaaatgcttcatttgttagtagatgaaatagaagtacatgcaaatggaaccattgaaatcaattatcgttttagagaaccaacagttccatcagcatagatttttgactatttattcttttaattttatcaacacacagcactccacatgattcgtatgcggaaacatatccacaggctgcacttcgcgcgtcacgtacccgccatcctcaagcacccgcaaatctctcgcaagcgtgccaggattacaggacacatacactacccgcttcggcttcatctccacaattgtccgcaggagggcttcgtcgcagccttttcttggcgggtcgacgaccagcgtatcagctgtaatgccttcttcgtaccactttggaatcacggtttccgcttctccaacagcaaactctgcgtttgtgttgccgtttaattcggcgtttcgcttcgcgtcctcaattgcttccggcacaatctctacaccgtacacttttttcgcctgctttgccaggaagagagaaatcgttccgatgccgcagtaagcgtcgatgacggtttcttccccttgaagctcagcgtactcaagcgctttgtcgtagagcacttttgtttgctctgggttgacctgataaaacgatctggcggagatggcgaatttgacgtctccgatgaggtcgtagatgtattcttcgccccagatgacgtttgtttcgttgccaaaaatgacgtttgttttgtttgggttgatgttttgcacgatggatttgacgtgcgggaattgcgctgtgatgtcttcgatgatcttcgctttgtgcgggaagtcgcttgttcttgtgatgaagacgatcatcatttcgcccgtaacaacgccgtatctgaccatgatgtggcggagccagcctttgtggcgttcttcgttgtaggctttgacaccgtagtttgcgcaaatgtctttgacagcttgaacggcttcgtcgtttttggattgctggatcaggcaggcgctcatgtcgatgatgtcatggcttctttgctgatagaatcccgcgacgagtccgccttcccgttctcctaccggcacctgtgctttgtttctgtagttccacgggtcttccatgccgagtgtcgggtgcacggtgacttttgaaaggtccagcttgccgatgcgttctaagacgtctttgacttgtttctgtttaaacaggagctggccttcgtaggtcatgtgctgaagctggcagcctccgcattgtttgtaaatcgggcatggggcgtccgttctatgcgggctttcttccttcagctcaatcaggcggccgaaggcgaacccttttttgacgcgtgtcactttgatttgggctttttcctcgggtagggcattcggcacaaagatcgggaagccttggacctttgcgacgcccgctccttcatgtgtcaaatcctcaaatgtcacatcgtagtattcatttttttctactgggggtttcattttcatctataatcacctctagttttaagcgaaagaaaaacttggcctattcaagccaagtttcagcgtgtaggcaaaccttcgcattcgttgtcaggcctgtgcttcggtgctcacgaattcaacattcgctgtgctccgatgctcgcccttcctagacttcaaaggttttcaatcacgctgaaaagatgacaaaatcctaaaacgaaaactgttttaggattttgtcaacattctgagcttggcttaccaagccaagttttagtcatccaactgttccgctttctccttcggcatgacgacgtgaatgtgccggtacagattcacgaattcgcccggcagcatgccgccgtactcgccgtccaggttcagctgcatcttttctgatacattgactttcacgcggttcgcttttgtataaataatgtgctggtcgttgatgtgttctccgcgaagcgccatcgtggcgaccctgataaattcagcaaggtttgctttctttagtatcatcaaatcaaacatgccgtcattcaggctggaatccggcgcgagcttttcgaacccgccgacggagtttgtcagcgtgaccaaaaacagcatgatttcaccttgaaacagcttgccgtcatattcaatctcgacttctgtcggacgaagtgaaggcagcatttccattccttttaaataataagcaagctggccgagcattgttttcagtttgcttggcacgtcgtacgtcagctccgtcagacggcctccgccggcgatattgataaaatactggccgttgacctgtccgatatcaatcgggcgggcaacgccgttaatgaccgtatctgccgcttttaaaatatcctcgcgtgggattccgagcgctctggcgaagtcgttcgttgtgccgacaggaatcacaccgagtgtcggacgattgtctaaaggcgcaagcccgttgacgacctcgttgatcgttccgtctccgcctgccgcaatgatcaggtcaaactcacgcaatgccgcttccttggcagcgtgtgtagcgtctcctgcgcatgtcgtcgcatgggtggaggtttcatagccggcttgttcaaatttttgcaggacctgggcaagatgctttttaaagatctcccgtcctgaagtcggattgtatattatgcgtgcacgtttcattatctcatcatcctacttaagagtatccgatccatttttacactaacaacctttaattatactatgagttaaaaaaatcgcaacaaaatgtacataatcttacaggtgaaaacgcacaaaagctcaaaactgattcttgttttgagcttttgtcatccttaacattctttcagcttgattgaaaacccttgtagtctaggaagggggagcattggagcggagcgaatgtagaattcgtgagcaccgacgcgcagacctgacaacgaatgcgagggtttttcaacaagctgaaagcctcagcagagctgaggctttttgttttttactcttcttccgttcccggttttttcttgcggaacttcgccaatacttcatatacgattggcacgatcaggagcgtcagaagcgttgaactgattaaaccgccgataaccgttacgccgagtccttttgaaatgacctggcttccgccttcgaagccgagggctaatggaatcaaggcgccgattgtcgcaatggctgtcatcaggatcggacggagtcgtgtagagccggcttccaggagcgcttctctcgtagacaggccttccgcttccttatgaatcacgcggtcaattaagacaatggcattcgtgacaacgataccgatcagcatgagcataccgatcatggcgttcagactgatcgtttcacctgatacgtaaagtccgaccagggcaccgatgactgtgaacggcaatgagaacagaatcgcaaatggcgctagtgctccgccgaaggtaatcacgagcacaaggtaaacgatcgctattgctgccagcatcgctaaaccgagcttcgtgaaggaatcagcgatatccgctgatacgccgcctgtgtcaatcgatacgttatcagggtggtcaagcttatcgattttcttctggatagcagctgatacggctgtgacgttgtcagaggtaacctcacctgtgacatctgcatagacttttccgtcacgttttgacacggtatctgatgttgatccttctttcacttttgccacatcgccgattttgacttcctggccagtcgcggaagtgatctttttattctctaaatctttcacactcttatactcgtctttttctgtcttaatgttcacatcaagctctttgccgtcttttttcacagtggtgagcggttcttgcgatgtttgtgacattaaggcctgagaaatttgagacgcggttaaaccgagcttgcttagtttttcttggtcagcgacaaatgtgtactcatcatatgtgctggaaaggcctgaatttacgtttttcagatccttttcatctttcatgattttttcaatgtctttgaccgtgtctttaatatcgttttcagaatcgccatacacatagtatgttaattcgttattattgcctgaagagctgaagtcctgtgacttccattctccgcggtcagattgcttttggatttccttcagaacgttatctttttctttatcaaagtcaggtgtgtcgctttcatatttgatatagaataacgcaccgttagaatctcctccggcaagcgggctgccagagcctaatgaatactgaaccgtatcgacatgcttgcggtcaagcaggattttttccgctttttcagcttcattttcggcttcttttttcgtttcacccggttctgggctgtatgtgagctgcatcgttttttcttcctcggacggcaggtagctggcaccgattaacggtacgaggaacaagcttccaaggagcatcagaaccgcgatgatagacgtgatccatttgtggctcagcgcccagttcaatacttttttatagatgtttgcaagtctgccaggtttgtgttctttcgctttaatcggcgcaccggttaatgattttttgaacaggctgtgtgcgagcatcggcacaagcgtgattgaaatcactagggatgcggcaagcgcaaaaacaatcgttaaggcaaatggaataaacaattcaccgatttgtccgcctacaagtgcgagcggcaggaataccgcgattgtcacaatcgttgatgacatgatcggtttaaacatttccttcgtcgcttcacgaaccaaggcttttccgcggagcggctcatctttgagtctcatgcggcggtaaatgttctcgatcacaacgatggagtcatcgactacacgtccgatggcaacggtcattgcgccgagcgtcataatattcaatgtgatatcaagctgctgcagcacaaggagtgcgatcagcaatgataatggaattgaaacaacagaaattaatgttgatttgatatctcttaagaataagagaataatcacaatcgcaaaaatagcaccgaagatggctttgcttaacatcgtgtcaactgactgtgtgatcggctccgccatgtcgagagttgcgctgtaattgaagcctttatggtcttctttgaactttttcagctcagctttgacatcgtcggcaacctctaccgtattcgcatcgtttgctttgacgatgttgatgccgatgctgtctttgccatttgtgcgtgaaacggattcagcttttttcacatctttaattgtagcaatgtcagaaagcttgaccgtcggcactgctgtgcttgcgctttgctgcacctgtgctgccgcttgcgcgctttgggctgcttgagcactctgcgcacctgcttgagatgctgcgctgctgcctgcacttgaagcagatgccgtcgggattctcatattcttcaaatctttaattgtttcaatatcgccgctgacgacgacagatttttcttcatttccgaatgtgtacaatccaagcggagttgtcacatctgaaccttgaatcacttgcttgactgtatcttcatcaaggccgtattccttcagtttgtcttctttgaaagagaattcaacctcttccacctgctggcctgatacttggacggacgcaacgccttctatgccttcaagcttagaaacgaggctgtcctccacttgtttcgtcagctcttgcagattatctttatcactggacacgctcagcgtcagaatcgggaatgagttcaagctgtagcgtgaaatctccggatccttcgcgtcatcaggcaggttgacgttttctaacgcttcagctgcttctgttttcgctttgtccatatctttctcataatcatattcaatcatgaccgacgatgcgttttcataggacgtcgacgtcacaacgctgacaccgtccaagttctgtacggcttgttcaaccggtttggtcacttcatcagccacttggcttggtgttgcacccggatatgtcgtgctgatcgtcaagtaaggcatgttcacgtcaggaatagactcttgcttcatattcatacccgcatacaagccggctgccgttacaataatcgtcatcagccatacggcgaatttgtttttcagaacgaaattaataacgtggttcatcatatcctccattacattttttattgactgactggtcattctatataatactaaacgttataacgcaacaacgtcaactcatataccagaaaattttactaaatttttcaaggattaaggggaagcacgtcatgaatgaaaaaaaagagagaatcataaaaaccagcattcgtttatttgcgaaaaaaggattcgcagctacgacgatccaagaaatcgccagtgaatgcggcatttcgaagggcgctttttatttgcacttcaaatcgaaagaagcgctgctgttatctgcctgtgaatattatatcggtatgtctatgaacaaaatgaaaaatatagaagaagatctcgccggaaagccgcctaaggaagtgttaaaaaagcaaattggcgctcaatttgaggattttcgcgatcataaagattttatcgttcttttgcttaccgaaaatatcattccggaaaatcaagaaatcaagcaatacttttacaaagtaaccatggagacggataagctgtaccggaacgccttgctggtatcctatggcgaaggaatcgagcggtatgtcgcagatctgtccatcatggcaagaggcattgtgcattcctatatgaacgtgatggtatttaacggtgagcttaatatcgatgcagaagaaatctcagcctttattattgagagactggatgatcttgtacaggggctgagccgttctgcactcaatccgattgtatcaaaagacatttttaacccgatgcctgcgggaaaagaccagctgcttgaggacattcagaaagtgaaagaaaacagcacgctgcccgaggatatcaccgtgtcacttgatgttatcgaggaagaattgactcaggataaaccgcgcaagccgattattaaaggcatgctgtccaatttggccggaaccaacgacaaagaagttgaaaggcttcgggccctcatcttgtctttatctcaatttgaccataaaaaaagcagcctctaagggctgcttttttattagcgttttttaatttcttcaagcagaattttgttgaccatcggcgggttggcttgtcctttggacgctttcataatctgtccgactaggaagccgatcgcgcggtcttttccgtttttaaagtcttcgattgattgaggattgttgtcaagcgcctcagtgacaagcttcagaagcacgccttcgtcagaaatctgaacaaggcctttctctttcacaatcttctcagcgtcgccgcctttttcaatcaattctttaaacactttcttcgcgatcttagaagaaatggttcctttttcaatcaatttgatcatgccggcaaggccttcaggtgtcagggcaacatcggcaagctctttttgttctgcgtttaggtaagctgacacttcacccatcagccagttagacgcttgtttagcttcagcgcctttttgaacggtttcttcgaagaaatcagccatttcttttgtcagcgtcagaaccattgcgtcatatgcaggcaagccaagctcttcgatataacgcttgcggcgctcatccggaagctcaggaatgcttgcttttacgcgttccttccattcatcatcaatgtagagctcgactagatctggctctgggaagtaacggtagtcgtcagatccctctttgacacgcataagaatggttttcttcgttgcttcatcataacggcgagtttcttgctggatgacgccgccggaaagaagaacctgctcctggcgtttttcttcatgctcaaggcctttttgaacaaacgcaaaggagttcaagtttttcaattctgtttttgtgccgaattcctcttggccgatcggacgaagagagatattggcgtcacagcgaagtgagccttcttccattttacagtcagaaacgcctgtatattggatgatggatttcagcttttcaagatatgcgtacgcttcttccggcgtgcggatgtccggctctgatacgatctcaacaagcggcgttccttgacggttgaagtcaacaagagaatagccgtcgcccgtatgcgtcagttttccggcatcctcttcaagatgaaggcgcgtgatgccgatgcgttttgttttgccgccgacttcaatttcgatccagccgttttcgccgattggcttatcaaattgagaaatctgatacgctttcgggttgtcaggatagaaatagtttttgcggtcaaacttcgtatccgttgcgatctcacagttgagcgccatagcggctttcattgcgaattcaacggcttctttgttcagaacaggcaggacgcccggatatccgaggtcaataacgcttgtctgcgtattcgcctccgcgccgaatggcgttggagagcttgagaaaatttttgattttgtttttaactcaacgtggacttcaagtccgattaccgtttcaaagttcaattcttttcaccccttacagttcaggttttgctttatgatggtctgttgcttgttcaaatgcatgagcaacgcggtatacagtgctttcatcaaagtgttttccgatgatttgcaggccgagcggaagtccgtctgctaatccgcatggcacactgattcccggtacgccggcaaggttgaccggaatcgttaagatatcgtttgcgtacattgtgagcggatccttcgtgttttcaccgattttaaacgcaggtgtcggtgtagtcggtccaacaataacatcatatttttcaaatacgtcctcgaaatccttcttaatcaacgtacgcactttttgcgcttttttgtagtacgcatcgtagtagcctgagcttaaagcaaacgttccgagcatgatgcggcgtttgacttcatttccgaaaccttcagcgcgcgtttgcttgtaaaggtcgatcaggttatccgcgttgtctgtgcggtagccgtagcggatgccgtcaaagcgtgcaaggttcgctgacgcttcagaagatgacagcaggtaatatgtcgcaagcgcgtatttactgtgcggaagagacacttcttcccatgtagcgccgagaccttcaaggactttcagcgctgccaagacagattctctcgcttctttgccgacaccttcaccaaggtattctttcggaacggcgattttcagtcctttgatgtcgccagttaatgaagaaagaaaatcaggcacgtccacatttgcactcgtagagtccattttgtctacgccggaaatcgcttgaagtaaaaacgcgttatcctcaaccgtacgtgtaatcggtccgatttggtccaatgaagacgcaaatgcgaccaggccgtaacgagatacacgtccgtatgtaggttttaatccgacaacgccgcagaaagatgccggctgacggatggagccgcctgtgtcagatccaagagaaaacggaacttctcccgcagcaaccgcagctgcagatccgccgcttgaaccgccgggaactgtatccaggttccaagggtttttcgtcagcttgtaagctgagttttctgtagatgaccccatggcgaattcgtccatgttcagttttccgattgtgaccgcttcagcgtcttgaaggcgctgaacgacagtagcatcgtaaatcggatcaaagttttcgagaattttgctggagcatgttgtgcgcagcccttttgttacgatattatcttttacgccgatcggcataccgaaaagaagaccgtgctcagaacggccgtcaaccgcctcatcaagctccttcgcgtatgcgcgcgctctttcttcatctaatgccaaaaaggcttgtaccttatcatcaaccgcttggatgcgtttataagattcatcaaccagatcagaaatcttaatctcttttttatgtatgagctgttttaattctgtgattttatgatcaaataatgacattcttgtgtccctcctttagtccagaattgatggcacacgaatatagccgtctttatggtcaggcgcatttttcatgacatcctcaaccggaagacctttacccgcttcatcttctctcatgacatttttcattttcagcacgtgagttgtaggctccacattgtctgtgttaacctcattaagctcctcggcaaatgaaatgatactgtcgagctgttcagtgaacatttttgcttcttcttcagtaatcgcaagtcttgcaaggtgcgcaacgtgctttacttcttctattgaaattcgtgacatatgatccacctccacatatttctccgttaagtcatataatactgatcatatcaaaaacaagccctttaaagcaacaaaacgccttgagacaggcctgtgttttcgaaacaataccctatatattttatactaaaatgaggagaaggagaaacgaaatatttttctgaatatttttactttaattattttttgaaagcgttttattctttattcccttctaggtttgcaacggtatttccagcttatgatcaatgtttcatcgcttgaatggccgggaatactttgttaggttaagttaccaagtgcacccgcaaaagaatttcttttgttttgcacttacgccaggctgcttaactggcaccatcaatttgagaggtgatgcaacattattagaaatgaagagagggtaaaacgtgagtattgaaattattatatctttaggaatttactttattgccatgctgttaatcggctggtatgcattcaagaaaaccactgacatcaatgattacatgcttggaggaagaggcctcggaccattcgttactgctttgtctgccggcgcggccgatatgagcggatggatgctgatgggtgttcccggcgcgatgtttgcgacagggctgtccaccttatggcttgctttaggtcttacaatcggggcgtactcaaattacttgctgctggctccaaggctgcgtgcttatacagaagcggcagatgatgcgattacaattcctgatttctttgataaacgattccagcattcttcatcactgctgaaaatcgtatctgcattgatcatcatgatctttttcacattgtatacctcttccggtatggtatctggcggacggctgtttgaatctgcttttggtgcggattacaaattaggcctgtttctgaccaccgcagttgtcgtgttatacacactgtttggcggtttccttgctgtcagtctgactgacttcgtgcagggtgcgatcatgtttgcagcactagtgcttgtgccgatcgttgcttttacccatgtgggcggcgttgctccgactttccatgaaatcgacgctgttaatccacatttattggatatttttaaaggcgcgagcgtcattagcattatttcctatttagcctgggggttgggctactacggccagcctcatatcatcgtccgatttatggccattaaagacattaaagatttaaaacctgcacgccgaatcggcatgagctggatgatcattacagttctaggttccgtgctgacgggtttaatcggtgttgcatacgcccataaattcggagttgctgtaaaagatccggagatgattttcattatcttctctaaaatcttgttccacccattaattacagggttcttattgtcagctattttggctgccatcatgagttcgatttcctcacagctcttggtcacagcaagtgctgtaacagaggatttataccggtcatttttcagacgaaaagcttctgataaagaattggtcatgatcgggcgattgtccgtcttagtcattgccgttatcgcggtactcttgtcattgaacccgaacagcaccattcttgatttggtcggatacgcttgggccggcttcggttcagctttcgggcctgcgattctgctcagtctgtattggaaacgaatgaacgaatggggcgcgcttgctgccatgattgtcggggctgcgaccgtgttgatctggattacaaccggcctggcaaaatcaaccggtgtgtacgaaatcatccctgggtttattctcagtatgattgccggcatcattgtcagcatgatcacaaaacgtcctgcaaaagcctcttaccgattattcggtgtcatggaaaagctgttaaaacgcaaaaagtaagcaataagccatcaagcgcagcttggtggcttttgtgctcttgttttgctataaatactgtgagaaaatcatatttatttaaaaacaccatagagaagggggaagtttgctgttgagctggtatattgatcctgatattttattgaaattgggcattgccacattgattggcatggtcatcgggcttgaacgcgaattaaaaaataagccgctcggattaaaaacctgtattgtcatcgcagtcagctcatgcatgctgacgatcgtcagtattaatgcggcatatcatttccctaaatactaccgcatcatgatggatccgcttcgtctgccggcacaaatcatctccggcgtcgggtttatcggcgccggtgtcatcctgcgaaaaagcaatgatgtcatttccggcctgacgacatcggccatgatctggggggcagcggggctcgggcttgctacgggagccggtttttataaagaagcgtttgccagtcttctgttcatcctgatcagtgtggaatttctcccatgggtggtcagaaaaatcggccccgaccgcctgcaggaaaaagacatccgcatcagaatgtcactttctgataaagacaaaatgacagagattttaaaagaaatgaaaagaagagatatcaaagcacactccgttcggatcgacgacctaggcgaaaaggattttccaattatggaagtgaaggtccgcgtccataaaaacagatacacgaccgatgtctactatgacattaaagccattgaaggcgtagtcggcgtgaagtgtgatacattataaaagccaatgggactggaatcccattggctttttctatctacaccagtgctgaaaaatcaaatgctgtaatcggcgtgccattctctatatctcttctgaaaccggccagcatttctttttcctcttctcctattgtgttaaggtcaaacatctgatgcagcaatccgtaaatcagcatatggcgaaggcggaggaaatcaggtattatcatcagccatgcagggtcaagctcattttcctcccagtaccctttcataaaatgcgtcataaattcttctgtaaacgcagctttatcatcatatggcacaacaggataccacaggacattgtagagaagaatgctaatatcgttaacaaaccagttgtagccgatatcatcaaaatcaaatgccgtgattttgccatgatcccagttaaaattgccatggtgcagatccgcatgcaccaagccgtagttgtcctggcttttcgggagcctccgcagttcattcatcaaagaatcggcttgctgaaacacctttatctgatcttcaggcacatattttctcagctttaattgctcctcttcatcccattcctgtcttttgaaagcgggattgctcaatttgtagctttttgtcaggctgtgcatgctgcctgtgtatctgccaagctcataaaatagcgtttcattccagtccgattcatccactttttgccccggcgctttctcatacactctcaataaaaatgacccgccgtttccgtccggcactgcttctacgtcttttccgttcagcgacgggagcggtttggctactgaaattccccctattgcaaggtgacggagccattccatctctcccatcatataatcagaagatctccgaatcgtatgggtaatctttaaaatataaggttgattgtctttcatacattcatatacatagttttccgcatcagccagaaaacgcacctgatcttttgagaaaccgtatctcgctgcagcttctgccaaaacctgctcttcatgaaatatttttttgatatctttatgcacgtctaacatcctttcattgctatagatttgataatgattgttttcacacgatttccagcatcaacatacctccccttgatttgtgtttcggcagaagtgaaaatattttcccttttcctgttaattgtaacataaaaacccttgtgccaatatggcacaagggttttctatcagtcataaatgtgaacagtcggctctttatctccggcattgcggataatgaccgcttcctgtccgtctgaggacgtgatattgacttcgacatcaactgagctcttagagtagtagtccatcacttcacccgttaagaactgggtaaacgcgacaacttcactttttccgtagaattgcattggtatgtcaatcttcattttcttcatttcatcattttcatacagcgctgtaccgacaacgcctgtatagttcgggaaatattcttcaattgagtttttgaaccgcttaaagacctcggtgtcatccgggtacttttctgctgtggttgtatccgccggatagaatacatatttttcattgatgtcatcccaatttgagatatcagtagagcctgctttgacctctgttttggcgatgaagttccccggcacaatcgatgtttttgacgcctgcttgtagagcgccacggtaatcggcacattcttcaagttatcttttttgcggaggcggttaataacctcctgtgcaattttttctccctgctggcgaagcgtgctgtctttaatctccacttctttttgcgggtcgccagttttttcacgatagtaatacactgagtttaacgccagtccgatcatgacgccgccaagctggatagaattcttgtcttttctgactaaataatcgtgctcaagcatggatgctaaataaattgggctgctttcgttcttttcttctgttgaaccagaactcgggagcgccgggttcaagccttcatttttgaagttcttatcttctttttcggcttttttcaaatcagagcccgtttttttccgtgccagccagcttaatactgtatcctcatctaaatattgtccttcttggaacagataatcgtcagttgagaaagaatcttgggcaaggcgcatcagccctgtttcaaattcgtcaatgtccagccttgtattcagctgttccgttgttaagccgcgcgctttgcctgccttaaacggcagcaccattttgtaataggagtcagagatattatatttcgggacaatcgctttttctgacgatttcgccgtcttttgcgtaatctcttcctccttctcccccccgaaacctgacgagcaggcagacagcattaatactgccgccgttgccgccaatgccaacgtctttttcaatagaaaacactcctcttatttctttagctctcccattaactgttcttcattccacacttcaatgttcagctcttgtgcttttgtcagcttgcttcccgccgcttctccggcgatgactaagtctgtgtttttgctgacgcttccagtcagctttccgcccagcgcttcgatttgcgctttggcttcgtttcttgacagctcttccagctttcctgtcagaacaattgttttaccagcaaagtaagagtcgctgtcctctgcttttacttttttcgggcctttgtagagcgtgtttacgcccagctcctgaagttcattcaagagttcaagcatttcttctttatgaaaataggtgatcacagcatcagccattttttcaccgatttcatctaccgcgagaagttcctctttagaggcttttttcaggttctccaagctttcaaaatgcatggcaagcgtctttgcggcctttgatccgataaaacggatgccaagcccaaacagcaggcgctctaacgaattttcttttgatttttggatggagctgatcaggttttcagtggacttttcgcccatgcgctcgagctggatgactcgttccttcgtcagcttatataaatctgccacattgcggacaaggttttcctcaaacagctgtgtgatcactcgttcgccgagcccatcaatgttcatggcattccgggaaacgaaatggataagcccttcccggatttgcgccggacattcagggttaatgcagcgaagcgccacttctccttcgatccggacgagttcactgccgcattcaggacattccgtcggcatgctgaattccttttcttctcctgtgcgctggtcaacgaggacattcacaacttccgggatgatatcgcccgcttttttgacgacaaccttatccaaaatccgaatgtccttctctttaattaaatcttcgttatgaagggatgctcttgagaccgttgtgccggcaacttttaccggctcaagaatcgcagtcggcgtaatcacacccgttctgccgacatttaattcgatatcgagaagcttcgtcacgacctcttcagcaggaaacttatacgcgatggcccagcgcgggcttttcgccgtaaaaccgagctcctcctgttgatcgagagaatcgactttaatgacaatgccgtctatttcgtacggcaggtccgcgcgcttcgcctgaagctcatcgatcagcgtaatgacttcttctatgctgccgcatttttttcgttcctgattcgttttaaatccgagttcgtcgagaaaatcaagcccttggctttgcgtctctacacccatctcgtcaagctccgctatactgtagacgaagatatcgaggtttcgtttcgctgcaattttcggatcgagctgtctgagagatcccgccgcggcatttcgcggattggcgaacggttcttcctcatttttaatccgttcctcattgagtgcttcaaacgaacgcttcggcatatacgcctcgccgcgcacttcgatcgacagctcacggttcattttaagggggatattgcggatcgtcttcagattctccgtgatatcctctcccgtcgtcccgtcacctcttgtggcccctctgacaaaatagccgtcttcataacggagagaaacagcaagaccgtctattttcagctccacattatacgccacatcgtcgccgacggactggcgcacacggcggtcgaaatcacgaagatcatcagcattaaaggcgttgcccagactgagcatcggtgtgccgtgggtgactttctgaaacgcttcaagcacggctccgccgacgcgctgcgtaggagagtcaggcgttctgaggtctgggtgctcctcctcgatcgcgatcagctcctgcatcaatctgtcgtattcggcatctgggacgctcggttcatctaaggtgtaatattcatagctatacttgttgatggtgcggcgcagttcttctgcccgctgcttcgctgtttctttgtccatctgcttcttcctttcctcttcaattactgcttttcaataggagcaaatgctgctaacaggcgtttcacgccgacagggctcgggaaggcaatatcaagctctgtcccttctccttcgcctttcacgctgacgacagttcctgttccccattttttatggcccgccttatctccgactgcccagttcaaggtgtcgccgcctgttttgctggcgtaggataccgggcgtgaaacagggccgcgtctcggctgcatttttctcgcagacgtcgctcttgtttcttttttctcatttaggttttccaataaatcatccggtatttcagcaatgaagcgagattccgggttcatatttgtccggccaaacaaggtgcgcattttagcattggtcagataaagctcctgttccgcccttgtaatcccaacgtacgcaaggcggcgttcttcttccatttccgcttcctccatgagtgaacggctatgcgggaagacgccttcttcaagccccatcaagaaaacaaccggaaactccagtcctttcgcggcgtgcagtgtcatcagggtgatcgcatccttgccgcctgactcttcctccttctgatcgagctgatcaatatctgcgatcaatgccaagtctgtcaggaacgcaacgagtgtcttgtcttcacttttctgttcaaagtttttcgtaacagacaggaactcgtcgatattttctaaacggctttgggcttcgatcgatttctcagccttcagcatttctctgtattccgtcttatcaagaatttcttctgtcagctctgtaatggataagtaatcctgcatattggtcaggttttcaatcatctgtctaaagctgtcaagcgcgtttgccgctttggcactgacgccgataaaatcaacctgctgaatcgcttggaaaaaggacaagccgtttatggccgcatacgaagcgattttttcaagtgatgtcgcgccgactccgcgcttcggcacattgacaatgcgcgtgaaactgatatcgtcatccggattggatacgaggcgcaggtacgcaagaatgtctttaatttcttttctgtcatagaactttgtgccgccgacaatgttatagttcaagcccgctttgagaagcgtttcctcaatcacacgggactgcgcgtttgtccggtataatatggcgatatccgacagcttccgcttgcctgtgctgtgaagctgatgaattttgccggccacaaactgtccttcaccgaactcattatcaccgcgataataggaaatcttgatgccttcatcattttccgtccacaaatttttcggtttgcggttagagttgtttttaatgacctcgttagccgcgcgcaaaatccgtttcgttgaacgatagttttgttctagcaaaatcacgcttgcattcggataatctttttcaaatgaaagaatgttggtgatatccgcgccgcgccatctgtagattgactgatcagaatcccccacaacgcaaaggttctggaaacgctcggcaagctgcttaacgagcatgtattgtgccctgttcgtatcctgatactcatcaacgtggatgtactggaatttgcgctgataaaattcaagcacttcaggcactctgtcaaacagtttaatcgtcgtcataattaaatcgtcgaaatcgagcgactggtttttcaatagcttcttctgataatcagcatatacatcgctgaccacctgatcgtagtagccgccagcaactttagagaattcctccggttcggtcaattcgttttttgcactgctgatcgtgccgaggatgcttctcgggtcaaacttcttcggatcaagattgcgctccttcaaaatccccttgatcactgaaagctggtcagccgtatcaaggatggagaaatttcggttgatcccaatccggtcgatatctctgcgcaagatccgcacgcacatgctgtggaatgtggagatccagatatcgtccgcgccgggtccgaggatgctttccacacgttctttcatttcgcgtgccgctttatttgtaaatgtgatcgccagaatgttccacggcgccacatgcttttctgccattaaataagcaattctatgggtcaggacacgcgtctttccgctacccgctcccgccatcagcaaaagaggcccgtccgttgttttgactgcttcctgctgaacggggtttaaaccgcttagtaattgattgctaatataattcaaaatttgttcacccgcctatacaaaacatacgttctatcataaaccaaatccgtacaatttactactcgcctttcacagccgctactgttttcaaagccctgtcaaaatcttcatacaccgcattgcctacaacgatcacgtccgcatgctctgcgtactgcttggccgtttccgcatccttgatgccgccgccgtaaaacaaggtggacgtttccaatacagccttcgttttcttgacagcttctatgtctccaagcacgccgctgtattctaaataaaaaatcggcagttgcagcagctccgacacacgcgcataggcgacaatatcatccatattcagatcggcgtccgcttcagtcagtgccgcggctttgcaatctggatttgcgatgcagtagccctccgccacgatttcttccatagacatcagttctccgtattccttcatggctttctggtgcattccgacaatccaatccgcgtttttgctgtttaatacactcggaataaaatataagtcaaagccgggaacaatcgcttcaatcgctgatacctctaggacacacggcaccaaaaaccgtcttaccttagacatcatccgcaggacattatcctctgtcacaccatcgcttcctccgataatgaccgcatccgttcctgattcgcaaagaatctccagctgttcgtcaggcaaatctttatttggatcgagtttaaagacatgcttccactccgttacatcgtacacgtcatacgttcctccattcgtttgttaccatttaaacattataacaaattcacatagcgcggaaaaacggaaaaagccgttaatctcgttattcactgaaaaaggtgttttgattcttttttcataaaaaaagagagcatatggcagtacctgcatggtgagtcctgtatcggcaggagcacacatttttcaccagattccttctgctattgtttggaaagtgttctactgtggaaatggttacataaaaagggaggctgagagatggaaaccatcataatagcactcatcgcatttatcattgggatcatcgctatcccgatcgtcttgtttgcctggatctacataaaggatgaaaaacagcaggagcactcaattcttcgcaactatcccgtcatcggaaggtttcggtatatccttgaaaaaatcgggccggagctcagacagtatttatacagcaatgacaatgaagagcagccattttcacgaaaggaatatgagcaaaccgtcatctccggcaaatacaaaagcagaatgatgggctttggatctgtaagagattttgataaacctggctattatatccgtaacgctatgtttccaaaacaaagggaagaaatgcatgtaaatcaaacgccaaaaattgaaacccaaatctataaaatggatgctgacaatctgttcaaacgcaaggagcatgccgaacatatcaaggcagacccgtattttctccatcctgatgatgtacaggtgattggcgagcatacatgcgagaagccattttatgtgaagggcttagtcggccagtctgccatgagctacggttctcttggagaacgggctgttacggcgctctcaaaagggctccatctggcaggcggcacctggatgaatacaggtgaagggggattgtctgaatatcacttaaagggcggcgccgatatcatttgccaaatcggaccgggcctattcggcgtgcgcaaaagaaacggggaattttcgtgggaggaatttaaaagaaaaagcaggattgaccagattaaagcgtttgagctaaagctggcacaaggagcgaaaacccgcggcggccatgtggacggcgccaaagtatcagaggaagtggcagacattcggaatgtcgaacctggaaagtcgattgacagcccgaaccgcttttatgaattctcaaaccctcctgaaatgctcgactttattgaaaaacttagagatgtcggacaaaagccagtcggcatcaaactggtcgcagggcatcctgaagaattgcatgagcttttctctcatatgcagaaaagcggaaagcatccggattttatcacgatcgacggaagtgaaggcggtaccggagcttccttttacgagctcgcggatacagtcggccttccgattatgacagcgctgcctattgtggacacgcttcttaaacagtacggcttgcgcagccagctgaaaatctttgcttccggaaagctcctgactcctgataaaatcgcggtcgccttagccctcggcgctgactttgttaacatcgcacgcggcatgatgttttccgttggctgcatccgcgctctcgtctgccacaccaacacctgtccggcaggtgtggcgacgacagatccgaaattgcaaaaagcactgagcgttgaggaaaaacagcatcgtgtctgcaactacgttatttcattgcgcgagggactatttaaccttgcagccgcagcagggattaattcgccgattcatttttccaaggagcatgttgtctatcggaaagaggatggcagtatcatcaatatcgacaacctgatccatcaatttgtttcataaagaaaccgcccttgccagacggcagggcggttttttatttggaagaagactctgtttccgtctccttcacacggtcaagcgccatttcataagcgtcatttccgtaatttaagcagcgtttcacacgggaaatcgtagccgtggaagcgcctgtttctgtttcaatcttatgatacgtgtttccttcgcgaagcatgcgcgccacttcaaggcgctgagccagcgattgaatttcgttaattgtgcatagatcatcgaagaatcggtaacattcctccaggtctttcagcgataagatcgagttaaataactggtccagctctttgccgcgtaatttatcgatttgcatcgttacacaccttctcctttactaatggaagccgcatcaagatcaggtacgatattgatccaagtctttcctggcacaaacggaagccacttgccgtcttttaccggcacaattctgccattcacttgtttccagtctgtttcaatgacgtttccgtgctgaaacaacagaccttttcctcctgattccaagtcgatgtcccgccttccatcttgatcaataatatgatggctggcttcaacaatgaaaatattttgcattgcaaccggctttccggtttcccggtctgtcgttatgacaccatcagagcttcttgtataaaattcagcttttttatcatagttgtattcgacaagatttgtaacgttatttgttccataatctacccgaacattgtaagattcatttgcaggttttgcatctgatgtttgaaacagcagcggatttgtttcctgcttcagcttataacccttttgttctgccgccttttttatgtaatcataagacgtataggaattgtggggcggtttgctgaaatcagctctccaaaataagcttccgtcaaaatccaatccgttcatataatcggcagctccggattccagctgctttttggcgccgggactccagccgtgatggacaaatatgctgtcaaagccattgctgagagtgacgaaatattcccgcgcgctccgcacaggtccgacagtttcaggcatctggctttggaaaatggccagaaatcttgtgatttgcccttcggctagcgcttctatgacaatgtcggctttagacagacccgactgcggcctcgccttcgggtgattgttcaccacaacagcaacagggcggcgttcagtcactttctgttcagtctttagccccgttaaaggagctttcagcttctttgcagtatccgggacagcatccttctgctggcaggataccagcagaaaaaacacgaaacacagcgcgcaaactgtcatccattttttcatatgtcggctccctgctcttttatattttaacgcattatcgatggaaagagtacagtttttttcatgacgtcgaatattcctcttggcgtaatgcgtatatacggaaggtgcgtactttgcaaaaagagcagcgtatagataggatcgcaaaactcatagcctctttcagtcaaaagatctctcagcttttgttccttctcaagcacgtcttcatacgcttccgaagaggcgcagccgcacagcgcaagcgggatttcatgcagaatgtttccgttctccgctaaaacaattcctcctccgatttctttcatgcgggcgaaagcgagcagcatatccgctttattttttccaatcgcgacaatgtcgcccgtcgtcgtaaaggagcttacaaatccctgcacgcttgaggcaaacccttttatcatcgtattgacgcgccatttcccgtgtctgtcgagcatcgtcaaataactttcatcatggtcaaacgagagctgttccatcgaattgtcgatctcaatcatatatggctccataataaccgcattccgcattttcacgcccatcggcatagaaaactgcaagtcatccatcgtcatatcatatgaaagctcaagcgggacaagaccgcctttgtgccagtccgtctttgtaaacgccttcaaatcacagccgttttcacgcagaatggtcccttttgacagaacagtcactggattcggatttaacggatcttccagtatgtttagcgatgccagtctgcccggtccgacaactcctaaataatcatccatttggtaatactttgcgatattaaatgatgccatattgtaggcgtcgattgcaggtacgccttcttctaacgcaatgcgaatcagctcgtttgtcatgccgcctttatagaaattcggggttgcgccatctgtcgtgtaaaagaagtggtcataatagcggaagcccttctcatgcagctcttgcaagatttttcttacatcggggcgaatggaagagttccgaagggaaacataatagcccagttccagccttctcatcacttcatcacctgtcatcgcttcatgatcacaatccgcaccgaacagcttcatttttgtaagcgttttatcagaagcgccgggaaaatgcccttcaatacgttttctctgtttctttgtagcttgcatacagtggagcattaaatcatcaccatctaccaggcgaggccatccggtcatttctccgccttgaatcacatccggatgttcaatccactgttttctgacgtcaaatggaaggacgtggtcctcgttcagaacctcggtctggaggtcatagcgtgaccaccaaaaatactggacaggctgctttttgagttcattcaaaatcgtaagcgctttcttttttccgctttgcaaaagcaaaaataagttatcattcacgaatgtcgttgttccgtattgagacacatattccgccagtgtttggggattatatatttgaaaaggatgtgcgtgcggttcaatataacctggcacaatgtattttccttcacaatcaatcgtatgaatttcttcggctctattcggaagttcatgacccacataaacaatgcggtcctgataaatccaaatgttttttttcagccattgttttacatatggatttaagacgagagcattccgtaaaaggagcgttggaagcagctttgagtctacaacatcaacctgtgccctgatgtctttgtttttccagttaaaggtgcgttcggacattcacatactctcctttacatgtattagactcatggtatcacatccttcctcatcacgcacgataaaaacgttacaaatttttgaaggttcgattaaaaaacttttttaagtaaaaggagcggatttccttgaagccaaacatcagtctcatcaatgccgtgttcagaatcgcctgcggattgacgattatgtcagccgccagtgcaaagtttacgaaaaaaccttggtgcagaatgcatctcttttacatctttatgggggccatgaaagcgggttcgggaatcttgcgcttctgtcctgtgacctacatgtttcaacacagcgattctggaaataacgagcatcaaaacggataaatggaaaagcttgatcacaaaacgtgatcaagcttttttttatgcccaccctttgttttcatatagaaatatcctgcagctgccagcactgccggataaagcagtgcccagccgctgaatgaataaatcaccgcgcacgccacaaatgccccgagcgccatccaccagcctatatctctcctgcccagcagtttcagtgctgccgccattgtacatatgtaagatgcgataaaagccgcgctcggccctttcaacagagtcgtcaaatcgatttgaaacagaccatgcgctgcaagcactaagccaaacactgcggccatcgctgtcaaaacgcgaataggcgtacgttttgtcgcactgagttttccaaaaaatacgggtatgtgcccctctctcgccaatgcgtacaccattcttgaaaaaccggcaatattggcatggatggtggcgaatgtaataaacagcgctaaacataccgtgacatatacaccgctttctcctgctccttttgaaatgagcatggcaagcgatgcaatttctccattctctccatatgaatgagtacccacggtcacaaatgacagcatgatatacagccccgccacacaagacgctgccaaaaacaagctgagcgggacatctttttcaggacgatgaaattcctcagccaacggggtaatcatttcccagcctacaaaagagaaaaaaatcataacagaaacagatccagcggcagaccagccatgcggaagaaacggcttgaattctgctatcgtgacgtgtggcaatgacacagcaatagaagtgacaagcagaaatacgatgacacatataacgagtgtactaatgtttgctgatagttgaatccctctcatatgaagcaaaatagatatagccagcatgcaaccagcaatcaatgtaatctgccaatcggccgcctctgtgatgtaactgacgtaatgcgcgccagtcaaagcgatgatgggaacgccgatcggaacggaccctaacatgatccagcccaaaatagccccggcgttttttctgaaaggccagctgcacataagccgtgattcctcccgcgctaggcgctattttcacaagccgggccagcgtgccgacaagaaaaaaggataagaaggacatgaacacccaaacaaataaagaagcggggccggccgtgtccgcggtgacagacggcaggattaatatcccgcatcctaaaaccgccccaatcgttaacgccgtcccttgtatccaagtaatagagcgctgcaattctggcaacatgatgccccctctctgattgatggctttattatagaaaaaataagacggcatccatatgctacaatgaagttaaatcaacagcattaccttacgatcaaaggaattttcattcattcgcctaaatatgtaaaggagccagacaaatggacgatacagaccttcagattctctcgcatttgcagcgaaacggcagattaacgatggttgagctgggaaagcttgtcggactcagctcgccaagcgcggcggagcgtgtcaggaagctggaagacaaaggagtgattaccggctacagcgcgaatatctgttacgaaaaactaaacaagcatgtcaccgcttttattctcatggagccgaaaagctgcaagcactacgccgcctttgcaacatcgcatcctgatgtagcagaaaaccaccgcatcacggggatgtacagctatgtgacaaaggtcgtgactgaatcggtacatacgcttgaggattttattgacacctcgatggcccatggaaaaccaaccacgctcgttgtgctttcttcttctagctgccatcccgctttttgataacaaaaaacccgcagctattctgcgggttttcctcacttatttttgggcagcctttaaagcgcgtgccccaatgtcttttctgaaaaagagtcccggtttgaaaatttcatcaaccgctttgtacactcggtctctagccgcttcaaacgtttcatcaaaagccgtcacattggcgacgcgccccccgtttgtaacgaactctccaccttctgctttcgttccggcatggaagaccacgacctgctcagtttctgctgcaaggctgccgatcggcgtgccttttgcatagctttccggatacccttctgatgcaagcacaacactcactgccgcggtatccttccatcttaagtcaacttccttatcatctaaaagatcaagaagcacctgtaccagatcagattccatgcgcggaagcacgacctgtgtttccggatcgccgaaacgggcattaaattcaatgaccttcgagccgttttcagtaagcatcaatccagcgtacaaaacgccagtgaaggaacggccttcttgtaccattgcttttgcagccggcttaacgatcgtttctacagcatggcggaccgtttcttccgaaatttgcggaactggcgagtaggcgcccatgccgcctgtattcgggcctttgtctccgtcaaacgcccgcttgtgatcctgggcaatcaccatcggatacaccttttcccctttgacaaaggccattagagaaaattcttcaccagaaagatattcttcaatgacaacggacgcgctcgcatcaccgaacttttcatcttcaagaaagtcatgcaagcacgcaattgcttcttcctctgtcatagccacagtaacgccttttccagctgcaagtccatctgcttttatcacaatcggagcacctttttcctgcacatatgccttcgcctcatcaaaggatgtaaacgtctcgtattctgcggtcggaatgtcgtatttcttcattaaatccttagcgaactgtttgcttccttcgatgatcgccgcagcttttgacggaccgaacacatgtaagcccgctttttcgaattcatccaccagaccttcaattaaaggaacctcagggccgacaatggtcaggccgacctgattttgttttgcaaatgagacaagccctgcgtggtcgctttcctcaatgtttacaagctgagcggaagctgccatgccgtcatttccgggagcggcaaatacattctcgacgaggctgctttgcgctgccttccacgccagcgtatgttctcttccgcctttaccgataattaatacattcacgtcgttttcatccccttaatgtttgaagtgtctgatgccggtgaataccatggcaatgccgtattcatccgcttttttgatggaatcctcatctcggatcgatccgcctggctgaatgatggctgtaacgcccgcttttgccgcttcttcgacagtatctggcattgggaaatatgcatccgaaccgagcgcgctgcccttcgctttttcccctgcttgctcgattgcgatttttgccgatccgacgcggttcatttggcctgctcccacgccgactgtcatgttgtccttcgcgagaacaatcgcatttgatttcacatgcttcacgactttccaagcaagcttcaagtcttcccactcttgctcgttcggctctctttttgtcggaatgctaatctcagcatcatcgaagccgtgcatatctaaatcttgaatcagcagcccgccttgaacagatgtcagttgtttttccttttgaacagcggcggatacgtcaagcgtcagcagacggagatttttcttcgcagtcaggacgtcgagcgcttcttggctgaatgaaggcgcaatgatgatttctaagaaaatgttgtgaagcgcttcggcagttgccttgtccacttcacggttcagcgcgataatgccgccgaagatagatgttttatccgcttcaaacgctctgtcaaacgcttctgcgatcgtttttcctgttcctacaccgcacgggttcatgtgcttcacagcaacagcagccggttcagtgaattcacgaacgatttgaactgccgcatccgtgtctttaatgttgttgtaagaaagctcttttccgtgaagctgttctgcttgcgcaatggagcctttgacaggaagagctgtttgatagaaagttgcttcctgatgcgggttttctccatagcgaagcgattgttttttctcaaatgtcacagtgaattgctctggttctttttcaccgacaacatttgtcagatagtcagcgatcagtgcatcatatgccgcagtatgacggaatacttttgccgcgagctcgcgttttttctgaagagatacgctgccttcttctttgatttgatttagcactgggctgtaatcggccggatcgacgataaccgtgacatcctgatggttctttgatgccgcacgcagcatgccaggtccgccgatgtcgatattttcgatcgcttcttcatatgtgacgtcttccttagaaatcgtttctttaaatggatagaggttgacgacaacgaggtcaatcggctgaatcccgtgttcattgatctgcgccatatgctcttcattgccgcgaaccgccagaaggccgccgtgaatattcgggtgaagggtttttaaccggccgtccataatttcagggaagcctgtcacttcagaaattccgatcacatccacaccgttttcttgaagaagctttttcgttccgcctgtggagatgacttcaatgccaagctctgtcagttcttttacgaaaggaacgagatttgttttatctgaaacactgattaacgcacgtttaatggtcatgccttttcacctctgttatttaatcctaatagctgtttaatcacactcggataccatttatgctcaagcttgtgaatccgctgttcgattgtttccaatgtatcatgttcatcaatttcgattgccttttgagcgatgatcggacctgtatccattccttcatcgacataatgcacggtgattccggccaccttcacacccgcccggaacgcctgtccgactgcgtcgatcccaggaaacgccggaagaagcgacgggtgaatgttaatgatttttcctccatatgcttgaaggagcgtatcaccaattagcctcatatagccggcaagaacaatcaattcaacctcgtgaagacgaagctgttcaatgatggcttgttcaaatgcggccttgttttcataagacttcggctcaaatgcaaaggatggaatgtggaatgcttccgcccgttcgatgactttcgcctgcggtttgtcgcaaacgaggagcgctgctgacgcatcccagttctcctccttcaaacgcgtaacgatggcttcgaagtttgaaccgtttcctgatgcaaataccgcaaactttttcatgaaagtgccgcaccgccgaatgtgacgccttcaccttttttcacacgcccgattaaataggctttttcgccatggctttcaagcgttctgatcacatctgtcagatgctcttctttgacagccaaaacaaaaccgatccccatattaaagacgttgaacatgtcttcttccttcagcttgccgtactcttgcaggaaagagaaaatcggcgggatcggccatgagccatgatcaatttccgcacttaagccttccggaagcatacgcggaatattttcaataaatcctccgcctgtcacgtgcgccatgccgtcgatttttccgcttttgaccgcggcaagcacaggcttcacgtaaatccttgtcggttcaagcaattcctcgccaagcgggcgttcaaacggctcatatgttgtatcgaggtccagctccgcatcatccagaagcacttttctgacaagggaaaagccgttgctgtgaaggccgctggagctgaggccgatcaacagatggccctcttcgatattttctccagtcacgatttcgtccttttctgccactccgactgagaaaccggcaatatcgtattcatcagctgtatagagtcccggcatttcagccgtttcaccgccgactaaggctgaacctgactgctcacagccttccgcaacaccttgtacaatctgttcaattttcactgggtccgctttgccaaccgctaaataatcgaggaaaaacagcggctctgcaccttgtgccagcacgtcattgacacacattgcaacagcatccacgccaatcgtgtcatgcttatccatggaaaaagcgagctttaattttgtgccgacaccgtccgttcccgaaatgagaactggtttttgataagaaagctcagacaggtcaaacatgccgccaaaaccgccaaggctgcccataacgccaagccgtttcgtgcgctccacgtgttttttcattcgtttgacagcttcatatccggcttcgatgtcaactcctgcgtttttatatgcttcagacatcctattcactcctttaaggcgcttttcaaaatatctccccgaacgagggcagaaagagaaaggcagccgaactgcgctgcctttatgtcatttttcaagttttatttggttaatactgcttcttttacgtgaggaagcactgtatcctggtaaatttcagtcggatattttcctgtaaagcaagcgagacactgtccgcaattcgagtcatcgtattttctgccgatgcctttcagcagcccttccacactcaaaaatgagagggtatcggctccgatttcctgacggatttcttcaacagaatgcgaagacgcgatcagttcttcatgtgtggaagtatcaatgccataaaagcacggatgagcgatcggcggtgaactgattttcacatgcacctctgtcgcacccgcttctctaagcatcgtgacaatccggcggctagttgttccgcgtacgatagagtcatccaccatcacgacgcgtttgccttctacaaccccgcgcaccgcagacagcttcattctgacgccttgctcacgcagagcctgggacggctgaataaacgttctgccaacataacggtttttgattaagccaagctcatacggaatgcctgttgcctctgcatagccgatcgccgctgaaatactggaatccggaaccccggttacgacgtcagcttcaactgcggattcctgagccagcattttcccaaggttttttacgggcactgtgcacattaataccgtcaatattgctgtctggtctggagaaataaatgtactccatgctgcaaatggaacgattgatattcatggaaaaacgctctgatttcatgccttcatcattaatgatcagcatttcccccggctctacctcgcgaaggtacgttgcgccgacgacgtcaaatgcgcatgtttctgatgcgaccacataagcatcgcccatcatgccgatggatagcggtctcagcccgttcggatcaagtgcgacaatcatttctgtttcggtcatgatcaggaacgcgtaggcgcctttcagcatagaaagcgagtttttaatttgatccttcagcgtgaagtgtccgcttcttttgatcaggtgagccaaaacctctgtatccgaagaggtttgaaagatgctcccttgattttcaagctgctgcttcagctgagtggcattgacaagatttccgttatgagcaagcgccaggctgccgttgttttgggaacggaagaggagcggctgaacattttcgtatccgccgcctccagccgttgcgtaccgaacgtgcccgatagcgccttttccctttactttgctgagttcgccgttttgaaatacttcagtgatcagcccttggcctttgtgagccgtcagcttttcaccgtcagtcgctacgatgccagcaccctcctgtcctcggtgctgaaggctgtggagaccgtaatacgtgatctgcggggcttcttcatgtccccaaatcccaaaaacgccgcattcttcatttaagcctttgatttcagcaagcatgggatagctcctttccatacgcgttcaagctctttcgtttgcgcatgaatcatttgttgtccgtcttggttttgaatcgccagaattccgtcagctgttacctcaccaatatgaaccgcatctttgacagttgcttcaaacgcagcttgatgttcttttttcactgaaacgacgaagcgggattgagattcagagaataataacgccgcttccccttctacagtcacattagcgccaaggttttccgtcgtcatgacactttccgcaatcgctacgcctaagccgccttcagacacatcatgcgcagattgaacgaagccttttttaatcgcgtcaagcagtgctttttgacgagacagctcgacatcaagatcgatttgcggcgctttgccgtaaatacggccttctgtcattttttgcagctcgcttccggcaaactctggttttgtttcgccgatcacgtatacgagatctcctgcttgtttgaaatgctgtgttgtaatgtgcgctgtatcttcaattaggccgaccatgccgataactggtgtcggatagatcgccgtgccgtttgattcgttataaagcgatacgttaccgccgataaccggagtgctgagaacattgcacgcttcgcttatgccgtctgccgctttttcgatctgccagaagatttccggcttctcagggtttccgaagttaaggttatctgtcaccgcaagcggttctgcgcctgagcaaatgatgttgcgcgctgcttcagcgacagcaattttccctccgacttcaggatcaagatagagataacgcgcgttacagtctgtcgtcatcgccagcgcctttttcgttccgcggattctgagaacaccagcatcagacccaggagcgacaactgtattcgtgcgcaccatgtagtcatactgatcataaacccactctttactcgcaatcgtcggctgctgaagaagggccttcagcatttcattcgcatcttcaatttgcggagccggaacgtctgtttccaaaaactcgcgatagtaagcaggctcttgagaaggcttatggtaaaccggtgcttcttctgccaaggcatcaacaggcagctcgcacacaacctctcctttatgtgtcaggcgaagcattttatcatctgtcacatgtccgacagaaaccgcttcaagatcatacttgtcaaaaatatcgatgatttcctgctcacgtccgcgctcaataaccaaaagcatccgttcttgtgattcagaaagcatcatttcatacgcggtcatgcctgtttcgcgctgaggaatcaggtcaagattcatttcaatgccagaaccggctttacttgccatttctgcacttgagcttgttaaaccggcagctcccatatcctgaatgccgactaaggcgtcgcattggatgacttccagacatgcttcaagcaaaagcttctccataaacggatcgccgacttggacagcagaacgcttttcttcagacgagtctgacatttcttcagaagcaaacgtagcgccgtggatgccgtcacgccctgttttcgctcctacgtacattactgtgttgccgacaccctttgcctggccttttttgatgtcttcatggttgattaaaccgacgcacattgcgttgacgagcggatttccttcatagctgctgtcaaactgcacttctccgccgactgtcgggatgccgatacagttgccgtatccggcgatacccgctactacttcttcaaacaagtacttcacgcggggtgaagtcagttcaccaaatcgaagagagttcaatacagcgattgggcgtgcacccattgagaatacatcacggataattccgcctacgccagtcgcagcgccttggtaaggctcgagagctgatgggtggttatgtgattcaattttgaacacaaccgcttggttatcaccgatatcaacgattccggcgccttcccccggcccctgcagcacacgctcgccgcttgtcgggaatttacgcagaatcggctttgagtttttatagctgcaatgctcagaccacatgacagaaaaaattccgatttctgtgtagttcggcaatcttccaagaatggattctatcaatgcaaactcatcatcactgacacccatttgctgatacagtttctcttcttttatttgttctttacttggttcaagcagtagtgacatgagtttccctccaatttttcacgatagactggaacaatttaagaccgtcggcgcttccaagcagttcatcgaccgcgcgctcagggtgaggcatcatgcctaatacattgcctttctcattcacgacaccggcaatgtcgctgacacttccattaatattagagccgtatgtgaaagcaatttgattgttttcctttaatgtagcaagcgtctcgtcatcacagtagaaattcccttcaccatgggcaaccgggattgtaatcgattctcccttttcgtaggaagctgtgaataaggtttcgtcgttctgaacaatcaattcaaccggacggcaaatgaacttcagatctttgttgcgtctcattgcgcctggcagcagcccaagctcctgtaaaatctggaatccgttacagacgccaagaacaggttttccttcagccgctgcttgtttgacagctggcataatattcgcaaatcgggcgatggcgccgcatcttaagtaatcgccgtaagaaaatcctcccggaattaacacgccgtcgaagccgtcaaggcttgtttcctcatgccagacgtattccacttcatggccgagctcatcctttacagcatgatacatatcgatatcacagttggagccgggtaacacaatcaccgcaaatttcactgtgcgactacctcctcaacctcatatctataatcttcaatcactgtgttcgcaagaagtttttcgcacatttctttcactagcacgtcaagatcacggtcagatttttcaatggtaagctccatgtatttcccgatgcgcacatcttgaacttcgttgtaagtcatactgtgcaaggcatgctggacagcgctcccttgtggatctagtacactttcttttaagctgacataaacttttactttatacatgatgaatgcctcccagtctattgaaaatctcttcgtatgcgtcggttaagcttcccagattgcgtctgaataaatctttgtccagcttttcgttcgtttctttatcccacaagcggcatgtgtcaggagatatttcatccgccaaaagcacttgcccttctgcatctaaaccgaattcaagcttgaaatctattaatctgacatgacaatcgtcgaagatgctttgaagctcttcatttactattgttgtaatggacttaatggtttctacctgctcaggagtcgccgccttcaaaagccaaatatgatcttctgtgatgagcggatcacccagcgcgtcatccttgtagtaaaactcgataatcggctgctcaagctccgtgccttctggaatgccgagacgtttggacatgcttcctgccacaacatttcttaccacgacttcaagcggcacaatcgttacctttttaatgagctgctccgtttccgaaatgcgctcgataaaatgattgttaatgcccttagcatgaaggtgtttgaaaatgaggcttgaaatttcattatttaagcgcccttttccgctgatttctgcttttttctcgccgttaaaggcagtggcggagtctttatacacgacatacagcgtgttttcgtcatcggttttgtagatcttttttgcttttccttcgtataaaagttcattcttcacaatattcacggaaggcctcctaacccgaatgttgggaattttcaaactgcggcggcttagaagaagccgctaaaagcttcttctatgctaaacctaaacgttcaaagatcagatcaacatttttcagatggtaattgtaatcaaagcagtcagcaattttttctggagaaagacgtgacgtgattttctcttccgcttccacaagctcgcggaacggcacttgtttttcccacgcttccattgctttcggctgaactgtatcataggcttcttcacgagtcaggcctgtgtcaatcaaagcaaggagcacacgctgagaatagataaggccgagagtgcggtccatgttgcgcttcatgttttccgggaagaccgttaagttcttcacgatgttggagaagcggttcagcatgtagttcagcgcaattgtcgcatccggaagaataattcgttctgctgaagaatgagaaatatcgcgctcatgccataatggaacattttcgtaagctgtcatcatgtagccgcggatcacgcgcgccatgcctgtcatgttttcagagccaatcggatttcgtttatgcggcattgcagatgaacccttttgccctttcgcgaaaaatccctctacttcacgtgtttcactcttttgcagtccgcggatttccacagcgaatttctcgatgcttgtcgcgatcaaagcaagtgttgccatatagtcagcatggcggtcacgctgaagggtttgagtggaaatcggtgctgctttcaatccgagcttctcacagacatattgttcaacaaatggatcaatgttcgcatatgtgccgacagcaccggaaatctttccaacctcgatgcctgctttcgcttgtttgaagcgctcaagattacgtttcatttcttcatgccaaagcgcaagttttaagccgaatgttgtaggctcagcgtgtacgccgtgtgtgcgccccatcatgactgtgtatttatgttctttcgctttttcttttataatgtcaacaaatctctcaagatccttgagcaaaatatcgtttgcctgttttaataagtaggaaagagccgtatcaacaacgtcagttgacgttaagccgtaatgcacccattttctttcttcgcccagtgattcggatacagcgcgcgtaaaagcgacaacgtcatggcgcgtgtccttttcgatttctaaaatgcggttgatgtcatatgacgcgttttcgcgcataacctttacatcttctttcggaatgacgccaagctccgcccacgcttcacaggcaagaatttcaacctctaaccatgcttgaaatctgttttcatccgtccaaatcgcggacatttcaggtcttgaataacgttcgatcattctgcttgtcctccgtctctattcatccatttatttgtgatctcctgaatccattcgtcttcaggctgcttcataaatgtaatatgccccattttgcggccttttttgatttcatgttttccgtatatatatagctttgcctcttttaaaagctccgggtcttcctcaacaagcttcacttcatcgccgagaagattcaccatcatgcccggcttcagcaaatctgtcttcccaagcggaagcccgcataccgctctgatatgctgctcaaactggctcgtctcgcaaaggtccagcgtataatgccctgaattgtgcggtcttggcgccagttcattgaccaaaagctctccgtcctctgtcaggaacatctcaacagcaagcggtccgacaaggttaagctcatctgcaagcttaactgcgagatcagcagccttctgctgaatccctttctctacccgtgcgggcacgatgctttggaaaagaatattgttgtggtgaatgttttcagctgtcggaaatgttgaaatttcaccgtttaccgatctaacgacgatcaccgacagttccattttaaaagaaacccagctttcaagaatgcaagttccgtgttctaacagagcggctgcctgctccatttgcgcctcttcttttatcacaaattggcctttgccgtcgtacccgccgcggcatgttttcagcactgccggaagcctgagctcctgtactgcctgtttcaattcattctttgttttgacgatgctgtacggtgcgacttcacagcccgcggattgaattgcttttttctctgtttcacggttttgggtaataagcagcagctcacttccttgcgggagatacgcatgatcttttagccaatgcagcgcatcatagtcgatgttttcaaactcatatgtgatgatatcgctgatttcagccaattttcgaatcgcttcacggtcattataatgagcggtaatttcgacatccgcaacctgcccgcacggcgaatctttcaccggatcaacgaccgcgactttataccccatttgtttggcggacacagccatcattttcccaagctggccgccgccgataatgccgattacagctcccggatagatgatttgtttagacaagctgatcactgctttctaacactgtctgttttgtattttctcttctctcatccagcttacgggcaaggtcttcgtcaaatgctgacaaaatttgcgccgctaacaggcctgcgttcacagcacccgctttgccgatggatgttgtcgcaacaggcacgcctccaggcatttggacgatggaaagaagtgaatccattccgttcagcgccttggactgaaccggaactccaatgactggcagtgttgttttcgcagccgtcatccctggcagatgcgccgctcctccggcaccggcaataatcaccttgatgcctctttctctagcagtttcagcatattcaaacatgaaatcaggcgtccggtgagcggaaacgacctttttttcgtacggaacattgagttcgtcaagtatgtcgcatgcgtgtttcattgtctcccaatcggaagtgcttcccatgatgattcctactagcggctgcattctgttccccaccttctaatgcttttgttttcagaaaataaaaaatacccgctctgcattgcacttatgaggaagcaatacaaaccgggcatggtacatgtatcgtcagtcgttcgcttctgcgatatatccatgtcagttttatcgatcactttcctgcatagtccggcaatttacggttgccgggtagaaacttatgggccatattcccaagattatatgaggtcgtgttttgatttcatgtttatcttaacaacggacatggataatgtcaacgatattatcgaacgatacaaaaattcattctactaatgttcgtgttttagatcaatttcccttcaaatacgatttttttcccgcacggaacgatctgaattgacccattttcctttttttccataaaaataggctcttccattcgccttacaggcagatatccttcttctttcatttgctgaagcaccgcatcaatcgtttgctgctctgtcacttcaaactttttcttcttcggctttgccattattctttaattctcctcttcttcaccgctttgacccagaagccgccgtggattgtttttggttcgtacgcaataataaaggcttttgaatcaagtgttttaatcgtatcatatagctggagttcatatcttctcggcgtcaggatctgaagggctgtgcggtcgccttcaagcccgcctgccacccagtttgtcacgccgtagcctttttcacggagctgcttcggaagatcaagatcgagctccttcgtaatcacattgaccataatatagccaagcgccaatttttcttctattttcatgccgacaattacgccaagaccgtaaccgagcgcgtacgcgatcacattttgaatctggtctaagttatcgagcaccagactcagtcctgtcacataaaccagtatttcaatcgtactgatgccggccgctaaataacgctgtcctttcagcgttaaaatcattcttatcgtaaaaaatgacacatagacaatattaataatgagaattatgagaaccatggctatcccatttgataagatggtttgcatcattttattcatccccctactcttcagcttgcacaaagcattcatattctactagagaaatgagccgtttacaatcagcttcgcccgtaagcttaagcaaaatatttcgacacgcttttatgtgttgaacagtagtagtttaccctctttctcgccttttcaaaatcaaaacaaaaaagcccgcttttcagcagactcacctctttatatctattgtcagatctcttttttcattttctgaagggacttgtattctttctcaagctcactcagcgtgtagtcagcaagctgttcccctcttccttgataaaattccgagagcagtaatttggtttttaaaaattgcttcttttggttaattgctcggcgaagtacatcagccatgtccatcatcctccttaaacataaaggtttttgcgctggacgttttcagcattttccccatcatacacgggttaatcctacaaatcaactatgttttttagatatatttgtaaaaagtgtgacataaaaaaaccggctaggattagccggttttttcattaaagcggaatcaacgacgccgtaatatattcagaaataaacggccaagtcactgccgtaaacagcagcgctatcgcaactactgcaaatacacaatagatataatcaattggtgcatcttgtgccgcctggtacacacgctgtacatacagcgcgatgataaaaaagatggaaaacaagatcagcaccgtaaacagtactgtcagcattgggatatttacgatcgcaaagatcagccaaaggattgaaacagcaattacgggtacaagcaatgaacccaatacggcagccgcttctctgaacgtcaccttctgcttcatcatatagcgggagacagcccatatagcaaagaccattaccgcgaaaaagatcagcaaatacacaagaacaactaaaaacccgtcatagaaagcatgatggcgttctccgaaaccgagcggccgattccagcttgcctttaactgaaaccaattcccaattgaaaaaatgatactgaatataagcattgaaatcagaccgtacttataatgagaaaaaccatccgttacgacagttttcgccggagattttaaaatcgagaacgcaaaaccgcaatatctgttgatggctgcccaaacagacgcaagcttgtctttaacagttgattcaccgcgttcctggcgcggtttctgcttttgtttttgcttctgcttgctttgccggctcgcctttctggacattctcgatagcggttcttcatctgcatctattctttcactctggttaatttcttcttcaaacgtttcttttctttcttccgtcatgtcagcaactcctatcaaaaaaatacggcggaataccattcagcaagaaaataaaacacttatataaggtaccgaagccttcctgaacagtcaagtcatttccatttaagtaaagcatggcggcacatctacatgacggtatatcgtatgaaatggttttatcttttgcaacaaaaaaaccagctgccagtgcagctggtttttcattccttattttaagaagataaagtacaggataaatacgacaaacagcccgtacatgattggatgaacctcttttgcttttcctttgcacaccattgtaatcggatagaaaataaatccgatggcaataccagtcgcgatgctgtacgttaacggcatcatgatcatggtaaggaaagcaggaacggccacttcgaacttatcccaagcgattttgccaagcggcgccaccatcaatgcaccaacaataataagcgccggcgctgttacatttgacgtaacgactgataggagcggcgagaaaaacgtagccagtaaaaagagaatccctgttacaattgcggcaaatcctgaccgggcacccgcagcgacacctgagcttgattccacgtaagaagttgttgtagacgtaccaagcacggcaccgatcacaatagaagatgaatcagctaaaagcgcacggcccgcacgcggcaatttgttttccttcattaaaccagcttgtgttgccacagcaacaagtgtaccagctgtatcaaaaaatccgacaaacaagaatgttaaaataacgatcagcatttgtacagagaaaatatccgggaggtgaatccacgcttgtccgaaagtcggcgcaaggcttggcacactgccgataatttgagtcggaaccggaaccaaaccgaaaatcatgccggctaccgctgttaatagcatcccgataaacacgcctgcgttcacgcgaagcaccattaaaataaccgtgacaatcacaccgaaaatcgttaacagcacaggaccgctgtgaatgtttccgatcgtgacgagcgtagaaggattcgctgtaatgattcctgaaccttgtaatccaacaaatgtaataaacaggccgatccccgcaccgactgccaatttcagctcaggcggaatggcgttgatgattttttcacgaaaacctgttaaagaaagagcaacgaaaataagacctgaaataaaaacaccggacaaagctgcctgccatgaaatacccataccaaggacaacagaaaacgcaaaaaacgcgttcagccccatacccggcgcaatggcaatcggatatctcgctattaatcccattaagatacagcctgctgcagacgccagcgctgtcgccgtaaagaccgcaccctggtcaattctcagcgcctccggaaaatctttcacgctctccaaagcaagcgtaatcggattgacgaacagaatatatgccatagataaaaaagtcgttaatccgccaatgatttcattgcgatagctggtgcccagctcatcaaactgaaaaaacgttttcaagctatttgactcccttcactctttgctatttattctgtcctgaaaacgccaaataaaaaacgtcccaatacattttgggacgcttgactacagacggatttcagttcgaataaataaacgtgttttatttatatcaaacgaaagaaatgtttacgtagtcaagccatttacggtagcttggtagagacttgcgagccatattcccgcgattatacgaattcatcttatttgatttctgtgtctattgtaccaagttcattttgaattgacaatataaacaacgaacattacttattaaaaaaattggtttattcgtctattgactaaattggtaacaatgataaaaaccgtatgtatggcaacatacggcttttcaacttatgattattttttttcggtaggctgactcacctgatgcactggtacagtaaacgagaatggctttagttgaatcaggtcatttaaaacgccgttatcaatatacagaccgtattcattaaactcaaaatgctttaaagacagcttatcattataatcatcatccagttcaaaagtagataccatttcggctgttttcatatttttcactttagcaatatttcctttcaaataataaccttcttcataatcacctactggatcaggccaagattgcattttttttatatcaccaaggccaatcgtttcacctatattcactaagtcatcttttgacatatttgaagtatcaactccagtgaaacggtaatgaaccaatacttccctcccctcttgtttaatgttattgatttctatccctatgttttgatgctttgtttccgaaagacgatacggcatctctgcatttagagggacgatttcactgccctcagcctcagatctaatatctgcaattaatgttagctttttcgcttttggattgattggtgattctaactgtgtttgtccttttgctctaaccgttctctcgtttacctttatgcgatctccaagttcgatgtttgatgctgacatctcgtatgtgtttcctaaatcatctttaacttcgttaatttcaaccgtatcatgctttgctatgccttgataatcgattgtaaattgaaggacagatccaagtttcccgttttccacttgaatattggaaaattgataacgattatgataagccgatataacttttgagctttctaaataacccgcattctttttggtaataggcagtttgaatctccaatttccctgtatttcattgatatgagtaattacaaagggcacggtttccccattttttatttcagtaccatttgtataaatccttaattgtcctgcgtattgcttgttatttaattttttaagcattaaggaatcgtagttgattgaaaagttgtcgctataactcgtttcgtcgacatcatacatgatctctttttcatcagagtggaagttatcaacagtgaagttataaacaagctgtccggcatcgtaataggagctgtttacagaaacagtgattcccctggagtctgctttttcatttaaagctgtgaccaaattgcttttaaacaatgatagaccaactttatcttgaaaatccttataaatttgtccgacaatgggtatgctccccatcgctttgtttacagaaggcagaaaaaggccggacgttaaatacagtatacctaccacagcagcaacagcaattccatttgtaaaggttcgtccccatttaaaacggcgcctcgtgttaccttcgttttcagcacgaacgacagcttgatgtactgtcttttttagcgctttcttaggcacttcaatatcatcaaatatctgctttacttggtgtttgtccatttgttttgatcctccttttccagctcctgtttcaatgcttttctcgctctatgtaaatgggttttaattgtgccttctgccattcctgtttgttcagctatcattgaaatcgaataatcttgaaaataatatagctgaattgttaactgaacatgttcatcaagtgtatccagcgcattgcgcaagtctatatattcttcaatattcctttggtccgtgccagtgtcatgatggctttcaaacggaactaattcccccttctttttcttcattgcaaaaattgaattaataagaattcgggtgagccacgttaaaaagtactttggctcttttagtttttctatacctataaaagctttataagccgtttcctgtacagcatcaagtgcatcttctttatttcttaaatagagataagctgttttatataaagtctcctgatgtgccagcataagcttttcaaaggcccgagcatttccttttctcgcctttgtaatcaatctttcttccttcaccttatccacctcctatgttgttagatacgaaaactgtcgaaacggtttcaaaaagttaacaaaaaaacgccccttttgaaaaagggacgtttttcctttgttattttcttattcccactcaatcgtcgcaggcggcttacttgtaatatcgtacaccacgcggttaatgtgcttcacttcgtttacgatacgtgtcgaaatgacttcaagcacatcccacgggatacgcgcccagtcagatgtcatgccgtcgattgatgtaacggcgcggattccgattgtgtaatcatatgttcttgcgtcacccataacaccaacgctgcggatgtcaggaagaacagtgaagtattgccagatatcacgctctaagccgtgatttgcaatttcttcacgcaagattgcatctgattcacgaacgatttcaagtttttcttctgttacttcgccaagaacgcggattccgagtcccggtcctgggaacggctgacgccatacgatttcatccggaatgccgagctctgtgccaagcgcgcgcacttcgtctttgaagagcgtatttaacggctcgatcagctcaaactgcatgtcttcaggaagtccgccgacattgtggtgagatttgatcgtttgcgccgttgctgtaccgctctcgatgatatctgtgtaaagcgtaccttgtgcaaggtagtcgatgcctttgagcttgtccgcttcatcatcaaacacgtaaatgaattcattaccgatgattttgcgtttttgctcaggatcagaaacgccttttagtttgtttaagaatcgatcttttgcgtctactttaatcacattcatgttaaagccttcgctgaatgttttcataacaccctcagcttcgcctttacggagaagaccatggtctacaaagatacaagtcagctggtcgccgatcgctttatgaatcaaaacagcaacaacagaggaatcaacgccgccgcttagcgcgcaaagaacctgtttgtctccgaccgtttcacggattttttgcatttcgatttcgataaagttctccattgaccattcgccttcgcattcgcaaacaccgaatacaaagtttttcagaagatcattgccgtattcagagtggcgcacttccgggtggaactgaacgccataccattttttgtccgctttgctcattgctgagttcgggcagtgatggcttgtcgcgtcaacagtgaagccttcaggaacttctacaaccaaatcgccgtggctcatccaaaccacttgttcattcggaagatctctgaacaaatcaggtgtgccttcgatgcggatgtttgcttttccgtattcacgctggcttgccgcttcaactttaccgccaaggtaatgagtcatcagctgcatgccgtagcaaattcccaaaacaggaatatcaagctcgaagattttctcgtcacagcggaaagagttttcatcatacacactgtttggaccgccggataaaataattccttttggattcatttttttaatttcttcagccgtcaatgtatgtggatgcagctcgctgtaaacaccgaattcacggatacggcgtgtaatcagctggttatactgactgccgaaatcaaggacaagaatcatttcattcactaactttgtcatggttgtcacctaatctcctctaagttttttgacacagaaaaaaacgaggacagatatgaagctcgctccgccctctttggcaaggccgtttgccggagtcaggccaactcgctcccagactccgataatattcactaattctaacaacacgtcgataagcggtcaagaccatcttcttttaattaaattttcccataactctctcgaatcattccatagcgccgaagaatcttcatttctgtaaagcgccctttcatagcttaatgtcagctttgacatgtcttctatgtcgtatttttcatcaattcgttttgcataatcacgcagcgtttcactgtctcgtttcggcagtccttttctcttcagttgtttcagcagcgcgccatatgcctcaaaaaacgcgtgctgatcactgcgccgcttcaatttcctcacggcgaaaacaggaatccataacgagcggaaaacatacagcaatacagctgccaccaggaggactgcaagaaccgcaagcgctgcatacaagcccgcaccggcattagtatgcgaagcggacggctttttagaaacagctggctcccgcttttccttttgtttttcctctttttgcggctgttttttctcttctttctgtttctcttttgctttcttcggcgagctgctgctatcgctgccagagtcttttgtgtcagaagatgtaaattgagccggatttgtaaaccctttagtcggctcaaatgtaacccagccctgttccgggaaatacacctctacccaggaatgggcattgttatttgtcacttcgtaaatgctgccatttttgttccctgcttctttgtattcgccggacgtataaccctttacccagcgggccggaatgccggccgagcgcaagagcaccaccatggcggaagaaaagttatcacaataacccattttcgtttcaaagagaaattgatcgacataatcttcatcattcttcggaatggtcacgttttctgtttcatatgtgaacgcatttgaccctaaatagtcctcaaccgctttcaccttatcaaacatattgtcgtgatcctgagtcagtttgatcgcaagggttctcacccgctctggcagtgaatctggaagctgcatgtagcgatcgctgaatgtgtactcctcactgttttttctcacttttacctttctcagttcatccagcttatagaccggggaattgtacgttactgtataattccccatatttctgatttcaccggcttgttcactgatcggagaaatttgctccgtgttgccgttcatttcaagtgagacagcctgctttggctgaatggtttccgcaccaatcggatacatcagatggttatacccgtagtgcttatcgacttttacacggacggtgcggcgctctgtcgcaaccttatggtcaaaccacagattttcaacttttccattgctaagctgatacgacatgcctgtgtctgtttcaatccagccttttccggtatacgtgtccttcgtttccacacggaaatacgtacgctcttttccctgccatgtaaaaacaggtgtagcatcctgctggaacgggccgccgagtgattcatcatgattcccgtatccgattttgctttcccctgcagacacgcggtcttgatgagtgatttttttaagaaaaggcaccggatcaggccaagccggctctgattttggagcggcgagtccgaatcccgttgcagccaaaaccaatacagataaaggaagaaaccatttcaggacagatgtttttggcagtgtgattctttccatcagcttaatgcgttccaagtataaaaggcccagcataaagaagccgatcagcacgatacggattacggcaaaagtggcatcatatggcgtaaaggtatcaagaatcgtaatatacgctactgtcatcaaaaagaaaaacaaaattcttctctggtaaatcacccaataatgcaggagatagaccagcagccacagcagcacaaaaaacagcagggtccgaaatgaaggaatcatgtcattccattgccctgattgaatcagcgtgatattcagatagacatcctgcaaaaaagagctgacccagctcaagtcgaatatagatccttgataaaacaggatgtgtatcgagatcaatgtaaatatgacacaaaaaggaacggtgacaaaccacctcatcctgaaaaaagtcagcagaaacgtcaagccgataaagacactaaaaaagcctgtatgtttcgtttcagtaaaactgtcaagcggcctaagccactcccacagcaataaaaaagccagaaaataaaataacagcaagctcaaacggcttcccttgtgatcatcgtgcggcatgtgaaccagtcacctctctttctaaacaacacgcgaaactcgcccgcccctcatgatccgaactctgatttggcgtttcatcatgcgttcaatcatgacattttcagcttgagagagctcagcatctttctcttttgccagtatcaccgtaacccggccgcctcctatttctgcgaggtgcagcatatcttccgttaactgtcccgtgacaacaacttgatcagcttggcgaacagatggctttcccagctcttcccgtgcatatcggcttatcgggtctgccgcatcacaatgagcgatggctaaatgccgaagcatgtgcttaaaatgctgatccccttcctgaatagggaaaatgtttttttccttcccgatggaagccagaccagcacccgcgccgttttttaaaacagaatgaagaatcgaagctgtcactgaaacgacctcttcgaatgcgtctgaggaaaaacggtccatcagcagaaacagatttttgctgcgagaaggctcaaattccttcgtcatcagctggctccgccgtgcagatgtcttccaatctaacgcagcaaaccggtctcccggctgataattccgcacacttgctgcgactgaggaatggtgctgatgaataggagaagaaccgcttacaccgtcttcctgatgcctctcattcacctgataggaaaaacgctgatagaatggataaacaaacaaggtatcatccagctcaaaaaatgctgttttttcaatcaagccaagaacatccccggttcgcaccctgacagaatgaaagtgatgctctccgcgcggtacccgagctaattcatacgacatcgtcatgctccgtttaaaccaaggaaaaacgagccgtttggccgcggctccgtctcgatttaatgactcgataccttctggcaggcaatcttcaatcaccatatacatcagcggaaatggcagctttcttctcagcgtaaccgttacgcccagcctgtcccccgcatgcaattgtgttttatccatttgccttgaagcctgaaaagaacggagcggatacaaggccaacagcccggcatacaagacaaaagggagaaacgcgtaaaacaaaaaccagctgacaaagccgccctgaaacatcgcataagaaaaaacagcagccgtcaataaagttaatataatcagcttccaaccatatacgagccattgccatttcttattcatcagcggaccgccgacctttgaaccggcaccttcacagctgacatgatctcccttacgatcgcttctgcctgaatcccttcaaattttgcctcaggatgaagcatcatccggtgcggcagcgtgaaaggagctaaatattgaatatcatccggtatgacatagtcgcgatgatgcagcagcgcgtatgcctgtgccgctttcatgagggcgattgagccgcgcggactgacgcctaattgaacagaaggatgctgtctcgttttctgcacaatttcaacgatatattccttaatgctgtcatcagcacggacattttgcacttccctctgtaaaaagatgaagtcttcttttgcaataaccggctcaagcgtctcaatcggatggcttttttcctgaagagataagacgtcaagctcttcattaaaggacggataacccatccgaagtttgaataaaaaacggtcaagctgagcttccggcaaaggataggtcccttcatattcgaccgggttttgcgttgccatcacaaaaaacggatcggcaagctgcatcgtatggccatctaccgtgacgctcccctcttccatcgcttcgagcaaagccgactgtgtcttcggagaggtacggttgatttcatctgccagcacgatatttcccataattgggccgggacgatattcaaattccatcgttttcgcattatagatagatacccctgttacatcagatggcagcaaatccggagtgaattggattcttttgaaatcggcgccgattgactttgccagcgcgcggaccatcatcgtttttccgactccgggtacatcctcaagcagcacatgccctttggcaagaagggctgctaagctgagtatggcgatgtctcgttttccaaccattactctattaatatgttcaactgctttccccagcaaaggatgcaggtcttcttgatatgccattattttcctcctagtcatctacaaaattcatcataatgtaacctaactttaccacaaaaagcaatctgtataaaaaaacgattctagcaaattgttaccaataaagctggccaaaacacacaaaaaagcttcctgtggcaggaagctccagattgttgacaaaatcctaaaatggctttcattttagggttttgtcatcttttcagcgtgattgaaaacccttgaagtctaggaaggacgagcataggagcggagcgaatgttctaattcgtgagcaccgaagcgcagacctgacaacgaatgcgagggtttgtcgacacgctgaagcttcctgtgacaggaagctccattatttttgttctaaaggctccatatgaacatgcgaataatcaatcgcatgctcctccttcattctccgctcaatttcattggctatatcgtggctttccgtaatatttaaatctgccgatacctcaaccaccacatcaacatgaaccgtactgcccaagtatcttgcttttatgtcttttaaacggctcacaccggagattttttcgattgtctgtttataagcggaaatgtcctttatgtcgaatccatctgtcaaagagtgagatgactctttaaagatatcccatgcggtcttgcaaataagcagaccgatcacaaacgcagtgaccgtatcaatccaagcaagatggaattgagcagccacaatgccgataaatgtgccgatactgacgaatgcgtctgatttattatcagcagccgcagcaaggagcgcctggctcttcacctttttggccagccttttattgtaccggtaaacgatcagcatcaggactgccccgcccgctgccgtccaagccgcaatcatatctggcgtctcttgtttagcagaaaaaatagattctccggcgctgaacagcacttgcagtccgacaaccatcataataaacgatgcgataagcgatgcaatcgtttccgctcgaaagtggccgtatggatgatcttcgtcaggaggcttttgagagatgcgcaggccaatcagcacagcaacagaagcaataatgtcagttgtgttatttaacccgtctgccgtaagtgcttccgagtgaaaaagataaccgatgatcagtttaattgcggaaagaactagatacgcggcaatgctgaccagcgctccggattctccctttttcagttcatcatatctctccatacaaaacctcctctcgctcacattttcctattattatcttacaaagctgatccgcagtgggtctacagaaacatgattcacccgccacagaaaaatagtgacgaaggaacactttttctctcatccaatttatttgctccgccaaaaatcccatcaaacccaaggacaccagtgcttctcgcattctatcgaattgtaaatattacgcaaaatcacacagcgaataaaaaacgaaacattttttccacacattcgctgaaagcgcaaacaaaacactacaaatttgaaataagctggtatattttcttacacgaattttcgacaaactgtatatttatgatagagtttcaattatcataatattcagtaatgattgcattttaaaaggaggtaacttatgaaccagtctcaatcaggattaaaaaaggaattaaagacccgccatatgacaatgatttcgattgccggtgtaatcggagccggcctatttgtaggcagcggttcagtgattcactcgaccggtccgggtgccgttgtttcttacgcgttagccggattattggtgatttttattatgagaatgctcggtgagatgtctgccgtaaacccgacgagcggatcgttttctcaatacgctcacgacgccatcggaccgtgggcaggatttacaatcggctggctgtactggtttttctgggtgatcgtcatagcgatcgaagccattgccggtgctggcattattcaatactggttccatgatattccgctgtggctgacaagtttgatcttgaccattgtgctcaccctgacaaacgtctactccgttaagtctttcggtgagtttgaatattggttctccctcattaaagttgtgactatcattgcttttctaatcgttggttttgcctttatttttggctttgcaccgggcagtgagccagtcggtttttcgaatcttacaggcaaaggcggatttttcccggagggcatcagctccgtattgctcggcattgtcgttgtcatcttctcttttatgggaactgaaatcgttgccattgcagcaggggaaacatccaacccgatcgaatctgtgacaaaagccaccagatccgttgtatggcgcatcatcgtcttttacgtgggctcaatcgccattgtcgtggcgctgttgccatggaattcagcaaatattttagaaagccctttcgtcgctgtacttgagcatataggagtgccggcagccgcacagattatgaactttatcgtcctcacagccgtactctcttgcctgaattcaggtttgtataccacatccagaatgctgtattcacttgcagaaagaaatgaagcgccgcgccgttttatgaaattgagcaaaaaaggcgttcccgtacaagccattgtggccgggacatttttctcttatatcgcggtcgtaatgaactatttttcaccggataccgtctttttattcttagtcaactcatcaggcgcaatcgctttactcgtctatcttgtcatcgccgtttcccagctgaaaatgcggaaaaaactcgaaaaaacaaacccagaagcattgaagatcaaaatgtggctcttccctttcctaacctacttgaccatcatcgccatttgcggaattttagtgtccatggcgtttattgattccatgagagacgagctgctgctgacaggcgtcatcacgggaatcgttttgatttcttaccttgtgttcagaaaacgcaaggtgagcgagaaagcggctgccaacccagtcacacagcagcagcccgatatcctgccttaatgctgatcaaatcctaaacggcctgccgtttaggattttgttattttcttcttcgggtggtctgcagcacgaagattttttgtaaccatcacgtccttattgtcattaactatagtaccaatttggaaaatttagataaggacagatgaaaatgacacttgaaaaatttgtggatgctctcccaatcccagatacactaaagccagtacagcaatcaaaagaaaaaacatactacgaagtcaccatggaggaatgcactcatcagctccatcgcgatctccctccaacccgcctgtggggctacaacggcttatttccggggccgaccattgaggttaaaagaaatgaaaacgtatatgtaaaatggatgaataaccttccttccacgcatttccttccaattgatcacaccattcatcacagtgacagccagcatgaagagcccgaggtaaagactgttgttcatttacacggcggcgtcacgccagatgatagtgacgggtatccggaggcttggttttccaaagactttgaacaaacaggaccttatttcaaaagagaggtttatcattatccaaaccagcagcgcggggctatattgtggtaccacgatcacgccatggcgctcaccaggctaaatgtctatgccggacttgtcggtgcttatatcattcatgacccaaaggaaaaacgcttaaaactgccttcagacgaatacgatgtgccgcttcttatcacagaccgcacgatcaatgaggacggttctttgttttatccgagcgcaccggaaaacccttctccgtcactgcctaatccttcaatcgttccggctttttgcggagaaaccatactcgtcaacgggaaggtatggccatacttggaagtcgagccgaggaaataccgattccgtgtcatcaacgcctccaatacaagaacctataacctgtcactcgataatggcggagagtttattcagattggttcagatggagggctcctgccgcgatctgttaaactgaattctttcagccttgcgcctgctgaacgttatgatatcatcattgacttcacagcatatgaaggagaatcgatcattttggcaaacagcgcgggctgcggcggtgacgtcaatcctgaaacagatgcgaatatcatgcaattcagagtcacaaaaccattggcacaaaaagacgaaagcagaaagccgaagtacctcgcctcatacccttcggtacagcatgaaagaatacaaaacatcagaacgttaaaactggcaggcacccaggacgaatacggcagacccgtccttctggttaataacaaacgctggcacgatcccgtcacagaagcaccaaaagtgggcacaactgaaatatggtccattatcaacccgacacgcggaacacatccgattcacctgcatctagtctccttccgtgtattagaccggcggccgtttgatatcgcccgttatcaagaaagcggggaattgtcctataccggtccggctgtcccgccgccgccaagtgaaaagggctggaaagacaccattcaagcgcatgcaggtgaagtcctgagaatcgcggcgacattcggtccgtacagcggacgatacgtatggcattgccatattctagagcatgaagactatgacatgatgagaccgatggatataacagatccccataaataacccgacaaacttgcctctagcaggcaagttttttccttatgaaacctttggccctatttatcgtattacgtaaaaacagcaaaaaggagctgctttttatgctgacacacgacctacatgaaaaaataaagcaatacatttccatttatgctgaattaaaatcaaaattaaaatggaaagtttcacacgatcagatattaatgctcatttcttctgcatatattgtgaataaaagagagtttgattttcagcgcttttatgatttgagcagctatatcaaatcaaacatcggcagcttctcaacactcaattcacaccaccgctttactgttgcatctattctggacattcattttcagcatgaggcaaaacaaacatttcatacttttatcgatgtatacaatgaaatggtgaagctaggatataagcgggatatgttcacatacctttccactctgatcttgctcaccggcaaatctgaaacgacaaaccaaaaagaacagatgaacatggggctagcagtttatcagcagatgaagaaaaatcattatttcctcacttcaactcagaatgttccgctcgccatactgcttggagaaaacggaaaaggtttgcaggcgctacagaaggcggaaacatgctatcaactgctggcagccaacggctttaaaaaaggacagtacttacatcaggtcagccatattctggccttgcaaagtgaaaaagagcccgaaatgcttgtttccgcttgcaaacagatatatcaatcgatcactgatgtcaaaaaaccaaaggattatcattatccagaccttgctctcctcacatttctggaagagccagatatcaaaaccgttttgtgcatcactgacgaattaaaccaggaaaaagcttttaaatggcaaaaggaaatgaactttaaaattgctgtcagcctctatctcagtgagcatatggagaaaaatctgctgatggaatcaggactatacaccgctatcgaaacagtcattcaagcacagcaggcagccgcgacagctgccatcatcagctcaacagcagccagccatactcatgatggaaactaaaggaggagaaacatgccatacatcacattagaagatcagacacgcctttactatgtaacacacgggaacgggacgccgatcctgtttatacatggggtgctgatgagcggacaatttttccacaaacaattttcggcgctttctgccaattatcaatgtattcgtcttgatcttagaggacacggcgaatctgacaaagtgcttcacggccacaccatttcccaatatgcccgtgacataagggaatttctaaatgcaatggagcttgaccatgtcgttcttgccggctggtcaatgggcgcttttgtcgtatgggattatctcaatcaatttgggaatgataacattcaagccgctgtgatcatcgatcaatccgcttccgactatcaatgggagggctgggaacacggtccatttgattttgacggcttaaaaacagcgatgcacgccattcaaactgacccgctgcctttctacgaaagcttcatccagaacatgttcgcagaaccgcctgccgagaccgaaacagaatggatgctggcagaaatcctcaaacagccggctgccatttctagcacgattttatttaaccaaacggccgctgattaccggggcaccctccaaaacatcaatgtgccgacattgctgtgcttcggggaagacaagaaatttttctctacagcagctggggaacacttgcgcagcaatattccgaacgcgacactcgttaccttttctaaaagcagccattgcccgtttttagaagagccagatgcttttaacagcacactcctctcctttttagatggggttattggaaagtcataaagaaaaaggaattaggagattagggaaaagtatgagacaataaggaatgtgcagtaaaatacatgagggaagaagtgactttatgtcttactataacaaacgaaatcaagaaccgctgccaaaagaagatgtgagtacttgggaatgcacaaaagaagactgtaatggctggacccgaaaaaacttcgccagcagtgatacgccattgtgccctttgtgcggaagtaaaatggtcgacggcatccgttcattagtgaatctccaaaacaacagccaaacgaaaacaagctagttcttccctataacaaatgcagtctcctgcaagcaaacaaaccccgaacggagacaaaattctatatttcagaataaaagcctctcattgcaagaggccaaatacgaagaaagaagcccaaaactgtaaacgtttagggcttttttgtctgtttcaatggtataatatggatataagaggagtgataacgtgatctcaaaccagcagcaaaaagacttgaaaaaaagagctgcgttcaaaaagctgaatgttgcaatgaactcatatgttgaacttctgtttttgtcagtacctctgattcatatctttaaatggctcggatcattagccctgcacctcatccattaaaaaacgccactcagcttatgccgagtggtttttattagtttatcacagaaaagctgttgatgatgccgtttggattttcccatacttttttgaaggtcttattttcaaggctataggaataaatcgtccgcaccttagcttcacgccctgtttcatccttcagttttttagcccccttggcttcggcaagaaaataaatgttctttccatccttagagaactgaggctgtgcgtcaattaacagcttaaatgatttttgatttgagatgatgctttcatactttttcgtatccgcattgagcatctgaatagaagcggtttgctccgttcctttctgcgtatatgatgtgaataaaatacgtttatcatcatcagaaacagcaatatcgctgataaattggttcaggcttttcagctcattaaatttatgttggcggccttccgcaaaatgaatcgttgtcggttctgggtcgatgcccttttcgtttgcttcatctgttttcttgtagtcttcttctacagaataatgaagcaatgcaaatgaatcgtttttttggttataaaagaagctgctgacggtgttatcctgatcattagcggcaggataaagatttttgtactttttcgttttcagatcaaaagcggcgatccgaaaattgctttcgtccgattttcctaagcggaaatagatggttgaacggtcctttgataaaaacaaactgtccgcactctccgcgcctttataaagcaccgtctttttattagactttagatccagtttaaaaagcctcatttcattctgttcattattgcccgtataatagagcacctgctgtttttgatccaaggcaaatgccggatagctggtcagcttctcctcatggatcaccttgtcattttcataatactttgtcagcagatccgtatctgtaattgaaaccagcagctcatcaccgctttcagtattgactgaaacatcagcagccttctcatggcctttatcctttgcaacataaaacgcaacccccgcggcagctgccgctattatcactgctaataataatatgattctttttttcatcttttatctccaccaatagaaaaagcaagaatgtgacttcttgctttccagattatatatgtacattaatagctgtaatgccccgctactttccctttgcttaatgggtatccaagcgctttaaacgctttagggctaacatccagcactgcattaggcattctgccaacatcatttttataaaccgtaatcacctttttaggcttcgcttttgcataagctctgatttttgtcccgtttctaggaacatcaaatccgattttggtcgcacaatcccaatgtccaagtttcttacctgaagagccttttttcccgactccgttataccaagtaatatttccgttcacatgtttcgcactggcatctgatgaaaaactaaaagctcccaaagtacttcctactaagataaaagcggctaaaatgactttcttcaacatttcgtccccctgtttgttaacatctaggaagattatacacgatcaaccagctattttttatttcaatatccttacagtaatgttacaaagtcaaaaagttacctctgctaaattaaaccatggaagattatcctattataatagcggtattagcgttataattattgatagagtagttgtcgcattcaatatgaacgaaccattaccgtattgttcaaaccaaattcatagctatgtaaacgattgatactctcatataaagaaaaaagagtgtgcgagacccttttttctttaaagtttcttttttcaaaaaaacgtagattatattatataaaaatttcatttctttttggttttaaaaatggcgattttgtgaacagttcatattgaccggtgcggaattactcacatcaaaagttataggagtggtaatccatgaaggcagcaagatggcataaccaaaaggatatccgtattgaacatatcgaagagccaaaaacggagccgggaaaagtaaagatcaaagtcaaatggtgcggcatctgcggaagtgatttacacgaatatctgggcggcccgatctttattccggttgacaaaccgcacccattaacaaatgaaacggcacctgtcacaatggggcatgaattctccggtgaagttgtcgaagtcggagaaggcgttgaaaattataaagttggagaccgcgttgtagtcgagccgatttttgctacacacggccaccaaggcgcctacaaccttgatgaacaaatgggattcctcggcttagccggcggaggcggcggtttctctgaatacgtctctgtagatgaagagcttttgttcaaacttcctgatgaattatcatatgaacaaggcgcgctcgttgaaccttctgcagttgctctatacgctgtccgctcaagcaaactcaaagcaggcgacaaagcggctgtattcggctgcggcccgatcggacttcttgtcattgaagcgctgaaggctgccggtgcaactgatatttacgctgttgagctttctcctgaacgccagcaaaaagctgaggagcttggcgcgatcatcgttgatccgtctaaaacagacgatgtagtcgctgagattgcagaacgtacaggaggcggtgttgacgtagcattcgaagtcactggtgtcccagtggtgttacgacaagccatccagtccactacaattgccggtgaaaccgtcatcgtcagcatttgggaaaaaggtgctgaaatccatccgaacgatatcgtaatcaaagaacgtacagtaaaaggaattatcggataccgcgacatcttcccggctgtattgtcattaatgaaagaaggctatttctcagccgacaaactcgtaacgaaaaaaatcgtactagatgatttgatcgaggaaggcttcggggctcttattaaagagaaaagccaagtcaaaatccttgttagacctaactaatttgaaaccaaaaagaatccgcactcgggtgcggattcttttttaaattatccaatcacttcagccccagaatccttctttgccccgctgtgatcataagcgcggaagttttcctccagctgctcaagcgaaagccctttcgtttccggcaaaaacctcttcacaaacaagacagagcaaattcctaatccaacgaagataaagaacgttgtggacagcccgatagctgccagcaatatcggaaacgtgaaactgactgcaaaattcaccatccacagacagaataccgtaacacccattcccagtccgcgaaggcgaagcgggaaaatttcagatagcatcagccaagtcactggtgaaatggcgccctgctgaaaagcaagaaatgtgaccgttaatgacaggactacatacggaagtgccggtgatccttcaagtacaagtgagaatatcccgattagcaataatgctgttgtcgtaccgatcaagcctgtcatcagcatcggccggcgccccactcttcccagcagccagattccgacgaatgttgccaataccgaaatcacgccattcgcaatatttccgattaaagcggcttccgtttggaaaccggaatttcttagaatttcagtcccataatacataatcgaattcacacctgtaatttgctgtacaatcgcaatccctaatccaataaacacaatacggcgcacccatgggactgaaagatctttaaatgtcgctttttcaagctggtcttcttttttgaaagcgaattcaatttcttgcagctcagctgctgcccgtttttcgtccctgatttttttcaatacacgcaaagcatcttcttttcttcctttagaaacaagccaacggggactctcgggcattctgatcatgccgaaaaacaggaacaaggctggaagtgacgcaatgaccagcataaacctccacacatgggagttgtctcccattgttgttccaaggatcgcattaaaaacaaaggccaaaagctgtcctgatacaatcatcaattcgttctgcgtcaccatccgtcccctgctttccacaggagacatctctgctaaataggcaggcaccgttacggatgcacccccaaccgcaataccgagcacaaaacgggaaataatcatgaccgtaacatttggtgcaaacgtacacccaatcgttgaaataaaaaatataacagcgaggaacaaaatatttttgcggcggccgttaaaatcagacatcctgccgccaaacacagcacccagtgccgctccaaaaagaagtgaactggtgacaaggccttctgtgaaggcattgagattaagctgatccggctctcccatatacggcaaagctccattgagcacaccggtatcatagccaaaaagaagcccgccgaaagtggagactaaaataattgtacgtaaaaatgacatttgatttccttgtttattcatactgtttcccccagtctttttcaaaatgcgtatgtcaaaaacttattccagggctgctgccttcctcacatttcgtaagcaggcttcagaaaatagttgttcatgtttttatccaataacctcataaccttcccttcttcttagcatgtcaatccctatggaagcgatttcatttctcgttaaaagaacaatggtcatttctttgtgcataacctcgttcatttggtatttattagtcacttaatagttcaattgtagtgatgttatagtgacatttttgttatatctgatattatcataattataaaaacgctttcagtcaatataaatttctgaaaattttttactctataaaaggaaaatcaccaattcaaggggaaaatgaacgtttttcttcatgaaaatgtgtgaatcaagtcaaaaatcttgtgattttctgttcatatcgaaaaatgagtaagtgttgggtaactcccacctatttttctctgtaaaatcaaacattcgttcaattgtttcagactcaggataaaaggaaatagagaagaaaataaaagaaggctgacttaagggaggcaaccaaaatgaatgagggttatatcattgcaggccttttattattgacagcggggatgattgattttttatggaccacgttatggttagagagcggtgccggcccgatcacaagatgcctgtctgcctggctgtggaagggctgccgcaaaatcagcggtgaccacgcaaaggttctaagtatggctggtcctctgctgttatgcctgacgttagtgatatggatcagtctattttggagcgggtgggttttgatttactcgagtgaccctcactcacttatggaaactcaatcaaaagaaccggcttcctggtcagaccgaatttatttttccggctatgtcatgtttacattaggaaatggcgacctcgctccgaacggaggcctatggaagcttgtcacgattattgaaacagctcaaggactgcttaccatcacattttctgtcacgtatttgatttccgtcttgagtgcggttaatcaaaaacgctcctttgcccaaagtgtattaagtctagggcatgacggaactgaaatcgtccataatgcatggaatggcaaagattttcacgacattgattttcttcttgtcgctgcctcatcagaactgggaaagctgaccgctcagcataacgccttccccatccttcatttttaccacagcacgcagcatcaggaatcatccattatagctgttgctgtattggatgaggctctaaccattttcaaatacggaattcctgaacaatatcagccgaatcagcttcatatcaaagaagcgcgctcaagtatcaaaaactatctggataccgttcatactgcctatatccatcctgcagaacaagcgccgccagaaccagacatctcaaagcttcaacaatcaggcataccggctttatcaaagcaaacatttcaaattgccgtcaattcaataaaggaacgtcgtcaattgctgctgggaattatccaagcgggggctcgaaaatggcctgttcaggagcaagcaataggtaatgcttattctcctaaataaaaaagtcccgagtgctgatcactccggacttttcactgtatgattcttatacaagcttctggccgcaattcggacaaaaattggcttcgcccgtttttgttccgcagtttggacagaaattcggtttgcttccgctgccagttgactgtgggcctgatgactgtgcctgctgattctgattcatttggttcatcatctgattggccatattcattcccatcatcattccagccatatccgaagccgctccgcttccgctcatctttccggatgccattccatccgtcattgatatttgctggtatctgttcacatccccaaccataccgtaggaagcgttctttgtaatcatatcttgaacctcttgaggataattaaagctcatgatttgaaaaccagtgaccgtcatcccgtcgcttattaattgcatatctaagtcctcttgaattcccttggcaatatcaaaagcgtttgcttgaagattaaacatatctttcccttctcttgtgatccacttcatgagaagctgatccagaatagaaatgatacgggttttaatatcctctacaaaatattgatctttcacgccagcgattttatcaatcaggctgatatagtcctgcaccttgaaattaaatgtgccgtttgcgcgaatgggcatcccgcctggcattcccgctgccggaatatttatcgcctgttttgttccccatcttacggtaaattccttcgtattgacaaacagcacctcagctcgcatgccgctgttaaagccaaacttaaagccctttaacgttgaaaggaatggaataatttctgattcaatatcataatcgccatcatcttgaaagactccttcaacccgcccattgttcaaaaagacagcatcctgtccgggacgaatgattaaacggctcccttttttgatttcacgattgttccatttataaaaaatcatatcatctctaaattcttcccactctactacattcgctaattgatttctgaaaaacgacattacgcctctccctttctctatttcttacatttaaaaactgccccggctcccactgtatgacgtgccgcctttcgtaacaccgccatcgctgccgctgtctttatctgatggttttctttctcttgttacagtcgttctaatataagtgtcgtattgatcaatcacatcagacgtacgctgatccatatatgtacttccattaaccgttactttgccgcctgcatgataaagcatgattgaaaccgcaattcccccgactgcgatggcagcaatcagctgaaaccaccatgtaaagaatatgttgtcagggtttactcccggttttatgcccatatctttataggaaagctgaatatatgtctcaaaagcttcaaaataattttcattggataaatcagatgaaatcgtatttctgatgctattgagcctgctgttgtccaaatactgttcggcttttttaaagcctgcgataaacacttctctgtttgtcatatcaatcgtcagaatggctgtactgccttttccgtaacgatcataaaaatcgccggtatagtctgcaatatcttcaccgtttgtgcttttggtcgtaataatgatgaaatcagtgtccctctttgcacccagctttgccgagagagattcaagttttccgatctccgcttttgacaatagatgagcgcgatcgtacacatgctgctgcaattcagaggctcttaccgcttcgatacccagtaaaggcatcatgatgaaaacagccagcacaacaaagatcgctttcccaaaaaatccacgcatcaaaatccgcctcccatcatcaatgagacgagcttcaacgcaagaaatgtcccgcctgctattccgctaaaccatgcagccacttttcctcgactgatcggcggctttccaacgacctttcctgtttgcccgttcatcgcaaagatatgctccgctctttcataatcgtaactgaccatccaaacaggaagcaaaacgtaaaagctgttcacgtttttcgtgtgaatatgtttgtccctcacattgactgacgtatatccggaaaaagtagaatggatgtatgaatctatataactgctgattttctcttttgccctcggaaaaagctcctcatcggtataattgtacttttccgcaatataaccggccaaatatgccgtttgaaagtccttcagctcttcgtatgaataaggctccaatttgtccattaattcgtctttcattttttcagaggcatcgacagggattttcaaataatcgagattgatatcacgaaacgcttcaaagtgctctgtttccgtgcaaatataatccccttcttcatattgatggactctggtacagtttgctctcacctgtacttcactatttaaatcaaacatccaaaatggaatatacatgccggtgatgcttttgatacgatcagcagacatgaaacctcttggtgtcagaaggccttttttgcaccactttcgaaatgcctgctccgcttcttgcttgctgattgtaaatggaatgaccttcgccggcgccaaatgtcctgataaacgatcggcaagtattgcagcacctccgcagaagctgcacgtcgttgctgtcgtttcagcttccgtgatcaaaacggcaccgcagtttttacattgatattcttttgcttcatcatcagaaaaccgtgccgcaatgttttctttcggaaggctttcaatattgtcctgtcttccgcagctgctgcaggataacgagccggtttcactgtcaaatgccatatcactgccgcagttcggacacttataagatattatcattaccgttccctctcacattttatgataaaatgacgccgcagccgaaagctgcggcctcctatgtattacttatcgagcatcattttcgcttttaacgccgcaagttcatcatcaacctggcttgaaccgccagtgtcatactttgcagacagatcagccatatcatcctgcggagcgctgttcagttcagccattgcattggcctgatcaagtgccttatttactttgtcctccattcggccgaatgcagacattgattggcttgtacttgaaacagaagcgcccagtttgttcattctttcttgcgttttcgctactgcccacttcgccttgatcatatttttgcgtgcttccagctctccaatgtcagataccaatttgtcatgcatctttctcatctgtgcggcattggttgcagcaatttgattcgccgcctgcagctcagaaagctttgactccaaagatgtttttctttcaagaaattttctcgcatcgctctcattcccggcttgcagcgccttcattgcatagctttccatcttttccatatccgcctggcattcgtgatattctctttttgctctctgctcctcagccataacagctgctgtttctgccttaaccttagccaaatcgctattcatatttcttaaatattgatctaccattttctccggattttcagccttgtccaataaagcattgatattcgcagacataatatctttaaatcttccaattatactcattatatcgttcctcctaaagctaattcggtaacccttgttacatatactatttattatcgttaaaagtttcacttttttaataaaaaatgacatttcaaacaaaaaatatacaactttttacctgaacaaaaatgtaagcaataaaaaaagatgcccccaaaagtccaaagactttcaagaaacatcttcaatgatttacaaagaaactccaatctcatccaaactcggcagtgcatcaatcgctccaattttagtgcacacaagagctccgaccttattggcaaacgccacaatctcacgcagtttcacaaaatcagcatctacagattgaatctgatccgtgtttgccaattgatataaagccgcaccgacaaaagcatctcccgcccctgttgagtcaattgatgtcaccggaatgcttggaatgatttcacggtcttttccattggaaagaagcgttccgcttttcccaagtgtcacagcgacaatgttggctccgatctcatgaaggatcgcaactcccttttcatgatccttcacaccgctgataatctcaagttcctcgtcactgactttcacaaaatcacttacagcgatcgcttttttcgcaacacttacaaactctgagactcttcccctccataaatcttcacggtagttagggtcaaacgaaataaactgtccattgtctttcgcaatcgacatcaaccgtaaataggctgagcaaaacggatccgataacagtgccgtcgcagagccgaaatgaaggattttcgcttcgtttagtttttcctggtcaatgtcctccagcgtaaacaaagcgtccgcgcctctattaaaaacaaagtcacgctctccattttgttttaatgaaacaaaagcaagcgttgtaggcgctttctcatccatcaccagcatagaggtatcgacatgtacagcgtccaatgttcgcttcagaaaatacccaaacggatcctttcctacttttccgctgaaagcggcgtctccgcccagcttggcaatcgctgccgacacattcgccggtgccccgccggcacttttcaggaattggcgcccttccattaaatcaacgtcaacatcggtacaaaagaaatcaatcaacaattccccaatacaaactacagaatgactacgcatattatcacactcatttataaagtctagattacagtctcagtatattactttttgccataaatacaacattgaatattaaaaattttacatctatttatctcgcagacctttgctccagctcagagatgatgtgtttatatcttttttccgttaaaggatagaaggcgataagaataatagaaagcaaaatgaaaaatcccggaatcaaagcattcatatttttaatcgcattcaacgacgcaactgtctggtctgtattcgccacatacccggcgattcctaaataaatggccgaaaatgacccggctaacgcaacacccagcttattaataaagctcatgctcgaaatcacaacaccatccgcgcgaattccggttttccattccgcataatcgacgcaatccgcaaccattccccaagcaagcgtatttaaaggcgttgtgaaaaatcccgaagcgaaaagccaaatgaaaatgagtggaattgaagaatacggcgtaaaatgcaggccggcataagaaataagcgatagagctgccgtgataatcatgacttgttttctgccccacttctcagaaaagaaaggaataaacaaattgctgatcagcgctgccccgaaaaataaaacggtgcccataaacacgaactctttatggtttacgttatacgtaaaataatacaccatcgtgctgagcttaatattaaacccgatcgcaaaagccaaaaatgatgaaattaacatgagcaagggtttgtttttgaataaaacggataacgtctttttgatcccttgtttttttctctttttaggctgaatccgctcccgtacagtaaagaaactaaatagattcaaaacgatgctgacagccgcatagatgagcgccgtcatctgaaatccaaacgcctgatcctctcctccgatagcagttgcaagcggtgtcgcacaggaaatggataaaagaatgccgatatacaccaaaatcatccgggttgtggtcagaaccgttcgttcctccaccgaattcgtcatccgccccgttaagctgttcaccgggatcgtttgcatactaaaggacatcccaagcagaatataagtgacatacgcatataccatatttccggtctcaccgaaatgaggcgtcgtgaaacataagaatgtgaatagcgcaaaaggaaatgccacccacagcaaatatggccttgcttttccccaccttgtattcgttttatctaaaatcaatcccatgatcgggtcaaaaatagcatccagcacacgcacaacaagaaacaaagttgcgattaccgcaggctgaatgccgccgacgtctgtataataaaataataagtatgcgtttacaaactgaaagataatattatacgacatatcgccgaatccataaccgattcgttcaaaccaggacaggccggtgctggattttgactgatgcttcgccttcaatgccgttactttttctgttccaatcatcatttcccaccccaagaatccgttttcatttccagtaaacaagagggagaatacgaagatcctccctgttcactcagcgatttggatacaccatcacttttaaacattcattcttaaattgaagcgcccgctccatcgcatcttgcgtctgctccagcgaatattggtccgttactagatgcttcgtgtccacaatgcctgaagcaagaaattcgattccctttggatacgtattggcataacggaagatcccgtaaatatcaatctcattatccgcaataaacggcacgttgagcggaatctcgttctgtgaaggcaaaccgacaatcgccaattttccgccccggcgcacagaagccagtgcggattgcaatgccgctggattccctgctgtttcccaagcaacatcaacgcctctatcattcgtgatcgttttaatctcttcaagtgcatcctgttcacgtatattaataatgtgagtcgctcccatttttttcgcagcttctaaccgcagcggctctaagtcggtgacaatgattgtgcctgccccaaatgctttagctgcggcaacagccattaacccaacagggcccatccccataatcgcaatcgttgatccgggctgtagcttcgttctggccgccgcatggataccgacagaaaacggctcgatcaaagcagcttcttcataagaaagtgagtctgggattaaaaaaacaaagtcctgacgcattttaatatattggacaaacgcaccgtctaccggcggtgtagccaaaaactgtacatccgggcaaagattatagcgtccttctttgcacgcctcacagcgtccgcacgtaacacccggctctacagcgacgcggtctcccaccttgaattgatcgacagatgatccgacagcggcaatttcacccgcacattcatgcccaaggataaatggtttttccacaacatagttgcctattcggccatttgtatagtaatgcagatcagatccgcaaattccgacagccatcaccttaatcaacacttcatcatgattgatatcaggcacaggcaatgtttcaattttgatctctcttgtgttgtgcataacagccgctttcatgttttgaggtactgtgtgagtcatttggcaagttcctttctttagaaaataaaatgtaagtgcatacatttttgttttctctgttactgcccccattttatctgctttttaacacgttcaacagcctttcctgctgtataaaaggacagcggcactgtacttttattttttcatatacaaaaaacgctggattgataaaatagtactaataggaggtgcaggcttatggctgaacttgaaaaccgaaaacaatttgcacaaatgctggcacctggcgtcaaaacgctaaaacttcatcctgattataaagtcagaaggaaaaagaatgaaaaaacaggacagtcttacatagataaaatcgcactccagctgggagtctccccaaacacgatcaaaagctggatcggacagatgggggcaaactacattcccggaagaatcgacgacggaaaactgttcggaatgatctggatcattctcgaaaagaccgacttggatatcgagtggttgaccgacttgctggaagccaccactatcccagtcatcaaacccgcattgcctgtatgggcagcatcctgtttgaaaaaagcgaaaatactgcgaaaagacggattattcggggctccgagtgaaggcgaaattgaaaatgtagtaaaacggctgtttcatgacagacccggccaagaaacgaatgcgcttacagaacagcccatcacgcataatttaccctcacgctggtccggacgctttatcggacgcagctttgatatggaagcgatacggcaatggatgctttctccatcaccagtctgtttaatcaccggctgggccggcatgggaaaaaccacaattgctcttgaagccgcctattcctgtgtcgacgatacttcagtttggccggcattcaacagcatcatctgggtcagcgctgattggaaaggattaagctttagcgattttttaaatacgatcgcctatcagctcggacgcaaagaacaaatcgataaatcaatcaatgtaaaacggtttgtcgtccgcaatgcgttagccaattacactagagaaaaaccgatcctgctgatcgttgacagcattgatactgcagaacgtgacattcatgaatttatcaccagccttccgcaaggcgtaaaagttctccttacagcgcgggaaaacgtaaagcaaacttatcgggaaagcttcggagaaatgacagccattcagctaagcggtcttgaccaaacagatgcccacgaattttttcaacaagaagtgcatcactgcttacaaacatgcaacctcccacgtaaacgggaaaagctggagcagctgttacatctatcatctgacctgaaaaacgaattcatttcagcgactgccggaaacccgaaagccatggcactcagcattgcctatatgtcagacgatgacatccccgctcagcagctgattcatgagcttggaaaagcaggctactcactgctggaattgtttgaattcctctttggccgcacctgggatagatgcaatgaagatacgcgaaagctctggcagacgctttgctttttcagcaagccgcctgatgaaaaaagcctggcggcagcagccggattagacgcccgccgttttcattacgctatggaacaaatgcggtcatatgcgctgattcagccggaacgaagccaaggcaggacacaatacttagcgcaccaaaccgttgtcgcttacggagaacagcacttgtccgaacagcacgaatatgaaaaagaagcccgcaatcgctgggcgcactattatattgattatgccgaaacccatttaaagcgggaacagcccaactctatctattggagctacctgctgggacggaacttagatcaaatgaaacaagaatggccaaacatcttaaaggtcatccaatgggcaagtgaaactgaacaaaaagaaatcctaatcgaactcatcacccgcattagccattttctaagcagaatcaacctgcccctgcgaatcgaatacggacgcaaagcggccgacgccgcccatcacttaggccaacacacacgagaagcgtacttccgaatcgacacctcaggctgggcattgatggaagtcaatgatttagacggagcgcttcagcaaatagaagccgggctgaagattcttgaacaatcagacgctcacgatgcctatgatctaaaggtttggggacatgcactcaaagcaaggctgtttttaaaagacgggcaacaggaaaaagcagagacaattttaaacgaaatcgaaaatcaaccgatttcccctaccattcaacacagagttctattggttcgcggtgacttaagctttgcgagaggttatcatgtagaagccattcaattatacgaagcggcaaatgaaatcagctccacatacggcggcgaaaaaacgatagaagcctatttcaatctgggtgtcgcttacgtgaaatgtgatcagtttgaaaaagcggaagaagcctttgagcaaatgctctatgacaaacataacgccaatcaagttgaactgatctactatcactacggaatggcgcagctgttgtatcgtaaaggagagaaaacgaaagcggtggaatctaatcagaaggcgattcgtttgattgattcgtgggagcctgcgattgggattcggggagaggttgaacgattagcaagggcaactaaagaaaacgagtagtacgtagttctgtcagcaatctcactcaatttctttattataaataggaaaggccaactgaagtcgcagttggcctttcgtttcttattaaagtctacaaatgtatcaaaccagtttttctcgtataaaggaaagcgtatcatttgccagctttttgcgacaaagaacaataccggaatgaccacaattgtagacatatcttgtaggtctcccccaactttcccataaataatctgcatctttcaagtcaatatattgatcatgtttagcagaaatcagcagtacgttatctttattaactttcggcaaggcttgactaggatctgtgatatcccaatattttattaactcattataggtcacaccattttgttctaattcttctcttatgtatttacctgggatcgtgttccatatcgaataagaaaggcgattggcataaaagatagataccactacatcaattttcgattccagggtagcaattagattagtaacccatcccccaaggcttactccgactatgataacaggcccttttttatttgcttttatccagtgaatgaacgcccgtaaatctacaatagcctgtcttgtcgactcaattgtacgatcaatattaactaagaataaacagaaaggaaagactgatttatcatggtatattcatttaaaagagaccctttaggatacttaagaatagttcttccaacaagaacagaactagaatacttttccgatttcattgaagatattgtttcagtagaggaagctgatgaatactttaaatattgttcaagaagtattgaatggttcttctgaagaatatgagattcaattaaacaccactagattcattcaaatcaattgaaacatcagctatatttgcactgtaaaattcctctctatcattgatatcgactgtaaaagcagcagaaaaatgtttatctatgcttctttttctgtgtaaatcatataaagccaaacgatctatcatttttgagacatgcactattaagtcctccttgataatatcagagttgataattaggttgtctatctccatagcgtcgggacggattttattaaggtactgttggaagaatctaactccatcgacagtgaatttttggggatcagatgtcattattctgtcgctctttatatttaacataaaagacgagttccttattgcaaggaaaacatcgtcttttagctaaaaaagcaaagaagcacaagatttaacaggattcctctttgacagtgcttttctaggggaaacagtctaagagtgggtggcactacttatttagataactgggtcttttttgtgtcgtatgagagtataccaatagggtatcctgtctgcaatagagagagaagcggtccataaatgaaatgccatgtaagcttgtacacactacacatgtttatttatacatcaaaaaagaagcttctcacaagttcggtgaactcatgagaagccttgaaaatttgcaaatggccaaaagggcatcaaaaataaaagtccgttgccgacaaacccctgtttatcaagagttttttgtcggttttacatcatgcaacccattcattccgactaataacagttgaaaatagtattaaaaaaaccagctcaaaatactgttttttagacttaacatttaatgctgataaatatttttaaaactataggaggacaaaaccgaggacaagtattatgttatcggcttttaaccttctagaactaatttttatcacttaatctttttgtaaacaaaaacatattaccatacaatgttgaagttataacgctatgtcgtttttttgacttattaatttcacttacaaatttaaataagtcatcagtggaaaatgttttattttcaagatataagttataaacttgttcagcagaaatataaacaagagttacagcggctatatcaagaaaatcaaaatcaacagaaccaaatactttaaaggtattggttgaattagaggaaggaaacagaaaagcattatgttttgttttacctctggacagtttttcaagtgccttatcatataacagctgcttagttatatcttcaaccccaggattcccctccagcttttttccgtcaaaatttatattataatatttagcatctaatattaaaaagtattcttttgaacggtattcgaaagccttaataatatcgggttctagtgtttttttctctttattaacctctatatccgtaaagttaatccaatttggccttgatatcttttttacgtattcattaacatgggaaaatacggtcttacatacttcctcccatactctgtgaaagtattttgttccatacagagaaagagtgggtcgtttagaaaactgattctcttccctatcaattgcggttttcaatgcctttaacaatttaacgtcacgatcaacatatgtgttcacgatttctttatttattactgagccaaaaaaatcagcgtagtccaaaattttcataccatcacaggatttatcaaattctagtcccgtaaaacctaaaatgactccgaaatcattaaaatatttacttaaagcccatttatgaattttaactatcaagtgatactcgtctttttgtaccacttcattataagtactgaaataatatggaactccctttgagaatactggggtaatttcattaactgtcttactccaatctataattccttctccatcaatttcatattcagtaaattttttttgataatacccattcaatgagaaatcattaagcaaataatctgctatcataaagtcggagacttcatcactatctagctccgatacgaaataatcagattcccggcttttatttaaacctgaatattttttaaaaatcttcagcaacttattaaacaaagtccgctttgaatgttcatctaagtgcctgttacagtatttaggcaaaatgaatattacattgcgcccattagatataacacctacatagttaaatattaaatccccactagaatcttcatataatatacctttacttttgagtaaagctaaattaccaccgagtacacgtacaatcctttctttattgtatttttgatcttcaaagaagaacttacttgacttatccatagttaatcactcacaaaagacgaatcatctatgtcaaaagtaaaaatgttatccgagccatcatatttttcaattagctcagagaaagtactagcatttaaaaaatcaatcgttggattatgcttgaaaacatcttccttcaaataataaagcagtttatttttaaatacattctgattccacagttcactttctttcaggaaaaaaggtccaagcagcttatcctctggtacttttcctttaagacgcttattaataatgtctcggaaatcattccacataattactttattatgacctttatatctgaggctcagcttccaagagtccactgcctttctatacttttccaactctaaatattcaaatgaccaccttctcttaaaagcggtatcgagcggtaaaacaccctgatccgcattattcatagttgcccaaataaagaaattggatggtagcttaatcatttcatctttaattccgtttctcgctaaataattcataatgtccggcccgaatgtaacaggataatcactttcaccgtttttatttctgtctaataattgaaaaatatcaccaaaaacacttgctgcattggcacgattaatttcttcgataattaatataaaattagtgtatctatttttcagagctttaattaatacatcgataaatgggccaggaacaaattgataatcaatcattggctcaaagttttccatcttatccctaaagtttgaactaaatatctcttcctcaccgcttaattttttatatataggaaccggtttataagcacctataaattgtccatatgtataaccagggaaaaaagtaactcgggtgaatacatatggattatcaccaaagatctttcccacttccctttctagataattactcttccctgttcctggtgcaccataaataatcctattcctaggaatactgcgtaaaacgctgaattttggtaaagtgccttttttcttttctaggctcaataataaatctgaagtttgtttggatatttccatcagttcatttcccctatttaaagtttatcgcttagttattttcaaagtcttccggtaagtcatccgatgatgtagtagcgttctcatcaacaatgtccccagatacaaatccctcacttccattttggacatttggatgtaagtctagaaatgaaatcaaatcttgttcaatatttacaaacttaagcagtgaattcttatcaacaggttcattatatttatgttttatcttacacaccacaagattttcaacgacttcaattacttccagtctgcgtgtgatagctgatgaaccattagtatgtgaagccgtccaaatcatatcaccaattctataggttttgtctttatcttctacaaattccacaatagaaccatcttcctcaatatcaaggaagactacatagctctttgcactttcctcatcttcatttttagcgcttttgttattttcctgggctggggattgattagctcgcgggtattctttgagttcaattcctggaatcaattcctcagccttttcctttaattcaaaatcgttctcgaaaactaagaatgctagcggatacactttggtttcaccctcaaatactaaaaaaagtaatattccgtcaaaaatcgtgcccctttcttccccgttacagaatttagatgaggttgtaattgcactatttctcgttcttataattagttcatctaattccgaatcgtccacagaaggtatagaaataaaagcaactgccatccgggtatgtttattccgttgatttccttgagcaaaccgagtgtccaaattgctaatccttcttgatgttcccgttacatacacttcattttcaccgatcaagaaggcttctgaaacaatctttcgtatttcgttatacttactagtactggtactagatactccggcagggtaattccctaatagagtttcataagcgtcctctaatctttttataaaagtcattgattttacccccataaaatcacacaagctaatatgtatgtattttctaattaatataattgtatcataataaataaagaggatggaattgtttgagagaccaattcaaatatcgaattggtactgattggggctgtcgaaaaagaaattcctcgccaccatgatctcatcaaatttagagacaaaataaaaaaaaccaactataactagacataatcagacaagagcactcgatttatgtcagaaagtcgtcgttcgaaaacctctagactatattataatgaacaataatgttattttattgtaggtcaatcataggctggaaaaacaaaacagaaaaatggctacagtttagtcaacttgcaccgagctaaaatcggggttgggtaaatcaggaaggaatgagaaagacctggaagatgctttttataaggaatttgggatatggaacaggaggcatgcgcggggaaattggagctggaacaaaccggatgacatctatacgttaaggaaagtttctgctgggttggcggcttttataatggaagccgccaggacactggcatccagcgcatacgttttcgagtcattaaggcctacaaccgtgttaagtttgcagtacgtcaccttcatggttttgccggtattgttgtgactgcgagccataacccgcctgaatacaatggatataaagtttatgggccagatggcggccagcttcctcctagcaaagggcctgatcaaaatatagcgcagaggtggacaaggcataccttgaactatttcagaaaactcaaatatttaagatgaaacagacatcaaggttgtatttacgccgcttcatggtacagcaaatctactgcaatggccttggcggcaatgaactacaagcatgtagcggtgggaaaagaacaggagcagcctgccctctgttttccactatcaccagtccaaatgctgaagaacatgccgcgtttgagctggccatcagggaaggcagcaaattgacgccgatatttaattgcaacagatcccgatgcagacaggcttggaattgctgttaaaaatgaaaatggtgagtatacggttttaaccggaaatcaaaccgagccacttctgctccactatatcttaacccaaataaaaagaaaggaacacttccatctaatgggatcgttcttaaaacgattgttacctcggagcttgggagggaagttgcaacctctttcagagtcgaaacaatcggtgtattaacgggatttaagttcattgccagaaagattaatggctactacaagacaggagaacataatttcctctttgggtacgaagagagctatggctatctgattggcgactttgtccgagacaaggatgctgttcagacggatgtccttgcagttgaggtatgtgcttactataagaaaaaaggatttcactatacgaagctctccttagtattgaagaatatggctactttcaggaaggcctgcgctcattaacactaaagggaaaagaaggggcagaactgattcagcagaccctcgctgccttccgttctgaatttggccagctttggttccgtcaaggttaccactgttgaggattacttgaccggaatcgagagactgtggaaggccctgaggaactcatgggccttccacagtcaaatgttcttaaatgttttcttgaagtcggatccctggatgtgcctgcgactttcaggaacagaaccaaaaatcaaattctacttcagggtagatgaaagtcttgccgagacccgaaacccccaaagaattgaaaaggagtttatggaactggtcgaataaaagatggaataatgcaaaaaaattaaagataaaaaacggagctggttttatccagctccgatactttttagtatgctctctttaatgtgaaaagttaaaccttttgaagttgcctatccttacaacgttctaacgagttaataaattcatccgaataatttacatttgtacacctggctgctctacctaaaaaaccgtttaatgccctagcagataaaggttttaatggatgatttaaaaactctgaaatagctatttgttctgtgtttgcaacccattttgatacgggaactttatactttttatctccgtacccccatgctgcacttggccaagtcttggtcactaattcaccttcaaaatctgatatcgacccttttggctgacttaagttttcaccaatccatttagaaacccttaccgaaacagcatttcccaccaatctccatctggcaccttcttttatatccttacctgtttcagtagtgatatttgtccaatcttccgggaatccttgtaggcgctcagcatcccttatattaatggtccctactatatcctcgtaaggagaccaaactgcaggtggagaggctatacctacagacgatccgcattttataggtggaactgcttcacgtgcccagccgacacctcttaacccttccgtccaataaaaaccataatagttggaatgatccacaacagaaggctttccatctaaatctggttctgaatgatcctgtgaaaaaatcacatcttttggatcttcaaataaagaggctaacaaaataactctatgtcttcgttgcggtaaaccaaaacaacgagcatcaacagttcgatatgcccaagtataacctaattcagaaaggacagatgttaaatatgacatagctttaccacggtttaaccttaacatatatgggacattttcaattagtatccatggagggcgatttgcatgttctttcttttctataagttcaaatagtttcttaactaaaccggagcgtgatccgtcaatcccttctttacctccagcttgacttaaatcttggcatggaaaccctgccgcaactaaatcacagcttggtaactctctaatttcattaatatcatcttctatcttaacgccagggaagttttttgataaaacagcttttgccaaaggatcaacctcacaaaatatttctgttgtatgtcctgactgatgaaggccaagctctattccgcctatgccggagaataaactaacaactttcaaagatatcaacctcaaatctttttatcttaattgatgtaatgctaataaataggatagtttggaaggcacagcattaccgataacgtcttgatactgtctcctccgaaggtcaccaaagttaaaaaagtccgggaagaactgaatcctagctgcttcatggggagttatcgttctctttaacaaagaatgaacaaatctcccttgacctgttgatccaaaccctctggttatagtgggagcaggtctatcccaatacattctgccatacacagatttgtatgaatgtggttttagccgatgacaatccggtctttctgaattaggtaattcaaacaagttattttcaaaaagatattctattctccttttgttttccaatgaatgctcggaagcagtgttgaatatatcatcacctacattttctactaaatctgatattgcccaactaattggcctactattggttgaataaaattcatttatttgatttaaggaagatacaggagtttttgaagcaaaaataaaatatctacgacgtgcttgtgaaacacctagtttttcagcatttagtacgatttcatcgaagtaataaccttgtgtctttaaatgattcttaaattctttaaaagaaccagatttatcatgaataattcctggtacattctccactaatactgaagaaggttggaacaactctataactctacttactctcattagtaaagcgtttctagggtcttttcgtctagtatggttattaagatcagaatgcccttggcaaggaggacctgctagaatgaaatctatttttttcaccttatcttttattctttgctcttcaacagttaatggagcacctaactcgccattaatatgtttttcgatggattcattcaagctaaaatcgggagaaaagtttttttcgtacacagataaggcagcttcgttaagatcacaagcaaacgaaaatcttggatttatccccagggcacggcatgcctcccaaacccctaaggatagacctccacatccactaaataaatccgcaatatttatactctcagtagtgagctcagtattgggtctgtttttcatacggagccaagattcatcgtataattcatgaaggttcttgttttctaaatcttgggtgctaaggaccggaacccgtgatgtaactcctgaacctgatctacggattatctttcggactaaatctgtaccatctatataaaaattttctatgttctcatcttcaattgccaatgataactgtttattttcatttaaaataaaatttgtcattatatcaccctaagacattattttcattctcagagaaagtaccccatacaagaacgaatgttctttatcattataccttttatacaaaactttttcagtagcttatataatactttaaattcatgaaagaatgaaggtttttgctttggatatatcatcctcttgagggcatttacggtatttttagttgtaatgtgcgttaatgaacaccttatcattcctagtattacactaaacttgatcacttaatccttctatataagcttgctcacgttaccacacctccatatacaattctagaagccttagatcactctcattcgaatttagcttcttcctcattccctgttttaatttcaccagtatgttcaatctattccttgaaggccgcatttgttttagtaatatactcagacgcctttagtcgctctttaaccgaactattccatcgcgtataataattgtccaaaacatttttacctcaataatgtttgctatgcgctccgcttctagttgattatttctttgctctatatagtttgaatgtctagttttgacaagttttgagaagctactctgttgagatttttccctttgtttccggctagacgcgtagcctctgttgtatttctagtttctgtaaagaaatcacaaaagcgtcgttgtctctctgtcagcttcattttttgcccttccttctcaactagcccattatccgccaatgaaaagcaactcccgcttggtgatataacactagcaggaactatatcctttttttcgcgtccgttatcgtttgaggctagttcataatgaacactgtttctttcgatattagacagtttcttaaaagggtgaatcactcctacacgccatgatgagctattcttcaaagtccccgctattcttgattaccgttttatataagacatttccttttatcttaaacggctggggaataacattttgatgcgatttttttgtggattctaaatacaatggaaactgagcttgttccagtttccatttgatagcatatatggtgagtttataaaattcctccaaagagaaatcttttttatccagcagaaggtatttataaatcaattccatggccttgctaatttcgtatggttccaccttccaggctttcaaatgtgtagcaaatttaaagtatcatttctgctaccaactctgtcgattggtacagggaatacatatttttcaccagtgttgttgtcctttacattaacagaattccgtacaggcctcagataattaggtatttcatctaactcattaggactcttagttactatatatcgtcctcagtgttacttgttgggaaaacaatatagcctgccccagcgatcccagcatcgactatgatacctatttgagtaaaaaatttggttatttgtttaattttcttttccccatgttggttatccttaaaaataaactgccacccattagggtcctaatacaatgacaatgaaagttttgcgcatctagtaaacctttcactagctctccctgttttgaatcatcaatatcgatgacaattccgccagctggaatgcttgcaccaatccaatgaccttttctaatcagaattgctatctctgatccggataaacctgcggcgaccttccacttttctaccggggattttgcaatggtgtatactttgtgggccctgctgtatcccctcaatttgattacttttgcacctggcaatagatactgtacattctccagtgtttcggaaacaaaattattatcacttagcataattttcacctcacatcgcttatcgttttattaaattttgctagttaggcgaaagtgaaagatatatcaggccctctttttccttttaacctcaattgaccaccaatcaatgtattcttggacttctttcttgttaaaaagccatttgttccccaatcaaatagatggaaaattaggctcgattaagaaggtctgttgcacagtaggccaggataaaattagaaatttacaaagcttttagaatccatcaggattgattccatctcaaatttatccaatcttttgaaatatgaagggcaattattgaccagtcgagagaaacaaaaattattaaactcacttaaagaccaatttgatgaaaaaaaattagttagggacaaataaatggcaaaactcaagcaatgcggtaagacgtggagttatcatatctactaggcattgaccctttaaccaaaaaacgtctagaaatatccaaaggaagatttaaaacaaagaaagaagccccagtagcagcccgtcacgtagaactccaaaacgacaacgggacttttattaaggagtcagatatgcccttcaaaacatttgcaaaaggttggcttaagatttacaaccggagtggggtaaaaataagcagtgtacgggccagtgaaaagaaaatgatgcattttatcgcagtattgggtcaatacccgattagcaaaacacaaaaaaatgtatgaagaccgcacgttagaactgaacgagcaatacagtcacaattgtttgggaggtattcatgcctgcggccgtatgattttccgaaaagctaaaactcaagggattattaaaatgaacccaactggggattttcaattacccaagaagcaacaaagcattggaaaaagaggtgctgacacattttctaaagctcgctcaatctgacgggctagaaatggaccatttggtctttaccgtacttgcctagaccgacctaagaattggtgaacttcttgctttaaaatggacagatttcaatgataagccaggtcacaaagaccctatacacccctaacaatcaaattgaaaaataccaattgctaacacctaaaacaacaggatctgttgatatcgttcgaattgatgaaacgatgtcaatctactaaaaaaaataaaatttatcaaaatgaaattaagcttaaaaatagattgatttatcaagactcatcatttatttttgagcgggaggatggtcatccgcaattaagaaaggttattgagactagacttaaacggctgctcaaaaaagctgggataaaaagaatgtcaccccccactcttttaggcatacccatacctccttactaattgaggcaggagtaggcattaaagaaatccagcaacaatttggtcattcggacataaatacgacgatggacatttatgctcatatgaccgctaatatggagaaaaggtctcccaacagtttagtaaactgatgaaagaccttctctttttttattcacgctttgtctagttttttaagacggttaaaacattgatgtataagggttaatatccctttattacatcattccacccataccgcccatgccgcccatatcaggcattcctgcgccgccaccgttttcttctggcttgtcagcgacaacagcttctgttgttaagaacattgcagctacagacgcagcgttttgaagagctgagcgtgtaacttttgttgggtcaacgatacctttttcgatcatgtttacccattcgccagttgcagcgttgaagcctacgccgatttcttcgtttttgaggcgctcaacgatgacagatccttcaaggccagcgttgtgtgcgatttgacggattggctcttcaagcgcgcgaagcacgatgttgatacctgtttgagcatcgccttcagcttcaactgcagcgactttgttatatacgtttacaagcgctgtaccaccaccggatacgatgccttcttcaacagctgcgcgagttgagttcaaggcgtcttcgatgcgaagtttacgctctttcagctcagtttcagtcgcagcgccgactttgatgacagctacgccgccagcaagtttagcaagacgctcttgtaatttttctctgtcgaattcagaagttgtttcttccacttgagcgcggatttgagtcacacgggcagaaattttgtctgtttcgccagcgccttcaacgattgttgtgttttctttagtaacgacaactttagaagcgcgtcccaattgagcgatttgagtagatttcaggtcaaggccaagatcttctgtgatgacttctccgccagtaaggacagcgatgtcttcaagcattgctttacggcgatcaccgaaaccaggagctttaacagccactgcgttgaatgtgccgcgaagtttgttcacaacaagtgtagcaagtgcttcgccttcaacatcctcagcgatcagaagcaatggtttgccttgctgaacaacctgctcaagcacaggaaggatttcttgaatgtttgtgatttttttgtctgtgattaagatgtaaggattgtcaagaaccgcttccatcttatcagagtcagttaccatgtaaggagacgcatatccgcggtcgaattgcataccttcaacaacttcaagctcagttgtgaagcctttagactcttcgattgtgataacgccgtcgtttcctacgcgctccattgcttcagcgataaggcttccgacttcctcatcagcagcagagatcgcagcaacctgagcgatagactctttgccttcgattggcttagaaatttcttttaagttttcgatcgcaaccgctacagcttgttccatccctttacgcacgcctacagggttagcgcctgctgttacgtttttaaggccttcacggatcattgcttgcgcaagaactgttgcagttgttgtaccgtcaccggcaacgtcgtttgttttgctggctacttcagcaacaagcttagcacccatgttttcaaacgcgtcttctagctcgatttctttagcgattgttacaccgtcatttgtgattaacggagaaccgaattttttctctagaaccacgttgcgtccttttggtcctaaagttactttaacagcatcagcaagtgcatcgacaccgcgaagcattgcgcggcgagcttcttcactaaacttaatttcttttgccatgtttacaagacctcctcaaatgttttaagtattgtttatttaagaattagccgataacagctaaaatgtcgctttcacgtaagattaagtattcagtaccttcgtatttcacttcagtacctgcgtattttgagaagataatgcggtcgccctcttttacttctaaagcaacgcgctctccgctttctaacacgcgacctgaaccagctgccacgattttgccttcttgcggtttttcttttgcagaatccggcaacacaattccgctggcagttttttcttcagattctacgagttcaatgacaacgcgatcacctaatggctttaacaatgaaataacctcctcaatagtatgaatatgtaattttagcactcagcactaaagagtgctaacacaattcttataataaagaatctcccttccaatttcaagtgataagataaaaaatttttcacgcttacatcattcttttccgctcccttttccgttagctttttcacccccgtaccgattatgttacaatagctgtagatgaacgaaacccacttaacaaaggagtacataccatttgagaaaacagtattggtttattattttgacatatatcatcatgcagttttccgcattaatcgcgattcccttgttatttaaattcggttatgccggaggacagcctacagatgaaaatatgctgcatgcacaaggattatggtccgttatcagctttatcgcctgtctcgttgttgttctgctcattctgagaaccgttccgaaagaaacgctgcgaaacggacagaaggactcaatcggactttctatcctttgggcgatagccggttttttcattgcccttttctctcaaggaatagcaggctctattgaatattatgtttttggcatcggaagagaatcagaaaatacacaagcgattctggatgtcattcaggcagtcccgctcatgattatcgtttcttccatcgtcgggcctatattagaagaaatcatcttcagaaaaatcattttcggcgcgctgtacgaaaaaacgaatttctttttcgcaggactgatcagctcggttatcttcggtattgttcacgctgatttgaagcatctccttctatatacagcaatgggctttacctttgcctttttatatgcgagaacaaaacggatatgggtgccgattttcgcccatttaatgatgaatacattcgtcgtcatcatgcagcttgagcctgttcgtaattaccttgaacagcagagcacacaaatgcaattgattattggaggattatttttatgagaaacccggtagtttggggaatgatctactttgccgtagggtgcatctttacttatcttgccgcaagctcgccaggcagcatgtggtcattttactccatcctgctgatggtgttcgccgcttacaacatcagcatttcttttaagatgttcgccttttcatttaaaatcaaaaagaaccaaaaataaagaaaatccatttctcgcatgagaaatggattttttattattgcccagaagacacgtcccgatcggcagcactgcttttctgtgctttccgataagcggccttcgatataaggatactgatttcatataaaatcaaaagcgggactgtgaccatcatatgggacagaagctcaggcggtgtaatcagggctgcgatcaccagcagcgtaaaatacgcatactttctgattttcgccaagaacatcggtgtcacaattccgagccttgtcaaaaacatgaggatgaccggcatttggaacagcagtccaaacggaatcgtcagctgcagaagaaaatgaaaatattcattaattccgatcacctgattgacattcaagtcctgagaaatccgcttcataaaatcaacaacaaaaggaaataaaatataatatgaaaaagataagcccgctaaaaacagcaaaatagagaccggaatgtagctgagcgttactttgcgctctttctcatagaggcccgggctcacaaaagcccaaagctgataaagaataaccggcgaggtcaagactatgccgatgataaacgcaaattgcataaacacataaagcgggtctgtcaggttaaacgcgttaagcgtaagctgcttcgcttcatctgtttcttgcagatacacaataatcggctttgctaaaaaaaatccagcaataaagaaaacgacaaacgccagcgctacaatcagcaaccgttttcgaagctcagcaatatgctccagcagcgacatttgattcactttcattcgtgtcatcctaacttactgatcttctttcttttttcctcttcatcactcgttaatcctttagtagcgtttttaaattcacgaagtgtgtctcccgctgctttccccaattcaggcagctttttgggaccgaagataatcagagcaacgattgcgataacagcaaggcttccaggaccgatcggcatatttgggctcctcctttccctctattcgatttcctctaaaactgaataatgcttcaaaaaataaaccagtgactgaagctcaactgctaaatctatatgatgaattcgaatgtgttccggcacattcaaacgggccggcgtaaaattaaggattcccttgattcctaatgcgaccaatctgtctgtaatggattgagcggcaactgctggcactgtaagaatggcaactgattcatcttttacgtgttgttcaaggtcatcaaggttatagacgggcacgccgcctacctcagttcctattttactctcatttatatcaaaagccatagaaatttttgtgttattgttttttgtgaaattatagtgaagaaatgccgttcccaagttcccgacaccaatcaagatgacgtctgtcatctcatcctgatcaagcgttttccggaaaaaagacagcaaataatccacattatatccgtatccttttttgccaagagctccaaaataggaaaaatccctccgaatcgtggcagaatcaacctttacggcatcactgagttcagcggatgatacacgctgttttcctgacgcatgcagattctttaaaaagcgatagtaaagcggcagccgtttcgccgtcgcctgcggaatttttgattgatccttattcatttttggtcctccaaattatactcggatagttctcttttaaagtcaccgtttttcccgcctgtcttctccagcaagaaagtagggccgatgaccattcccttatcaagggccttgcacatatcgtaaacggtaagagcgcacaccgatgcagaagtgagcgcttccatttccacacctgtactccctttcgttttgacctgtgcttttatatgaagtataacttctgcttcttttattttccagtcaaacgatatatctaccccgctcaatgaaagcggatggcacatcggaatgatattcgacgtttgctttgcggccataatgcctgccacctgtgcgacagccagtacatctcctttgccgatatcgtgactttgtattttctcgtacacttcattcttcatgtgtacgcttgaaacagccgccgcagtacggacagtcgaagatttttcgctaatatccaccatctgggctctgccctgttcattaaaatgagaaaatccattcatattaaaacgctccttaaacagatcatacactattttcttctctatgtcttatatggccaatgtattgtttgctgacttctggttcataagctacacttaacttattatagcagaggtgaaataatatgatgatcttacaagttaatcagctgtccaaatcatttggtgctgatactattttaaacaatataaagctggaagtcagaaatcgtgatcgcatcgccattgtaggaagaaatggcgccggaaaatccacgctccttaaaattatcgcaggccagctttcgtatgaaaagggcgaaattattaaaccgaaagatattacaatgggatatctcgcccagcatactggcttggattctaagcttaccataaaagaagagctgctgactgtttttgaccacttaaaagcaatggaaaaggaaatgcgggctatggaagaaaaaatggcggcagctgacccgggtgaattagaaagcatcatgaaaacctacgaccgtcttcagcaggaattcaaagataaaggcggttatcaatatgaagcggatgttagatctgtgctgcatggtctcggcttcagccattttgacgattctacacaggttcaaagcctcagcggaggccagaaaacaagactggctttaggtaagcttctattaacacagcctgatttgctcattcttgatgagccgacaaaccatctggatattgatacgcttacctggcttgagcattatttacaaggctattcaggcgccattctcatcgtttcgcatgaccgctactttttggacaaagtagtaaaccaggtatacgaggtatcaagagcagaaagcaaaaagtatcacggcaactacagcgcttatctcgaccaaaaagccgcgcagtatgaaaaagatctgaaaatgtatgaaaagcagcaggacgagattgcaaagctgcaggacttcgtagatcgaaatctggcgagagcctctaccaccaaaagggcgcaaagccgcagaaagcagcttgagcgaatggatgtcatgtcaaaaccgcttggcgatgaaaaatccgcaaactttcattttgatattacaaaacagagcggaaatgaagtccttcgtgttcaggatctcacaatcagctatgaaaaccagccgccgcttttaacagaagtgtcattcatgctcacaagaggagaaagcgctgcgcttgtcggccctaacggaataggtaaatcgacattgctgaaaacattaatagacaccctaaaaccagatcagggaacaatttcttacggctcaaatgtcagtgtcggctattatgaccaggaacaggctgagttgacttcctctaaacgtgtccttgatgagctgtgggacgagtaccccgggctcccagaaaaagaaatcagaacgtgtctcggaaatttcttattctccggagatgatgtgctgaaaccagttcattcactgagcggaggcgaaaaagcaagattggctctagctaagctgatgcttcaaaaagccaactttctcatccttgatgaaccgacgaaccatctggatttagacagcaaagaagttctcgaaaacgcgctgattgattatccaggcacactgttatttgtctcacatgacagatattttattaacagaatcgccacaagagtattggagctttcttcaagccatatagaggagtatctgggagattacgattattatacagagaaaaaaacagagcagcttgaattggagaaaatgaatcagcaagaggaaactgataaaacgccagctacagtgaagtctgactccaaacgttcctacgaggaagaaaaagaatggaaaaagaaagagcgccaacgactccgtcggattgaagaaattgaaaccaccgttcaaaccattgaggagaacatcagccgcaatgatgaattgctatgtgaccctgaagtctatcaggatcatgaaaaagtacaagctatccatgcagacaatgagaagcttaatcaggagctggaatctcttttgtccgaatgggaagaactatccacagaagaagattaaaaaagtcaagcacctctttttagaggtgctttttatccacagaacatcccctaataaataaacaaagtaagcgctttatacacactatccacaaaatattctgaatttatccactttattaacagtgacctcagccctttatccatcaatatctctataattactcacagatatgtggataaattgtgaattgtctgttaataacaaacagataaaaagtctcacgctattatctcgtgagactttgataagaagtcaattcaaggccgggctggccattcatatcatatgcaccgcgaattcctttttcaaaagcaattgtaccagcagcagcaatcatcgcagcattatccgtgcataaagctaatggaggaatgacaagcgtaatcccttcatgctgggcaaattccttttctaatgcagctctgaggcctctgtttgcagctactcctccggctaaaaggacctgtttgacatcatattcctttgccgcgcgcgccgttttggttaccaagacatcgatcacactattttggaaactggcagacaaatcttccggagcaatctcttgccctttttgggatgcattatgaagcgtattgatcaccgcagacttcaatccgctaaagctgaagttgtaagagccttcttcaagccatgcgcgaggaagcggaatattgtcattccctttttcagctagcttgtcaatttgcggtccacccggatatggcaatcccatcgtccgcgccactttgtcgtaggcttctcctgccgcatcatcaagggtttccccaatgacttcaaatgatccatgttccttcatataaaccagttctgtatggcctcctgaaacgaccaatgccagtgccgggaacacgatgtcttctacaagacggttcgcgtatatatgaccggctatatgatgaacgcctactaacggaatgttatatgcaaagctcaatgctttagcggcattcactccgataagaagcgctcccaccagtcccggaccttctgttactgcaatcgcatcaatatcactatacgtcatgccagctttgcgaaacgcctcttctataaccaaagtgatttgttcaacatgatgtcttgaagcaatttccggaacaacgcctccgaagcgcttatggctttcaatttgagaggctactacgtttgaaatgatctctttcccgtttttcacaatagctgcagcagtctcatcacagcttgtttcaattcctaatacgtacatgtctttttgctcactcatttatcgtcacccacataattaacgcatcttccccgttatcagtataatagttctttcttattccgccgggctgcatcccgaatttcttatataagccttgagcaggatgattcgaaaccctcacttcaagcgaaagccgccttgcgtctttttctttgcacagttcaacagctgagcgaaaaagcgtttctcctaaagactggccgcgatactctggttttatcgctatatttgtaatctgggcatcgtccatcacaatccaaatcccgcaatacccagcaagatggccgtccttttcaatcacgagataatgagcatacggattttccagcagctcatgataaaacgaatccttcgtccaaggagacgtaaaggaggatgcttcgatttcgtatacgtgatctatatcttcaagccgcatatttctgaccgctgcttttgttttcatcctatcaccctacttttgactttcaatccatttcgcttcagcttctgccagccgcaagtaatccgggacaagcccatgaacatcagctgcttccttttccttcccgagaaaagccaattctgaagggcgcgggttatgctgggcggcagttccaatgaatccttttgttccaagcacatcctcgatcatctgcttgtgaagagaagtatcatggcctaaaaacaaaacagggcggtccttttcttttagcatctccagccaatctgccagcatcacattttgatctggaacaacttgctctaaaagcccatttttatattgatacagacctgtgtacacctgtccccgtctagcatcaaagattgggctgatcagaccgtcaaaatgccggccatttgccgcaagcgtctcaagacttgatacagcacttattggaatgtctaaagaccaggcaagtgttttggccaacgtcacacctattcttactcctgtgtatgaaccagggccttttgcaacgacaattttagaaaggtcctgcggtgccatatcacaatcattcagcaatgaatgaacagcaggcatcgctcttacagagtggttctttttcaaatatgtaatgtattctgctataacagtgtcttctcgaagcagcgcaatgcccaatgtataatttgatgtatcaattgctaatattgtcatgtctacttaactcctcacaaagcatttcataccgattcccgacagcagtaaaggtaatttcccgctcatcatcaccagctcttttgatgacaatttgcagtcgctcctgtggcagctgttcttcaattaaatgagcccattcaacgagacagacaccttgtccgtgaaaatattcatcaagtcccaaatcttcactttcatcttccattctatacacatccatgtgataaagaggaagtacgccatcgttatattcttttataattgtaaaagtcggactgtttacaatacgtgtaattcccagcccttctgcaaaacctttcgtaaaagtcgtttttcctgcacctaaatcgccctctaatgtcaggacgtctcccggtttagcaaacgctgccgtcagcttggcaattgcttttgtttcttctggatttacagttctccattttaattgcttcacacgagtcacccgtcttatttaaaatgattatatccctttttctctaagatcattgatgtttgatctgtttttaggatcactttagattttgttttttccctgacatagccaatctttgtaatgggaagatgaagcgctgcgcactcctgcttcaacacttcccactcctcatttgaaaccgtccctgtcagctcaaaatcctcaccgccaaacaaagcccattctttccagttaggatgaagcttaggcaaatcagaatgaattggaagcatgctttcaacaatttcaattgaaacacagctggcttctgcaatctcgttcagttcactagccaatccgtcactaacatcatttaaagctgcccgtttaaaaatcgagcataatctgccgacgcttactcttggctcaggccgtttatgcctgtggataaagtaatccgtttccacagatgagttttgaggattagtctcttccagcaataaagaaagccctgctgcagaagaaccgatttcaccggttacaaacacaatatcattcggttttgccaagctgcgcaaacaggcctgtcccttttcaatttcaccgattacagtgactgtaacgactaatttgtcagcggtagaaactgtatcgccgccaatcagatccatatgatatagtttcgccagttcattcattccttcatacatcgccttgatttcagattcagtccattttgaaggtaccgcaagtgataccagataaaacttaggaatgcctcccatcgcggcaatatcacttatattaacggctaacgccttgtacccgatatcttcaggtgaggaatagtgtaatttgaagtgcacgtcttctaccatagtatcaacacaaacaatttcctgaacgccgtgtttcgcagtgtagagcgctgcatcatcacctattcctacatcaacggaagaatggtgaatggtccgcggagtaatgctatgtatcaaatcaaattcatccatgaaccaaaacctcctttcaaccctgcttatgcctatttgtgctcttcctagtttatcgaattttgctggaatatccaagatgttcccgatataaagaaagcttggctatgacaccaagcagaagatacagtaaaagaaaacacaaaaaaacgaaaacatgatcgtttcgtttacattaatggcggtccggacgggactcgaacccgcgacctcctgcgtgacaggcaggcattctaaccaactgaactaccggaccatatttgtataggattattttggttgcacccttagggcactccttatttaaccatatatttggttgcgggggcaggatttgaacctgcgaccttcgggttatgagcccgacgagctaccgaactgctccaccccgcgatgataaaagtaa

SEQ ID NO: 57 - DNA, 2966 bp, Bacillus subtilis WAUSV36; identical to SEQ ID NO: 41

SEQ ID NO: 58 - DNA, 459140 bp, Bacillus subtilis WAUSV36
tctgttcgctcgacttgcatgtattaggcacgccgccagcgttcgtcctgagccaggatcaaactctccgataaatggatcacaggttaagtccaccgcatcccgcggtgacacctgtgtgacctgcatcgtgcaggccctagtttgactgactacgcacatcgctgtgcgattttcaaaaactgaattaacaggtacgttttgtcttgtttagttttcaaagatcattcaataatggagcgggtgatgagaatcgaactcacgacatcagcttggaaggctgaggttttaccactaaactacacccgcgtggtatcttatatggcgcgcccgagaggagtcgaacccctaaccttttgatccgtagtcaaacgctctatccaattgagctacgggcgcttattgagcgacttaactatcatactatcatttgatgttgaagtcaagaagttttttaatgttttttcgaatctttttcaattcgacttttcttattatacacatttttaaaatcttgtaaacaccttaggaaaacttttttgtttttctgttttgtttcacgctgttcatcagcgacgtttaataatataccatgcctgttttatttggtcaacacttttcctgtattttttattttcttctttcacgccttcccatgcttatcatgtatatattttatctcatcttacaaataatataagaaaatctcttaagaagaaatgaggcgtgttatgtattactacaaagaggaactgattaatatcattaaaccggacaagccagacccggcagctgctaaggtcctgcaggagatattaggcggtcattacggagaaatgcgtacaatgatgcagtttttttccaaagctctaatttcagaggaaagcagaaacagtaccgcgatctgcttcgcggcatttttttagaggagattgcccacgttgaactggttcaaaacacaatcaatgctttattagatgaatcaggcggtgaaggtgtcggcagtcaaggtacagatcaagcgccacttgatgaagcggttaaacatgctaatcctcatcattatattattggagcgcaaagttcccttcctgttgatgcagggggcaatccgtggaacgggtcgtgggtgtataaccacggaaacttaattactgacctgctggataacctgcttcttgagtcgacaggtgtgctgcaaaaaacaagaatttatgaaatgagctctaatcagacgttccgcgaaacacttgcttttctgattgtacgcgacaatgctcaccagaatgcattcgcgaaagcgctcgagacattgggcgttgaatgggcgaagctgctccctgtgccgaattatgacattaataaatatcctgagtgcagaaagtatgtcgaattaggctaccataatacacattttaactttaggttggatgaaacgagaatcagtgaaatctatcaagggaaatctccaagccgaaatggcggagagttacaagtaatagatcctccggcagggtttcccgtaccagtgcttcctgaaataccaaatgaacacagtcctgggttaggcgatatgaatgcttaatccagtgggaaggtgctcaagaaacttcttgagcaccttcttaattgtgacattacggattcactcaacgattggcgttaaagaatcaccattccatatttctcccttgttgagtgtccagctgtcatgatataaagctgaagcacccttgtttactgctgcgctccattcatcattccatgccagaaagtaaatggttttaggatatttttgttttattgcattgatgaacaggctgtaatcgaagctgccgtttgctgtttgcgggccgacttctgtaaaagcaaatggtttattaagcgctgttagctgatcgtatccattgatcgagtaggcatcttgaaaatacgcatctaatccgacaatatccacgtaagacgcgcccgggtaaaaatcagttttaaaatctcggttggcgtcgggagagtaaacccaaatcaaatgatcaagtcctcttgtgtcggtcatataatgatagattttcttgtagagctgtttatatagagagattctttcattatccttttggttatatgatgtgagtccccaccaaaaccattcgccgttcatttcatgcagcggcctgaacagaacaggcacaccttggttctccaactcttgaagtccgtcagcaattttgctgagcatggcatttagccgctttccttctactgttgaagaatctagtatttttttatactgatcatttgtaatcggtgttttaaaatgccctgactgaaaagcagggttcgccaggtgcaaactgatttgcggaattccgccatttttccaatacgacattaaatcgccgttgcagcttacatctattgaatcttcaatatttgctgtttcaagccatcctctggcataatcgcagccataaatagcaggcgattgcccggtggcgcttcggattctatcagcctcagccatagaaaatgtgtcatggctgtaacctccgaacgctccggaaaggactctgttttccgttcggttcggcaggtgcgcaagccagttcatcactgtttttgttgtctgctgggcattaggattcacaggcgacacagtatgcgcttcaattggttttgctaaaacagcagacgcaagtaaaaatataatgagcaaagagatcgtatgtttcttaaacaaatgcaactcccccattcattaaggatgagatatcatgaattcacatgttccttctattgtaaattctccaaaatgcgcaggcagaataaagtgtgagcctgcattgcattcatactgaataccattatttatgattcgtcctgatccgctcagaacactccccagcaaataggtttgatatgaaggaaaagcagctcggccgctaatcttccatttgtacactgagaaataatctgattgcacataaacaatgatctcagcgttaccaacttcttttacttccggtgtatgcactttatcgatatgcggtatcgttatgacttccatggctttttctatatgaagagttcttttttggccctggtcattacagcggtcataatcgtatacgcgatatgttgtatcagagttttgctggatttcaaggacaagggttcccttacataaagcatggagtgtaccgcttggcacataaaagaaatctcctggcttgattttgattcgcctcagcagcccgttccaatcaccgctttctattcgttgtttgaactcttcctttgtgcttgcatgatgtcccaaaattagttcggcgtcatctttgcaatcaatgatataccagcactccgttttaccaaggtcgccattttcgtgcagttttgcataatcatcatcaggatggacttgcacggagagatccatattggcgtccagcagctttaccagcagcggaaacaccttaccatccggaaacccgaatatctctggatgatctttccatacttgatcaagtgtctttcctgccagcgggccattttttacagacgacgagccatgggcatgtgcagaaacggcccagcactcacctgttttttgtgagggtattgcgtagccaaaagcgtcacgaagcttcgtccctccccatagtctttctttaaagacaggctctaaaaataatggatgcgtcatgatcgcacctccccggatgctgcctctgcttgtaaggcctgatgcgctaaaactagcgtgccgatgattccggcgttactgcctaaacgtggaggtacaatataatcacttatatcatctgataattcagaaaaatctaagtagctgttcatgatttttggtacatattgatagatataagaaaacacttgtttctgttgcatgacgccgccgccaagaatgatttttttaggtgcaaggatcaaaatatactgagccagtgcttgggcaatatagtacccttccagttcccagacttgtgctatatctgataaatccgcggcttttttcccccagcgggcttcgatagcggggcctgaagctaagccttcaaagcaatctccatgataagggcacttcccttggtatacgtcatccgggtgcctccggatataaatatggcccatctctgggtgtgacagcccctgaaggagcctcccctctacaatagcccccgctccgatgccagtgccaatcgttatatacaggcagctgtcaagacccttcgcttcaccgaaaaggaattcacccagcgccgcagcgttgacatctgtactaaatccgactgggatcttcatttcgttcttaacggtttgcaaaaagggatagtgtctccagcccgctttcggcgtggccgtaatggtaccgtatgtttgactggttttatcgttatcaacgggaccaaaggagccgatgccgattgcctgtaatgaaaattggctaaaatattgaattactttctctatcgtttcatccggcatctttgtggggaattctatcctgtcaatgatcgttccatcttctctaccgacagcacaaacaaactttgtgccgcctgcttcaataccgccaagcatgcagatggcctccttgttgtctccgcaatcagcgccgtatgtttacagaagtcacaacaaacttgtcatgccgatgacgtgaaaaggaatattcaaatggaatcccggtatctaagaagcccacatgttccacttcaagaattggatcatcctgtttacagcccagatgctgctggtcaatatgatcagatttgcaggctctgattttccgatgcgttccggcgattttgagctgcagcacatttgtaatatgattgtagatcgaatcatgaaggacatcgtcattaatgcccggtattaaatgagtcggcatatatgttttttctaatacatagggttcaccttctacaattcgcagccgaacgacataataaaccggtgttttctgatcaatagacaaatgggcggccacttcctcagtgggaaattgcacttcaaactgaatgaccttgcttttgatttttttatctttcagcaagttggtcaatccgagaatctcattgctgactacatggacatggtcatcctgtattgcagattgaataataaacgtgccatggcctcgttttctaaacagcagaccctcggcaactaaattatccaaggctctcttcatcgtcatgcggcttgagttaaattcttttgcaagagatacttcatcaggaatgggctgatcgatcggatatacgttatttttaattctatttctcatttcatttgcaatgatttcgtatttattcattggtatcctccggcagctgtttgatatcacataagcttttacggatatcataagttcttttccctatttcatcaatgttgcggattttcgtcatctctattcgttatgatgattgccggaagatcttgacctttaggaaaatctagaaaccgctatgctcagcaacctctttgaaccattttccgctctttttgacggttctttctccgtctttctcaagattgactgatacaaatccgtatcggtttttataggcatttgtccaagaccagttgtccatgaacgtccataagtgatagccttttacgttcgagccttcctgtatggcgcggtgaatccatttgaggtgctcttttataaattcaatccggtaatcatcctgaatgatgccttgttcatccctgaatcgctcttcaccttcaacccccataccgttttcagagataaaacactcgatgttgccgtagttttcttttaaattgatcaaaatatcataaacgcctttttcatagatctcccagccgcgatgcggattcattttgcggcccggcatgacgtagggatcaaaatacctgtccggcaaaaaaggagcgtcgggattcggaagatgttctttcgctttcacacgtctcggctggtaataattcactcccaacaggtcaaccgtgttctttttgatgatgtcgagatcttcagcgttgtaatcaggcataaagccttcatgcttcaaaatgtcaaccagctctttgggaaattcgcctttgacagatgggtctaaaaaagatctgttaaaaaacgcgtctgcgatttccccggctttcacatccgccggatggctgcttctcgggtatgaaggggtcaaatttaagatgatgccgatttttccgtcctgcttcatctccctgtaagcctgaatggcgcgggcacttgatagcatcgtatgaaatccaacctggacggcctctttaaaatcgaccttgtttggataatgaaaatcatataggtatccgccttctacgggaacgattggttcattatgcgtgaaccattttttcacccggccgccaaacaaacggaagcaagttcttgcatagttttcatacgcgtcaaccgtctctctgttgacccagccgccgattttttgaagcgccatcggcatatcgaaatgaaacaaattgacaaaaggttcaattccgttagcgatcagctcatcaatgacattgttatagaaatctgcggctttatcgttgatctcgcccgttccgtttggtattaaacgtgaccaggaaatcgacatccggaacgagttgtggccaagttccttcatcagcctgatatcttctttatagttgtcgtaaaattgggatgtgtctgcgggtccgacatgatcaaaaaaacgatgcggttctttttcaaaccaataatcccatatattctggccttttccgtctctgtcggcggcaccctccatttgtgttgctgaagcggatgatccccaccaaaaatcctttggaaaacgatattgttctgtatgtgccaagtctctctccccttatgtcacatttttatgctgttatcattttgctgagcagctgtctcctgcacagcctgttctttttcttttgccagatttaatttatccattgcttttaggaacggaaaccagatcacgaagacaatcagcagattgataagctgcatcacgccccccatgattgagttcgtcgccatgatgccattaatgaataatggaaccgtccacggcactgtcacaccagttggaggcggaacgagcccggctgacatagccagataggtgacgagcgtaacaaccatcggtgccagcacccaaggcacaataatgatcggattcatgacaatcggaagcccaaagataatcggttcgtttacgttaaaaataccgggagcgaggccaagttttgatacttgcttcatctgcctgcttttcatgaatatgagaatggtaaacacaatcgcaagcgtcatccctgttccgcccatccctactgtataaatctccataaacggttttgaaataatatgagggatttcttttcccgccgtgtaagcagaaaggttttctacctgcagtgtattccaaatcgggtccatcacggagttgataatgatctgtccatgcagtccgaaaaaccaaagaatttgaatgaaaaacacggcaatcagtgttggaatgataccgcttccaagtccgacaagcggagcctgaatcgcatgataaatgacgtcgtgcatatttgttttaaaaaacagagtcaccattacgttaatcagcaaaaatacagtcaatgtgataaaagccggaataagtgcggcgaatgattttgctacagcaggcggaacgccggctggcattttgattgtcaggtttttttgaacgattcttctgtaaatttcgccagaaagaaatgccgtaatcatcccaagaaacatcccttttgcaccgagacgatcgaccgggataacccctgtaatggcatcacctgtttccggctgaatgataaatggcgttaagagcaaaaaggaaaccaaagcgatcgctccgccaaatacagcttcgacctgatagcttttcgacaggtaatagcctatcccgaacacaacaaagacagacataatgcccattgtcgccgtggaggcaatgccgaaatgagactgaaacgacgtaagcattgaggcgttcatgattttgtttagaaacggcaaattcgttaacacgacaaaaatggacccgaatatcgtcagcgggaaagccagcataaatgcatcacgcaacacttgcaaatagcggttattgtttaacctccctgcaattggaacaaggaattggctgattttctcgaacaccctatccaccccgattttttatatattcttggttttaaagagatcaagcatctctttcactaattctttcatggataatgttgacatcagatgatcctctgcatgcataagcagcaatgaaaaagctgttgcttctccgccggattccttctgtatcatttgaaagtgaatgtcatgggccgcggataaatcctgctccgccttggcaatgagggcatcagcctcgtcctttttcccttctttataggcgcgcagtgattgtatgatgcagctgcgggcatttccgctgtgcaggattagctgaaaactgatttgctcgtctgttaaattcgtgattttcatctgttccattattgattcaccattaaggacaatgcctgctcatacgcttttttcccatctgccattccgtaggccatcatgtcaatgacttcaacttgaatgttgtattgatctgcttctttttggagctcgcttttcagaaagctcatttgcggaccgatcaaaacggcatccgcttttctcatgtcttcttttgctttatcctggccaacagcccaaatctccgcttcctcaccgatagactgtgcgtattccttcatttttgtcaccaataaactggtagacattcctgaactgcacgcgagtaatatttttttcaactgctatcccccctgttattaaaacgcttacattgattattatagtcatttaattttaaatgtctatacttttataaaataaatataatcatatttttttccggttcaccgttttataaatttttctatggaagattcattcataatgtggtacactcatcaacggaaacgaatcaattaaatagctattatcacttgtataacctcaataatatggtttgagggtgtctaccaggaaccgtaaaatcctgattacaaaatttgtttatgacattttttgtaatcaggattttttttatttatcaaaacatttaagtaaaggagtttgttatgaatttcaaagttttcctgcttgcagcttctacgattgcagtcggattggttgagttaattgtggggggaattcttcctcagatcgcaaatgatttagacatttccattgtttcagccggacagctgatcagtgtgtttgcgctgggatatgcagtatctgggccgctgcttttggcattgactgcgaagattgagcggaagcgcttatatctaattgctttatttgttttcttccttagcaatcttgtcgcctatttcagccctaatttcgcaacactgatggtatctagggtattggcagcaatgagtacagggctgattgttgtgctttctttaacaattgccccgaaaattgtagcgcctgaatacagagcccgcgcaatcggaattatttttatgggattcagctctgctatcgcattaggcgtgccgctcggaatcttaatcagcgattccttcgggtggcggattttgttccttggcatcggcctgttggcactgatctccatgctgattatttcaatcttctttgaaagaataccggcggagaaaatgattcctttccgggaacaactcaagacgatcggtaatctgaaaatcgcgagttcacacctcgtcacgatgtttacattagctggccactacacgctttacgcttactttgcgccgtttttagaagagactcttcacctgagctctttctgggtcagcatttgttatttccttttcgggatatctgctgtatgcggaggccctttcggaggagcgctatctgaccggcttggttcctttaagagcattttgctggtgaccggttcctttgccatcattatgttcttactgccgctgtctacatcgtctatgattttctttttgcctgtcatggtgatttggggtcttctgagctggagcctcgccccggctcagcaaagctatttaattgaaattgcacctgattcgtctgacattcagcaaagctttaacacatcggccctccaagtcggaattgcccttggctcagccattggcggtgttgttttggatcagacgggtactgtggtgtcaacggcatggtgcggcggatcgattgtgatcatcgctgtcctgtttgctttcatttctttaacaagacctgttcaaacagcaaaaaaatcctccttgtaaaaggaggattttttattatttagctgaaagctcatcttctgtgacccatttgtggtttttcactttttcgccgctcgttgtcgatgtgtagtcaaccatgtatacagttgttttttccgcggaatcgatctcggctgttgctcctttcatgcctttcatatgagaagcctctaaaatcacctgatctccgggttgtaacgttttatctccggcatctttgatttcttcttggatcacccatttgtgatgatccacacgctgtcccccattagtcggagtataagaaacaacatacgccgttgtatcataggcgcctgttaccgtagcttcagcacctttcatgcctttcatatgagaagtattgatgattacttggctgcctactttgtatttcggatttttagattcctgtaatccctctggaacgtcagctgatccggaatggtccatctcttcatgtgttgaggagtctgaatgattgtcatgtgtgctttctttcgtactgttgttattgccgcatgctgataaaacaaaaactagagataacatcagaattcccagtgcatatttagagattttcatgttcattctcctttgcttcatttttttcctgtaacttttgcccgcagacaatgaaaacatgccctctcgataatactatacccccgaacggtatgtaaatacgctgatattctcataaagcgttcccgcagtttgtcctattcccctttgtttgcaaagccaaacataaaaaaagccgctgtcaggcggcaattactgctttaagatttttatatacacacctttttttgctttttgataagcggcctcacccattttcctcaccttttcagaaacacctgaggatttgatccatttgtcatcaagaaaaatggatggatcgattaggcgcattttcttcttttgatggaaatcgtactggatgtcatcctctattacttgtatgccgggatgaatggatgtaagcaagctcaggacttcttcattttttgatgcacgcaggatgttcagtacctcttggtccgttttcagcagatcctctgcagatatgacatcatgccgcagcgctgccttcaatgctcgcgctaaatattcatatccatatacattcacaggattcaaaaagaaatcaattacttccttgtagtacacactgacaaaccattcggcggcttcaatactatcaggaaacatccttccgtttctcacaataagatgatccaaaaaggtttgcgcttcgtgcaggttaatgtgtccatatcggtacatatcacgcagcgtatagtctgtccgatcagcacacagctccggtgcgggctgttcgagcaatgtccaccttgaatcgtcagataaaagttcttcagtatgatagccgtgtttttgtaaaatgtccgggatttcagagtgaacaatgacttgttgaaagatgttttcatgatagtcttctgcttgattttcaaagacaacgtcgaccacatgagaaaaagctgtgtgtgatacgtcgtggagcagacccgcaatctgttcttctatcgttcctccgagctttttgatgaggagcatcacgccgatggagtgctcatacctggtcacattccactttcgattgactaaaaagcttgctccgccttgatagattccttttaatctttgcacaggagcgcttttgataagctcttccagcactccgtctatatggtgctgcccgtaaatgatatcgctgatttccatgccgtcacctcaacatctatttttttgttatatattgtttatattgatagtacatatgcaatctttcaatagaggagtgttatgatgatcatcatcccaaacaatgagatagcgaaacatatgttgaccgatttttttgccaagcattggggtacacccgagatggcgatttccagcggcatttttcggtgtgatgaattagatggatttgccgcagtaaatgaaagcggcgaaatcattggctgtattacatacacaatagatgggaaagattgtgaaattatttcattagatagtatgattgaaaataaaggaatcggcacagctttacttcagcaggttgaagagaaggctaaacatgcacattgtcaacgaataaagcttatcacaacgaatgataatgtaaatgcgatagcgttttatcaaaagagaggctatcaattcgccgcagtgtttccgaacgcagttgaaaaagcgcgccgactcaagccggagattcccgaggtggctgaaaacggcattttgattcgggatgaaattctattttcgaaggtaattgattaaacgaataggagtcttttatgtccagtcattataaataccctctcattttcacggcattcctattaatcgctttctgcttgatctttttttcctatcacctgattcatcatgttcgtttggagtatccaaattggcagggagaaagcaaagatcagaattgggaagctgttttcacaaaaaatgaagatgcaccgaatgaatacagcggcaaactttattggatcggtgatacaattgaaatagacaacacttatctggaatcactgattgtaaaaaaggatgatgaagttctgctgagttctgacacggaaatcccgatgcatgattatgctggaggcactttttctgatggaagcgcaaaagaaaagtccgtttcttttttagagcggttagatgaacatgagcttgaaggccatgatattacgattgaagtgaaatggaaacaaggtaatcattattctgcgagtcagcttacgctcaatgaaaagaccttgtttgatgaaaagcagcaatagatgatcaaaacgaaaaatagacaaatgaaaaggcgtaacatattttatacagctcatatgttatgcctttttcttcatttccgccaaaaagtggagcagtccgccttgtccagaatattaaactcaatcattttctcaagtagcgtataatcaactggaccgttccaagggatacgtatcagctgctcggtgtaatcatatccggccttcacaatatcatcctctacgtgcgctatcgttactttttcaggagcgacagctaaatgctttttagaaacactaaagccaataataaatgtaccgtgatccgtaaacatcggctgattccattttatttctgtatgtaaatttggatatttattttttatccaagttaacacctcttccgttctttctcggtggaacgggtcagcaatccccgctaagtactcagaaaaaacgtccatgttgttccctcctaaaataaaatgatgccactccatatgaactgctcagacatgtgcttacacaatacctctttccaacgtaatactttaaattgttcaagatgtaagcgggttgcttctatgcgactatagcagatttcagtccgcctatccacggccagtatctattcctccaatttatttctttagtactatcgctctttccttctaaaacttctcataaaagaataaccattatttaagggtgccagttcattattcttgtaaatccaatctttaaaatcgattaatactagcttaacagtttaaaaatataattgggttgtcattgagattcatctatatttaggaggttatccagttgaaaaaattcccgaagaaattactgcctatcgcggttttatcatcaattgcgttcagcagcttagccagcggcagtgtgcctgaagccagcgcccaggaaaagaaaaaggggaaccaagacgaaattaaaaatgttattgttctgattggtgatggtatgggtgtgtcttatacgtctgcttatcgatacttaaaggataataaaaagacaaaagttgtggagcctacggcttttgatcagtatcttgtcggccagcaaacaacttaccccgatgatcctgaacaaaatgtaacggattctgcagcggcggcaacggctatgtctgcgggaattaaaacatacaataatgccatagccgttgataacgacgggtcagaagccaaaacggtgcttgaagctgcgaaagaaaaaggaaaagcaacaggacttgtggccacttcagaaattacacacgccactccggcctcttttggttcacacgaccacagccgaaaaaatatgaactcaattgcggatgattattttgatgagatggtcaacggcaagcacaaaattgatgtccttctaggcggaggaaagagcaattttgaccgtaaggaccgtaatttgattaaggaattcaaaaaggcggggtacagctacgtggatgatcgcaaggacatgctgaaaaacaaagacagccaagttctcggcctattcgctgacggcggcctgcctaaaaagattgaccgtacgaaggatattccatcacttaaagatatgacaaacacagccattaaaaaattaaacaaggataaagacggattcttcctcatggtggaaggcagccagattgactgggcgggccatgacaatgatatcgttggcgccatgagcgagatggaagacttcgaacaagcttataaggcggctattgatttcgctaaaaaagacaagcacacattggttgtcgcaacggctgaccactcaaccggcggatattccatcggtgcggacggcatctacaactggttcagtgaacccattaaagccgcaaagcgcacaccagactttatggcagaaaagatcgctgacggcgcggatgttgaaaaaacgttgaaaacatatatcgatcaaaagaaattggctttaacaaaagccgaaattcaatctgttgaagaagcggcaaaatcgaaggaagtactggatatcgataacgcaatcgagaacatctttaataaacgctctcacactggatggacaacaggcggacataccggtgaagatgttcccgtctatgcatacggtccgtctagtgagacatttgccggccaaatcgacaatacagaaatcgccaaaaatgttttcaaggctttacaatacaacattaagattaacgataagtaaaagaatacaaggtgtcccgttgcttgtatgaagtaacgggatctctttttaatggaggaatcatcatgagaagaattctttcaattctcgtttttgctatcatgcttgcgggctgctcatcaaacgccagtactgaaaaacagcatgcaggcggggagaaaacagtaaaagctgagccgcaaagcacttcatcccagaaggacagcacagatgattatcagcctaattcccaggtaactgatgaccggacattgcataaggtcggccaaacgttttcagatgataaaggaaaagctgtcttaaaagatatcaaacaagtgaacaaaacctataaaattggcgacgtggagttaacagtaaaagaaatgaagctgatccacttgcgcccggactacagcatgattgattactttcatgagttaacacacgatgaagagtttgatttcgttaaggttttcgttgatatcaagaacacctctacaaaaaaagtaaatgttgcgccgattgcattgatgaaaacaaatacgggtgaaacctttgattggaacaaagatatttatcttgaagagttaaacggcgaattggaaggcggcgccgaaaagtccggaaatctcggctttattgtgaacgcatcaagcggccatgctcatgataaggccgcggatgctgagaagaaaacaaaagagatcaagtggatcgaaatcacgacaagtgacgtctttgaccataaccataagaaaatcagtgatgctcaaaaaatcaaaatcaagttttaaatcaagaactcccgtacaaggtacgggagttctttttcttatttgtttttttggcgaatcaactcatcaatccgctccatcacttcttccatgtccatacattctttgaagctttgattgatttttttaatgcctgccgtatactgatcgttgcgcaaaacctcatctacggcctgttttaatatttgggcattgacttcatctttagagatgacatagcctgcatggagttcagagagacgctgcgccaccatcggctgatccttgtcatgaggcatgacaaccagtggcacgctgaaatgaatgccttcgtttacgctgttcattccgccgtgtgtaatgaaaacatccgattgctccagcacttccagctgagggacatacggagcaatgataaagttttccggcgcctgctttaatttggtcaggtccgctttttctccggcagcgatgacgacttttccgttaaagcctgaaaatgcatcaatacaaaggttgaagaaatcctctgtatgatccagtacagtccccattgaaatataaatgaccttctcatcttttagctgttcaatcgggaaatctgttttttccgctctctttggaaagctcggcccgataaatagacattcatccccgaaacgatcactttctggctgaaaataacggcttgtatacactacgttcaattcccctttattgttcatgaattgaaccaggtttttcggggcaacaccgtacgtttctttcatttttgccaaaaggtcttcgcactcttgatccaattcaagcggcgctccagactccggatgcagcggcaggattttcagatgctcctcgccaaacaggaaagacgccgatgaagagacccctggaatatctaagtaatccctcaccaattcccccgcgccgaatttatcataataaacaaaatcaaattgaatgctcttagataagtctttgacaatctgtaaaatgtccaatgacgttttgatatggattttcacgaaatcaagaatgccattgggcgaaccgacatgaataggtgtcgttcgcagcagatcccggtgaagatggaccgttgctcccgctgcttctaatcgttttttatatttttcagtggatatataatggacatcatatcccttatcggaaaacgctttcgtaatgcctaaagtaggattcacatggccttccgcaggaaaattcaaaatcaatactgtcttcatgtagacaactccctctcaaatcgtattctgactctttgtttgatcagactactactaatcgtaaaatgggaacacaacccatgcaaggtacaaatgaatgaactattctgctgctctggacttaatcaaaaaaaagacacccaagctctggtgtctttttttacacttttctgatcgtaaaaaatttccgcagaagccatgggcccggcgtaaagcccagcgttaactgccaagcgccaatagcctgcaatctgtattcacggacgatctgcatcttccggctcatgcttctgacatcctcaaaccatacctcatgcgtccgcccctgctgatcactgtaccggaaaaacggtgattgatattcggctgaatattgtatcggggcttggtacctcatcgctctttcgattgcgttttgatttgaaatcgctgaagcaactgtgcccggctggtacgggatgatccagtcgtacccgtagagcgggactccgataatgatttttctgctcggcacctgcgcaatcgtaaactcaatggttctccttatttcagtaatcggcgctacaggacccggctcacttcccgcatgatgccaatcataagccatgataaacatataattgacaaccgctcctatccccccgtaatcgtagcccctcagccatgggatattatcacttgtttttgcaggaacagctatcgtcagcacataccctcccgcctgaagtcgatctctcagctggcgtaaaaatccagtgaaaagatcgcgatccgcggcgctcacctgctcaaaatcgattgtgacaccgccatatccccttgtggaaactaagtcataaatgttgttgaccagattggttctcgctgtcggattgtttagcacttggtgaacaatctccgtactgaagcctcctgatgtaaggttcgttattgttgccagcggcgtgactcgtctttgccaagttgtctcaatagcggccgcatcattcaattggtttgcaatgtcgccgttcggtgcaatatggtattcgaaaattgaaatcgaagacgagtatggcgcataatcattgattaattcccgatcgaggtctgggtttcggagcacataaaaacttaacgttcccgcaatgtaatttgagatcgaaggaatcgttatttttgctcccgcttgtaaagcatttgggctgatgcccggattggccgctcgcagtcgctctaatggcacaaacgctttagctgcaatggcggtaagcgtatctctcggctggactgtatatacataaagagggataagcagagcctgccccggcacgatattcgtttcatctaaaccattcacaccccgtatttgatcaacagaagcaccgtatcttctgcctatcgaaaacaaagaatcaccaggcccgacgatatggataaacatatttaacccccattattcgttagtcaaaccatcataaaatcttattaacggggcctcttagatatgtggtgaatacataaaaaaataccaagggttctgctctcccttggtaccggatcatacaaatcaattctctttaccttcttcaagcacatgcttcaaatgctcacagtcatgattgaaatgagccagcacatgttgtttggctgcttctttgtttttctttttcacttcttcaaatatcctgcggtgctcacgcagtatcgtttctgcgcggtggtcgccggtataattaaggattctgcaaaaatgaatcaggtcatttacatgctcaagcaaatttttcaaatgtctgttatggctgaaatcaaccagcagctcatgaaatttttggtttaaacgaatgatttctgtatcttccgtgccgttgtgaatcgctttctctgtttcttcaagctgtttttcgagtatggtcagctcttcttcgtccgcttcgtctatgactaattcgactgccagctgctccagcggaattctgattttataaatctcatctacatcttttgccgttaacgacgtgatcgaaaacccatttcggtcatccgcttttaacaaaccatctttctcaagcaatcgcatggcttcccttatcggagagcggctgacgccaaagcttttcgccagctgtgtttcgtttatccgttccccaggcttaaaagtcccgttgaagatcattttttttagctggttataaaattgcaggtagtagggagtcggcttatctaatttaaaatcgtccatatataatacctcttttgaatatattcaagggcttttcttcatcaaaatcatataacagatggtaatgggaagcaacaaactgccttgtcagatccctgaatttgaggtacgatatgtttgctgaacgacggtcgacggactactggcaactgaaaaaacggcgtgtttttcttcgtcaataggacaccatacctccgccagaatagcgcacgattacatttttacatcttttcaatggaggaaaaaatatgctcattattcttgttatgtttcttctaggaattattttaggctttattggcgccggtggagccggctttgtcattgcccttttaacgcttcttttccatatcccgattcatacggctttaggcacttcgcttgccggcatggcttttacaagcttatcaggggcatacagccactatcgcgagggtaacattcaaatgaaaatcggcttaatagtcggaggctttgctgcggttggctcatttttcggcgccaagctgacttcttttattccggctgatttgcttcattatttgacggctggaatgttatttttatcagcaattctcattttaatcagattatttattttaaaagagaaggctcaagtgaatcaaagcactctttcaacgtatacgagagcggtcatcttaggaattgcagccggcgttctttccggcacattcggcatcgggtcggcaccttttattcaaatcggtttaatgattatgctgaatctgtccattcgccattctgtcggaacgacgatgcttgtgatcatccctctggctgtaggtggaggcatcggatatattacagaaggttttgttgattacgttttacttgtcaaagttctggtcgggacaatgtgcggggcctatgtaggcgcgaaattcaccaacctcatgccaaaggtggttttgaaatcagccatctttttgactccggcgattgcaggcctgctgttgttattctaaataaaacaaaaaacctgacgtcatgtcaggtttttttatgaattctgccctactcgttctttcgttaatccaaaaaacgccagtgagccgatgacagctgtcacaaacatgatggctcccatcggaacggctgttgtctcattaatgcctacaagcggtgacacgattgaaccgaggagcagcggaagcattccaagcagcgcacttgcacttccggcgcggtgcccctgcttttccatggctagggtaaacgtgctggtcagaaccatgccgatcgtaatcatgtaaatgaaaatggatatgactaatgtagcaagaggaccgtgaatcatggtcatggttaatagcacagccgtcgcaatcatagccgtaatgaccgctatacgaagcaggcttttttcatgaatgattccgccaaagcgtccgatgataaagctgcccgatataatcgccagcccgttaatgccaaaaagaatactaaatacctgcggagacaccccgtagatatcctggtatacaaaaggcgtaccagacacatatgcaaagcttcccccgtgaataaatccgacagttaacgcgtaccccataaaggatcgatccttcagcaggctgcccatcgttttgacggatgttccgattgagcttggaatccgtttttccagcggaagcgtttcttttaacctcaatgcaatcagaagaactagtaaaaatccgatgatcattaagacgtgaaaaattgtatgccacgttgcgaacggcaaaagcaaaatggcaccgcctgtcataggcgcaaccattggcgccaccgcggtaatgaccattaacagcgagaaaaatttagaaagctctcttccggtaaacacatcgcggacgattgcgcgagacagcacaagccctgcagaagcagtgaagccttgtaaaaaacgcgcagccactaaagttgttatattgggcgacagtgcacaaaacagagaagataacgcaaataaaaaaatacagattaatagcggttttcgtcttccctgcgcatcgctgaccggcccgacaatcagctggccgatcgtaagcccgaccagacaggctgttaaacttaactgaacaagtgaagcacttgctgataaatctttcgcgatttcaggaaaacttggcaaatacatatctatattaagcgggcccaatatagcaagcatgccgagcagaaacgctagtgccaagcgttcttttccagttggattgtgcagcatgttatcaaaccttcccttcaacctagtcccttatataatggatgtcagctccaactatggattgaagctgtgaaacatttgtatattgtatcataactttcagcctgtgaaagccgcttgagcacgggccggcaaagtgatattccgaacacctataaatgggaatgatgcagggaatcatcgtgaccagcatcatctgaagaagcggccagctttttttgctaagttctagcctagcgaattttatgcgctgggaggttgttcaaaagtgcaaatggcttgcaagatgaaatcaatcgttgtatattaattgacgtgtcaatcattgatatatcaattaatagttttgacaggaaagaagggatgggttttggcgtcattttgttcagaggaagccgagattttatatcagctgcaaggcgtgaacaaggtgattggcgtgaagttcgaggcatgcacgggcatcagccaatctcgtttggaattgctgacattgctttatcatgcagatgagatcagtcaaagcgaccttcaaaagaaagtaaatatcgatagcgcagccgttaccagacacctgaaacagctggaatccaaaggcatggtatcaaggcggcgcaagcctgaggacaaccgcatcacccttgttcggttaacagaccaaggaagagagcgaattgagtcttctaagaaggaaaaggagcgtttcatgaaggaaatgctcgcaaatgtaagcgcagaagaacgccgcctgctcattgatgtgctggcgcgcatgcgaaacaatataaataatatcgaagcttaagaggagtgtatcaacatgatcaaaacaaacgattttatggaaattatgaaaggccgccgttctatccgcaactatgatccggcagtaaaaatcagcaaagaagaaatgacagagatcttagaggaagcaacaactgccccatcttctgttaacgcgcagccatggcgttttcttgtcattgacagcccggaaggaaaagaaaagctcgcaccgcttgcaagctttaaccaaacacaagtcacaacatcatctgctgtcatcgctgtatttgcagacatgaacaacgcagactatctagaagaaatctattcaaaagccgtggaacttggttacatgccgcaggaggtcaaagacagacaaatcgccgcgctgaccgcacattttgaaaagcttccggcacaggtcaaccgtgaaacgatcctgattgacggaggtcttgtttccatgcagctgatgctgactgcacgcgcgcatggctacgatacaaacccgatcggcggatacgataaagaaaacatcgcggaaaccttcggattagataaagaacgttatgtaccggttatgctactttctatcggaaaagcagcagacgaaggctatgcttcctaccgtctgccgattgatacaattgcagaatggaaataaaacaaagagcccgggaatgttttccgggctctttgtttttaagtacagccgccgtttgatcgtctgatctttttgggtaacacgtctgaagttagtcgtttagtcatgaaaaaagagtgatgaccattcatcactcttctctcgattactcttttcctttcttcctgccgaacggccaccagtttccttctccaaaggtcgcaatgattgccgggatgaagagcggaagtatgacaaggccgtaaagcaagagcccgatgatgataacacttgccacctgcatcagtgtattgacacctgaaggcatcatcgccgcgaacgtaccggccaatataatggcagctgtaataatgacagatcccattttgctcattgacctgacgacaccttgctcaatgccaaggtgcacctcttccttaaatcgatccagcaagaagatcgaataatctacccctaacgcgatcaagatgacaaagctgaagaatggcactgcccagctgacacccgcgtttcctaagccgtttacaaaaattaattctgttatggatatcgacgtatagtacgtcagcagcaatgacgcgatcatataaatcggcatgatcattgagcggaacaaaatggttaacacgataaacaggcctataatcataatcaccattgttctggagaagtccgttgtggatagctcctttaagtccgcattcatactcgtgaccccgccgtacacgatctgtgcattctccaaaggagtgccgtcaacttcgtttgcgacagcttttttgatttggtttattgtcgtaatagcttgttctgagtacggatttgaatccagaacgacacttaattgaacacctttgccgtctgcaaaggaatactggtcaattgacttcttaaagtctttgtccttcattacttgatcaggaatgaatatgccagtatctcttacagttggacttttgctcatgtcctctaatatatcactggaagctgtaataccgtcagagactttcgtcaggccctcatttgcgcttttcacgccttcggacagctttttcaggctttctgtcagcgttccggcttgtgcctgctggcctgagagctgttggttcgcttgttcaaggccggtttgaatctggccaagctgtccgcttattgccgtaagctgctgcacggtctgtgcggtattgccggtttgggaaatctgtttgctcacgagctgcagctgctgattgattttgcccaagccatctgccgcatcgcccagtgaaccgccagaccctccatttgaggccgagccggtttgccctgccatttgattcagtccgttttctatatccgttaatccgctttggacatcggcaatccctttcaccgtcttatccagcccgtctgaaaccgatcctagctggttatcaatatataaatctttgatttttttaccagtcggctgcgtaatggtcataacagagtcaacatgatcaactttctcgatcgctttgctgatatttcctagataggggattgtatcagctgttgtaagatctttgtctccttttacgacaacattgatcgggaacgcttttccttccccgaatccatccttaatggcctcgagagcttttatagatttataatcgctgctgatttccgcagttgagtcgaatgaaatctggtcatcataggtcaagatgaacggaagcgtaatcaccaccgtgatgacaatgaacagaaacggacgcgcaacggagtgtctgccgagaaacgcccatagtttgttatcactgtgtgacagcactttcttagaaggccagaataatttttcacccagcgtcaccataaataatggcagcagtgtgtagaggatgatcattaaaattcccacaccgactgctacccctactgcggattggaaaatcgcaaacttcgcaaatcctaaggcggaaaatccgatcaataccgcaaatccgctgataaataaggtttttccccctgtgcggtaagcgataagcgccgcttcttttttatcatgcccgtttgccaattcttcacggaaccgtgtaagaagcagtatgcagtaatctgttccaatgccgaacaggatcgcaactaagaaggtttgcgtaaacgtcgagataggaaaatcaacattgtatacaaggatgcccagtatagattgactgatcagataagaaaaaccgacaaccacaatcgggataaaaggcgtcacaacagatcggaacacgatcaacagtaaaccgatgatcaggcagactgttatcacttccgttttcttaagcccttcctctgagctgtgagcgaaatcctggttgataagggaagctcccgtaatatatgccgtcaagtcatcaggaacgatttgataaatctcgtccgcaattttttccgcctttttatcagaacctgtaatcgtgacaggcatgagaacggttttcttgtctttcgacatcaactggtctttgacttctttttccgctgacagaggagatgttacctcttctacaccgtcgatctttttgattttatcaattattatccggagctgattctctgtttctttctttatagcgttgtctaatgtaaagactacactgatcgaattattgtcttctcccgcttgttttaaaatggcgtttgccctttctgaaacagcatcagcgggaagctgggcctgccccttttgattggccagctccgttaagttcggagaaaacaaactcaaaacgacggtaagtgctaatactatggctgcaattgcccacttgaatttgatgattgctctcattcggcagaatctcctcctttaaatttgctttttaaaatggtgaatatctcgatgatagaatgtaagtgttcctcatctatatcatcaatcaacggtttgagcgcgttaaagatggcagaatctaattcttctagtatgtgttcaccactgggtgtaatgttaataagcttagagcgcctatcacttttttccggacagtcgtcccattgaaccaatcccttttcgagcagctttttcagtctgttagagatcgcgctcttatgtacattttggtacatggccaggctgccgggagaggttgggcccttgacttttaaaattttcaacaggtctgcctgttcccttgagatatgcttgaagacatcctgattgatttcacgatgcacaaattctgtcccttcaagcaggacttccacaaacaggtttatcgcctgacatagcttttgttcattcaatatcttcccctcctcattatagtttaccccgctaaactttatgttcaatgtcaattagtttattcctctaaactatatatgtcaacaaattttattttcgagcactctacataagaactcatgttcgtgtataatgaaagctatacacacgaaagggggaattttaacatgtcagattttgcattcaaattgtatgaatataacgtctgggccaatcaacaaatattcaaccgattaaaagagcttccaaaagagatataccatcaagaaattcaaagcgtgtttccgtcaatatcccatgtattgtctcatgtttatctttctgatctcggctggattgaagtgttttccggcaaaaccttgagcgatgcgttggctttagctgaacagcttaaagaacagacagaggctaaagaaatagaggaaatggaagacctttttctgaggttatccgagcgctatatactatttttacagcaaaaagaacagctcaataagccactccagattcaaaatccctcaagcggaatcatgaaaacaactgtttccgaactgcttccccacgttgtcaatcacgggacataccaccgcggcaatatcacagcaatgctgcggcaggcaggctacgcatccgcaccgacagattacgggctctacctgtttatgacaaaaactgaaaaagcataaaaaagcggctccctaaatggagccgcttttttcgggaaatagtccaaatcacattaaaattcttttcatcaatccttttttagtaaaaaagatagaaattttagtgttataataatcattaaaaatagattgctgactcaataaacaattttcaatggaggaacacataaagtgacagacgacatgacgaaagacaatataaatcagcaaacgttgcagagaggcttgaaaaacaggcatatccagctcatcgccatcggcggagccattgggacaggcttatttctcggctcgggcaaatcgattcattttgccggaccttcgattttatttgcttatatgatcacagggatcatttgctttttaattatgagatcgctgggtgaactgctgttatcaaacttgaactatcactcttttgtggattttgtacaagactacctaggcgatatggcagcttttatcaccggctggacatattggttctgctggatttccattgcgatggctgatctgacagcagtcgggctctacactcaatattggctcccgggtgtgccgcaatgggtgcctggcttaatcgctcttattattttactgattatgaatctggcgacagtcaagctttttggagaattagaattttggttcgctttgattaaagtcattgccattttggcgttaatcgtcattggccttgtgatgattttcaaaggcttttccacaagctcaggagtgtccagcttcacaaacctctggagccacggaggcctgttcccgaatggcatgcacgggtttatcctctcgttccagatggttgtgtttgcttttgtcggcattgagcttgtcgggcttacggccggtgaaacagaaaaccctgaaaaagtaatccctaaggcgatcaacaatattcctgtccgtgtgctgcttttttatatcggggctcttctcgtgattatgagcatctatccttgggatatcatcaatcccagcgaaagcccattcgtacaagtatttgtcgctgttggcatcgtcggggctgcaagtattatcaactttgttgtgttgacatccgctgcttcagcatgcaacagcgctgtattcagtacaagccgtatggtctattccctggcgaaagatcacaatgcgcctgagtcaatggcgaaactgactcagcgtaaagtgcctagaaatgctttattcttttcagctatcgtgattttaatcggtgttacgttaaactacatcatgccagaaggcgtattcaccctgatcacaagtatttcaaccgtatgctttatctacatttgggggattacggtcatctgccatatgaaataccgcaaaacaagacctgaattagcgaaaacaaacaagtttaagcttccgctttatccgtttacaaattacctgattcttgcgttcctggcgtttgttctggttgtgctggcactggcacaggatactcgtgtttccttatttgtcacaccggtttggtttattttgctgattgtgatttataaagtgagaaaagcgaagcatcaataagactcaaaactcctgcctcaaaaatgagagcaggagtttttttgatgaaaatgacctttgcttttgaatttaaaggtatgctatagtgtttgtaatcaaaacaagaagggatgatgggtggacaatgattaactaatcttatttttaccgtttgaaatcaatatttcaaatcaaaaaataggattagtctgcccattttctatatatacgacactgctatttataaaaaatagcttatttgatcatgcacaggcacggctaatccttccaacacatttgggaggatttttttattctccctttaaagcgagggatatggatgaaagagatcgtaacattaacaaacgttagctatgaagtaaaggatcaaactgtttttaaacatgtaaacgccagtgttcagcaaggagatatcattgggattatcggcaaaaacggcgctgggaaatctacgttgctgcacctcattcacaatgacttagcccctgcacagggtcaaatccttcggaaggatataaaactggctttggttgaacaggaaaccgcggcgtattcctttgcggatcagacacctgccgaaaagaagttactggagaaatggcatgtgcctcttcgtgattttcatcagttaagcggcggtgaaaaactgaaagcgcggctggcgaaaggactatcagaggatgcagatctgctgctgttagatgaaccgacaaaccaccttgatgaaaaaagcttgcaatttctcatccaacagctgaaacattataacggcactgtgattctcgtttctcacgatcgatattttttagacgaagccgcaacaaaaatatggtcgcttgaggatcagacgctgattgaattcaaagggaattactccgggtatatgaagttccgggagaagaaaagactcacccagcagcgtgaatatgaaaagcagcaaaaaatggttgaacggattgaagcacaaatgaatgggctcgcttcttggtcggaaaaagcccatgctcaatcgacgaaaaaggaagggtttaaagaatatcaccgggtaaaagcgaagcgtacggatgcccagataaaatccaagcagaagcggcttgaaaaagagcttgaaaaagcaaaggcggaacccgttaccccagaatatacagtccgcttttcaatcgatacaacccacaaaacaggaaaacgttttttagaagttcagaatgtaacaaaagcgtttggagaaaggactctctttaaaaacgcaaactttacaattcagcacggcgaaaaggttgcgatcataggccccaatggcagcggaaaaacgacattactgaacatcattctgggacaggaaacagcagaaggaagtgtatgggtgtcgccgtccgcaaacatcggctatttaacgcaggaggtgtttgatttgcctttagaacaaacaccggaagagttatttgagaatgaaacattcaaagcaagggggcacgttcaaaatctgatgaggcacttaggttttacagccgcccaatggactgaaccgatcaagcatatgagtatgggtgagcgtgtaaagatcaagctgatggcatatattctggaggaaaaagacgtgctgattttagatgagccgacaaaccatctcgacctgccgtcacgcgaacagctggaagaaacactgtcacaatacagcggcacattgctggcggtttcacatgaccgatactttctcgaaaaaacaacaaacagtaaactcgtcatctcaaacaacggcatcgaaaagcagttaaacgacgttccttcagaaagaaatgagcgggaggagcttcggttaaagcttgagacagaaagacaagaagtgctgggaaagctcagttttatgacgccaaatgataaagggtataaggagcttgatcaggctttcaatgagcttacgaaacgaataaaagagctggatcatcaagacaaaaaagactgagggagaaagttcaagcggcattgaaaaggacaacagctgttgtcctttttctttatatgttcaagcctcccatgaccttaatctttctaatgatgacttatagtaccctgccaccgcttccagataggcatgttgtatttgggtaacgtaagcggcttttcagcatagctgtttccgcatacgtatattggtcatggcatagcccatcttctgataaagatagacggctgtctcgttgtgtgcaaatacatgtagagccagcctttccgcaccaagctctcttgctctttcatcaagcgtttgaagcgccaattgagcaagtccttttccgcgaaaggcttcatacaatccaaaggaatagataaacgcttccttttgcggatgtaatggatcagcatacagccagagccagcccattctttctccttggtcatttgtgatgttccaaaaataatgattgctgctgtctcgcccattcggaatcatgttctcatatgcctgctccgatttctcaaatgcctctttttccgtccaagttcctgacgttatgttttgtttcgcaaaattttgcacggacatcccgcgaaaggcttcgaactcttcctcagtcatgtcttccaaagtgaatgccatcctgtattcctcctttataaaaaaagcccagctgatgccggacgaataacacagaaatggagctctattttactgattcagttaattcctggactttctattattcgataagaaaaggagatttcctgcaaatgggcttgttcttaaacattagtgaaaagcttacgtgtaactccccatgatgatcatgattgaaacaatcaaacaaatcatcgctggtatcgccatgatgacagattgtcttgctcgaaacatatgcgcatgaattgctcccgccatgagaacgacaaacagaacacctgctccaattgctgcataccgattccaaattcccgctgtcatagcaagtgccccggctatttcaagaatgccagtaacagtcagaaatcataatggatattgataatgccgccaatgctcaacttgaaagggaacgcggcttacctttatgatgcctcccgcaagcataaaaactgccaaactgactttcatcataatagatatcatcttacatcattccctttcggaagcatcccgtaaattaaaagattcacaacctctgctgcgaggcttgccggatctttgattccggttaacaaaaatgattcggttaaatgttcaatcatgccgaccaaacactcagcgacagtttccatatccagttcagagtgaaaatagccaagccgctgttctgcttctaagttctctttcaaaaccatcgccaagtcttttttcatttgttttgcttccgggttgagaaaaaagccgatcttggttaaatccttgtcctcatccaaaaattgaaaaacagtctctacagctagcagtacccgttttgacacatcctccgtgtttaatccgttttccagaagaagtgactctgtcagctttctgactcgagagtgaaaatcggttattaactcggcaaagatggcttctttgctttgaaagtacaggtaaaatgaaggctgcgtgaacccagcttttttcacaatttcacttaccttcgcgtcatggaatccccgaaccgaaaattcattagcggcagctttaagtaatcgttttcggctttctactcctttacttttcaactaggaccaccccaaaaataatacccacgagtaatgttactcacgagtattatttcatggcattagcttcattgtcaattatttcaaactgatcctgtttgccagcttcctttattaaaaggtctcatgcatttcgaataactgaatcaattcattgattcctatatcaatggcttttcattcactgataattgagcatcactccggggccagatagagttttgcccgtaaatgcaaggaacaattgggtgcagcggcgcataatgtactgtacagaaagatggaagggtgtgatgggatgccgtctacagtaatcaacctatattatttgaagatcaacagtatttcgggcaatggttcaattacaataggcgaagctgcttataacagccctaccaacaatcaaaaatctcaagggaccaactcttctttcggtgatacatcacctacagaatccgtaatggaaaacttcttaaacgatcctgatgtaaatgaccagacatctatcggcaactctgatacatccaacgttaatgctcctccgattgcaccaccgccaattttagattaaaggggtttcgtctatgccatatcaaattaatatcgcaaatattaagatcaacggcgtcacgcaaaacggaaatatagatgtcggtccgactgtgcacaacagccatactgcgaacagcaaatattttggagcaaacttttccttaggggatctttcgcctacgtcttcacttttaaacactggaaatattgattcagacgttagtgaccaagaccaaatcggaaacccttctgcgccgatttcaaatcaaatttaaggagaatctcatatggatttcgaaaaaattcgaaagtggcttgagattacgaatgaatataaacaaagtgacttttggacaaatgtgctcaaatataaagccccggaacatttttttgattccgaagcttctacgtttgtttacgacttttatcaagatgaggaatataattttatcattgtggaaatgcccggtgtgtatgaggaagaattaacgatccgtttactgtctaaaacccagctgctgatcaaaggaacgatcacgcctgtttttccagccgaaatggaagtgctgcgtgaacggtattacggagaaattgagcgaatcattcagcttcccgaagccgctgaaactcatttgttacagattcagctgttaaacgggcttctgcatatttcgtacccaagacaagttgaaaccgttgcgttcaataaggggctttaagattgattgttccttcattccttatccatagggactgatatatggtctttatattgatccacataaatatccccattacccagcagcactgcgtacacggtctctttcacctttatgtctctttttcgcaattcttccaaaagccaggattccgtcaaacgattctgctttaaattattctcaatgatttctccgtccataataagttctatcggaagcctttgttcttggtttaccgcaatcattaaatcctgtttggtcacatgccggaattgcggttttcttaacacagtcagctgaccattcgtttcaagaatggcaaaaagaacttcttcgatattaaatatttctttttcccgtaattgctgatttaaataatcaagtgtgtaacgcattttcctcatatttgattcaagtatcttcccgttttgaatcagcactgttggatctccggcaaaaaatttcctcagcttcctgttctttatcgacagaaacgaaattagaaaaatggttagcacaaaaatactaaacgaaatggccatattgtgcggttttattgaagtattgtaagctaatccggcagcaatcgcccctagtgtgatcgccgcaataaaatcaaaaatcgtcatttgagagattgtctgtttgcctaaaattcgttctgcgattaacagcaagccaaagctggcaaccgttctaatgacaacttcaagttcaatcatgttatggcgctccccgcttcccagattgtttcggccaaaaaactcctgttgctatcattgtttggcttaatatatccatctataccaaaaatattgttcggttcaggacagaatgaaccgactgcctttcggatatattaaattgcgattggccggaagaaaagccaatcccatgacaaatctaattcatcattggtcaggtggtagcatgaatttcacttgggaatctcttgttctcattgtagccggggtcattttgctgagaatttcaggaaggaaatcaatcgcacaaatgacgtcgactcaaacggttgtcatgatttcgatcggaactattatcgttcagccaatcatcgagtacagcctcttcaaaacattaattgcagcggcaattttcacaagcacactcatcgttatggaatggatccaaatgaaatcgaacaccattgaaaagatgttaaccggaaaagcaaaaatcgtcattgaaaacggacagcttcatatcgaaaacttaaagaagatgagacttacagctgaccagcttgaaatgcagctaaggcttcacggcgttacggctatacaagatgtcaaaattgcgacattagaggcaaacgggcaattaggaatagaattaactgatgacgccaagcctttaacagtcagggatctgaaaaaactcattcaccccgatttcataaataaggacggacaagcccagtctggcaatcagaatatttttgatgaagttggcaaaaaaataaaaaaacgtccctaaaaagctgcattaacaaaaggcgcttgtggcattttgcaggtttttgtctcttactgaaagtttttgccgttttgtttaagcaactgctgctcacacaccatattgtataaacagtcataacagagaggagagatgaatgatgaaattcccagtttatattcattcgatatccgggaacagcgtttttaataacggatttgcagtttccatcagcccgttctctgtgtctaaaacaacagagggttccggtgggagtaatacaggtttggtttttgaatccaatgctttaagccaaacaagctccgccaatcaagcccaaaatgtaacatatgcgatccaagagctgctttccaagcttttagcgtaaaaattaagaaataaacacttcatgaggtgccgtatggcttttccaattattcacacgaacttttgggatgctgtgatagctgttccaatcatcatattgataacccaaatcctcaaaatattattgaaaatccccaaaacttttgtaccgtcagttgccttaataacaggccttgtcatttctgttttcataagccatcgacacagcctcttttctggcgtatttatgggctggttttatggctacgctgctataggctcctactcatcattaaaaacgactatcttatccttcaggcaaacgaaaaacgatacatcaaattcatagatgacatataacgatctgccgcctctttatcaggcggctttatttctgctgataggttgatcatcttcaaaagatgatcattcactcgctattatttttaccattatgttgatgcaatgatataaaaacgcaatatcatagaagtaaatagactgccagcgtcctttatgacagctacttctgagtgaaaggagtttttgaagcatgcgatctcaaatcaacatctcaaatctcacgataaatggaatgacacaaaacgccaatacagatatcggacaaaacttgcaaaacagccatactgcgaacagcaaaaattacggagtgaatttcacattaggagattactctccttctcattcaattattatttcagcaagttgtgataatgatacaagtgatcaagggcaggttgataacccttcttcgcctagtgaagaataaaaaaagaactcatttgagttctttttttgccttattcctttattcgccttcatataatcgataaacccttttcagcttttgttcaagctgttcaaaatgaacaaaacgggcttctcttagaaactcagtcccatcaatgaacaaaagaagcacaggaacggtgaaaactgaaaatctgccggcgacctctgctacatcgtcagcattgatatgccccaatttgatgtttggaaactgatccaatactattctgagctggggcagaactgcgtgacatactgtacagccaggccttgatatataaataaaactgaatttgtgctgtttgataaagttttctatagaaactaatgaatgtaatcctgtcatctctttcatccatttactccttcaaataggtctgtttttcatgaccaagctcatcaatacgtatcattcactatacagatttatatttatgatatccgcttttttgctttgcagagtacctgcaagcttgccgaaaatgtgaaaataaaagaacagttactgacaagcagcaactgttcttacatactttcgtattaaaaatgcaaagcgtaagctcctgaaccgatgagtgcaacccctatggaaactgcaatgagcaccaggttatattcaaaacctccggcgccattcgcaaaacctttcgctccatggacttttacgatagcacctaacatgatgattgttatgatagcagctccaagcgggaggaatacgcctaaaataaatagaattccgcttactaactccccaagacctgatagagcggccgcaacgtttcctggtttcaccccaattgattcgaaccattgtccggttcctttaatcccgtatccgccaaaccagccgaataatttttgtgtgccataaaacaaaaacaccacaccaatcattatacgaataagcaacagtcctgcatcttccatttgtatctctcctcatctttgattttatctgattctttgctgacagtaccatccagcaatcatcaattgaatatatgtttctttattttttatgtgtcaaatcaatctaactctcttacttcaaacggcagcagcccttgttcaatttgtgtgcgatgcggttcatattgcacaggcagcatcagtttttcgcccattgtttcctgtgtttcatcatgtgcaaagcctgggggatcagttgcgatttcaaacaggatttccccgtgttccctgaagtaaatggcattaaagtagtttctatcccgaacaggagttacaccatatccgtgggaagcaatatatctttgccaatctaactgatcttcatcatcgttagcccgccaagcgatgtgatgcaccgttccggcccccatttgcccgcggccaataggcgttaacttaaggtcaatcacatttccgatatcaccggcggaacgataacgaacgaagtctccttctttgccgactcgctccagccccatgatgttttctaaaaggtcagcggttttgtcaggctgctctgataatagggttgcacccccaaaacctttaatggcaacatcgggcgttacttctccgaaagtccacgtattagcctctccttcttctctttccacgatttctaagtgcagtccatgaggatcatcaaattctacatattgttccccaaagcgctcgattttggtgtagggaacgttgaacttttctagtctcttttcccaaaatgccatagcccctttcggcacgacatacgaagtcacgccaacttgaccgtctccaatgacgccttggcgggctccggcccacggaaagaaggtaatgattgttcccggcttcccgccttcattcccaaaataaagatgatacgtacctgggtcatcaaaattgacagtttgcttgaccaaacgaagcccaagcactcctgcgtaaaaatctgtgttctcttgagggtgaccgacaatcgctgtaatatgatgaattcccatcgtttttttagccatttttatccgctccttttacatatactcaacaaactcattcacaggcttccggtagccgcgcggtcttctgctctctgttttttcttttccaatcgtaatcatcatgacaacctcaaattggtcgtctatgttcaaaatccgttttacggcttccgcatcaaagccgatcatcgggcaggtatcccagcctttttccttagcactcagcataaacatcatcgcagaaagtgaagcattccttatcgcctcatctctcttaaattgttctcccctgttttcataaaacgaaacggtgtcttgcaccatgtggtcatactcttgcttatttaatatccccaatacctttaaaccttcatagatatcggccgcttgttgatatgcctgcttatcccctaataccaagagaaccgcagaagagctaaccactttatattgtccgtttgcggcctgcttcagcttttcctttacgtcctggtcaagaaccgtcacatattttgtatgctgcaaattaaaagccgatggtgccaatgcaaccaattcaaacatctcattgagatcttcttttgtgattggatgacctgaaagaaaattgcttgcagatcgtctttcattgactaaatgagtaaattcagccattacgctacactcccttttatctcgaattcgagatattatgttataaaaaatcatattgaatattgtgtaaaagaactgacaacgattgaacacttagagttgcgcttgatcgctgatctttccgaccaaatatctcaaattaaaatatcttgaatatgagataatagtaaaatacagatcttctcatgtcaataggtttttgaaaattaggtggaaatttttcactgacggcagcattttaatagcgaatcatcactgttgttacataagaactcatttgtttgctgtatgacctttttagcatagctccaactttttttctgtcaccttatttattagtaaacaggaaacaacgttgctatagacccactcgaaattgaattggtatgataaacaaagtgattacacaggaaaggatacggagagcgtatatagagcactcctatttttttgtgcagttttataggaggaaaaaatggcaagtgaaagagaacaaataagcagaaaagttgctttgattgcattgatcgccaatctgatcttaatggcaggaaaggtcttttttgggctggtaggcgatagtgaagccgtgtttgcagacggaatacattccgcggcagatgtcgttgcttcgattgcagtcttggcagtgatcggaatttccaataaaccgcccgatcaagaccatccttttggtcacggaaaagctgaagtcattagtgaggcgattgtaggaattatcttagtgatcgtatccgtttatatcctcatagaagcgattctgtcctttgttaaagggccaagcgttccccaatacagcgcattgtttgcggctctgatttcgtacgtggctaaggaaatcttatatcgttattctataaagcaagggaaaaaatggaacagcaaagcgattatagcgattgcgtacgatcataaaggcgatatcgttgcctctcttgccgcttttatcggcgtcctgttggctatcatcggaaacagccgtggatggtcctatctgttgtacgccgatgccattgccagtgcaatcgttgcttacctcatttttaagatttcaatggaattaatcaggccgtctgttgatgtgctcatggaaaagagtgttgatcccgagctgatagaggaatataaagctgttatttttcaatgtgatcaggtaaaacgaattgatagaatccgcgcgcgagaacatggccactataaattgcttgatgtccgtttatctttggatcatgatttgacaattaagcagggacacgacattgcccgcgaaattcgaaatgaaatcaaaagacagttttcagatgtagaagaagtgctcatccatgtaaatccttatttcgaagaatgaaaagctcctttttagaaggagttttttctttatgctgcaaactttacctttagtactcgccgtactatataatgtgtgtatatcaatcataggacagaaaggttgttagaatgaaggaatttttttcgattggagaagtgtcaaagttattcaatgtgaaaatctctgctcttcggtattatgatgaaatcggccttttgaaaccggaatataaagatgagcaaacgaactatagatattattctacccaacagtttgagcggctggataccatcaagtatttgagggccctaggcctgccaatcaataagcttcttgatttttataactctcaaaatacaaacactcttcttcatttactaaaaagccagcaggttgaaattgatcgcaagaagaaagaattggaacgcattgaacgaaagatctcccgacgcatcacacatatagaagatgccgttaacatgccgttacatcaaatttcaaaaatcaaacttcccgcaatgcgtgtggcctatttgcagcatgaatatgttctcggccatgatatcgaacattcgttagctgaattgagaacccacctgaatgtaaacgaagatatattcataggcaagattggtttatccatttctgcagcaaatgtgaaagcaaaacagtttgacaaatattccagtatatttatgattcttgaagatgaaaatgaaaaaacttcttcagaaatcatctttccttcaagagaatatctgcaaattaggtttaaagggtcacatccagaagccgaaccatactacaaaaaattactggcatatatgaaagaacatcattatgaggtagcaggggactcaatcgaaatcacactcattgattatggcattacgaataacctagataattacgtgactgaaatcctgctgcccatcaaataatctcatgaatatgttttgatctcccttgactctctactaactagagggtttattttttatgcaggaatgatttttggaggagaaagcttatgtttggaacgatttttaacacagtgatgatcattgcaggaagcataatcggggggatattcaaaaaaggcattaaagatgaataccaggatattttgatgcaggcaatgggattcgctgcggtcgcactggggatcaacgccattacacagcatttgcctgatagtaaataccccattctattcatcgtgagtttagccattggaggtttgctaggccagatcatcaatttagaattacgattcaacaagctggtgaacaaattttctaaaagcaatttagcagagggcttatcaactgcggtcttattattttgtataggttcgctgtcaatattaggccctgttgaagccgctttgcatggagattatacataccttctgacaaacgggatgttagatgggatcacctccattgtgctcgcttcaacttttggttttggaatagcggctgccgcacttgtattattttcctggcagggctccatctatttatttgcacaagtaatggagagcgcaatcaatacagaccttattaatgaaatcacaattgtgggaggcatactcatcctcagttcaggtctaagcattcttggaatcaagaagttcaaaacactgaatctgctgccttccctcctgatccctcctgttgtgatttttgtgattcatgcatttggattgcggttttaatgaagcggctccacaaaggaggttaatattctgttatattgattttcaataatctgtttcaatcgttttttccttttcatcttggatttgacgtctaataacaactgtattatattgtaaataaagtctgttatatcaaaatcagattccccatcacgaaacggcacattcatttaaacaaaattgggaggggcatttgtatgtcaaaccattcatctagtattcccgaattaagtgacaacggtatccgctattatcaaacttataatgaaagccttagtctttggccggtccgttgtaaatcattctatatatctactcgttttggtcaaacacatgtgattgcaagcggcccagaggatgccccgccgcttgtattactccacggagcattattcagctcgacgatgtggtatcccaacatcgccgattggagcagtaaatacagaacttatgcagttgatatcataggtgataaaaacaagagtattcctgagaatgtaagcggtacaagaacggattacgccaattggcttcttgatgtgtttgacaatctggggatcgaaaagtcccacatgatcggactttcgcttggcggtctccatacgatgaatttccttttacgtatgcctgagagagtaaaaagcgcagctatactgagtccggcagaaacgtttttgccatttcatcacgatttctacaaatacgctcttggccttacagcgtcaaatggagttgaaacattcttaaattggatgatgaatgatcagaatgtgctgcacccgatttttgtgaagcagtttaaggcaggggtaatgtggcaggatggatcaagaaatccaaatcctaatgccgacggatttccgtatgtttttaccgatgaggaattacgttcagcaagagttcctatcctattattacttggtgaacatgaagtcatctatgatccccactcagccctgcaccgagcctcttcattcgttccagatattgaggcggaagtcattaaaaatgccggacatgttttatcgatggaacaacccacttacgtaaatgaacgtgtaatgcgttttttcaatgcagaaacaggcatttcacggtaagggcttataagatagtgatttgcattcataaagtcctgcaatatgcttctagccgggcacttcaaaaaatagagtccctcttatggactctatttttcttggacaaaacccgcagctggttttgtgtgcttgtttctttaggtttcttatatgatcagttgtaaaatcctttattttcaagaaggattctcaagatccttggcatcaagtagtgaatgcaaagtcaaaaaatcatgtcacttctcctgggatgcctgctagtatgatgcagcttctgccaatatgaaacaaagttccatccatatcgaaaatgagtgatggcgccataagcgtctccttttaactgccgacttcatcttctaaatactaccataagcaaaagagcagatcataaaagatctgctttttctattacacactgatttgtttcttttgttcatgatctatttccggctgtatttcctttgtcagttgatgcccttctatatccacattcggaataatcttgtctaaccatttcggcaaataccaggctgcattccccatcagcttcatgacacttggaatcagtgtcattcttacaataaaggcatcaaagagtacaccaaaggaaagagccagcccattggctttaatagaagcttcgcctgcaaagataaatcctgcaaaaacgaagatcatgatcaagccggctgctgtaacaacaggaccactgtgttttaatccagcctgaatggcttgtactggattgtttgtttttacatattcttcacgcattctgctgacaaggaatacttgataatccatggctaacccgaacagaatcccaatcgataaaatcggcaggaacgcgagtatcggccctttttcaggtattttgaaaaagtcgatgagattcccgtcttgcaagacaaatacacagattccaagagtggctgtcatcgtcaacatgaaacctgcaacagcaacaagcggcacaagcagcgaacggaaaacgatggtcagcaatacaaacgcaaagccaacaataagtacagcaaacaccggtatcgcatcattcaggcgatctgaaatgtcaatattcactgcagttgatccagtaacaagcaaatctactccgtttttatctgataaactgcgtacatcatgtaccaaatctttcgttgtgacatcatttggacctgtttcaggaacgaccgtaatgatggcaaagttcccttctttattaggcattgcaggagtgacacttgctacatggtctaagccctttatttctttcactgcatctgcgaaagcctccgccttattttctgtagcatttgtggcatccgctacgattgttaattggccattaaatccttctccaaagccttcggcaagcaagtcatatgcccggcgatccggattatccttagctttcatcccagcatcaggcaagcccagttccaaatgcatagatgggatactaatgacgatcaaaatcagaatgctgcatacacttagcatgataggatttttggtgacaaagcgtccccagacatttgtttcagtgctttgtttttctattttcttgtttgatttcggaatcatccgcttccctgcaatcgataagaccgcaggcacaagtgtgatggaagccaaaacagccatcagtacactaagccctgctgtcagccccatcgcagacataaaaggaatgttaacgacagttaatccgcaaagtgcaacgataacagtaagtccggcaaaaaccactgcacttcccgctgttcccacggctctcgcaattgattcattcttttgtatgccttcgcctaaaaactggcggtgtttcgtaaaaataaataaagcataatcaataccaacagcaaggccaatcattccggctaatgaaagactgacagaagcaatatcaaatacttgtgtcccaatcaaaaccagtccaatacttacacctaaaccaatcagtgcagttaaaatcggcaaacctgctattaataaagaaccgaatgtaatggctaaaacgacaaaagccaagataatgccgacaatttcagagacaccgcctatctccatctccgctcccggtacatctccgcttagctcagtttgcaatccttcatcatcagccattttcaaactgtcttttaagtgtttgatagagtaatcctttatatcatctgctgatgatttatactggatatcagcataggcaactgtgccatctttcgcgattgtccctgtcacaaaaggacttgcaatcgagtcaacagaatcatctttactgatttctttgaacgtatcttctattgctttttttgctggcttcccagtaagtttctccccatcaccagcaccgaaaataacccgtatgctccctttatcaggaccatgaggaaattctttttgaatcacatccatcgctttttccgaaggtgtgtcaggtatggacatatcctcagaaaaacttggtttcaaggtcactgcaaggcctatcgcagcaactaacacaacgatccacgcacatattgcttttatgcgattgcgagcaacccatcctcctaatgtatataacatttttgacatgataatctcctttcaacacattgcttgatcacattctttctcattgtagttgacaatgaaatgaaaaaaacgtacattcgggcatgtacgtttgggcaattttcaaatatgcagtttagttgtctattgtcagaatacctttttgcatggcaatcgttactgcctcagttcttgaattcgcgcctaatttattgtaaatggacgttaatctggactttactgttcgctcagagacgcccaaatcaaaggcaatcgctttgcttttaagacctttagcaattgcttttagaacaatgacttccttttctgtcagctgcgtctcattgcgctgctttttcatccgctcaaattggatttcttgcagacgtttaaggatatcaggctgcaatagcacatttcctctgatggctgcatccattgtgtgaaaaagggtttctgaactcgtatcttttaacagatatcctttcgctcctaattcaatcccttcgatcattaagtgatcttcattatatgtagtcaaaataatgatgggggtatcgtgtttttcttttatttgtttaatggcctctaacccgctcatctccggcatatacaaatccatcagaatgatatccggttctaattcatctgcaagacggactgctacttttccattttccgcctctcctataatggtgtattgatcattcgtttcaattaaaagcttcagaccttccctcacgacaagatggtcatcaacgattaaaaccttattcatcttgcatctctccctgaattggtacagtgatctcaatttgtgttcctttcaattttgtactcttgatattgaattggccatttattgccctgacgcgttcttgtatgccaagaagcccataatgtcctctctttttctttcctttttcaacatcaaatcccttgccgttatccttaactgttaaatggagccttcccttttcatcatcccaaatggatatccagattgttttcgcctcagcatgctttgccgcattcgtcatgcattctccaatgatgtaataacagttttcagctgtacgcacatccagcacctgatgcaatctgtaatctaataaacaagccatgcctgtcgactctataaaatgatccattagcgaggtaattctttcttttaaaacaccgatttcttctgatttgctgcggagatcgtcaatagctgaacgtgcatcagctattgtgcttttcactcttttcatcgattgttgtatgatttccttcgctctctctgtgttgcctttggcgagatgaacatgaatcgcatccagctgcatatttaaactgacaagaccttgagcaagcgtatcgtgtaagtctcgggccatccgctgtctttcgttctgcagcgtcagctgttctacctgctgatgagccagctccagcctttcaagagtcaattgagcttttattttttcatcgacttgggcaaaaaatgttgcggcataagtgatgatgacaatcatgatcggcgcagcaataacaataaaatgcaaaacttcacctttatgaaggtgatacgccgaatttatgaccagcagcagcaatagataaagaatgagaaaagtccttcttctgtctgccattcctataatttgtccaattaaaaatgcataaaggccgataatcacaagtataaagaagccagtcatgagattagcaagtgcaaaggtgatcaaaccttgtaccgcgaaatacagaatcactcttttcttaacccagcgatatgagtgccaatgaagcaaagcaaaaatggcgattaatatggtaaacgcataaagcaataaaatggaccagcccccagaaacaaattgcagcacgatagaggctatatagatcatgagaataaaagccaggcccggcactctgagtgcaagcatgtttaatgcccgcctatcatgtgagtaatatttatctttaaaaggattccttataagcaaaccttatccacttcctttacctgtttcaccgaatagagattcatgaaaatcgaacccatatttcaacgtgcaaacatacatgtatccaatcattttataggaagagaaggaacacaacaatatcaggtgcagggaaacattagagtttccaacaagtgatcattgcccaaacgtacatgaacgttctgcctctatgtacgttttatcttttcaaatttacctttaaaatcataaggaacttactattcattgaaggaatgatcatcattgaaatcgattgatctcacaattttatcattaaagagaaaaggaatccggaccgaaaaggtattaaaaaatcagaaccctgatcgattaagccatatgacagacaaaaatgcgcaaccaaaaagcaaggaaaaagaggaatgaacatgtattggtttctaggtgctttattatattttctgatcggtacttatatattcattagagtcactagagacagccaatcaggctcatggatactgcttgcattagcagctccactcatcattgctggctacccttatttttattcaaagaagcttctttccaaaagacgctgaaacagctgtcattcaaaccgcacattggtaaaatgatcaataccgggatacaatctaggtattctatggaaaggagtcttgctttatgagtcaaagagtgtcctactatgagattgcacctgaaggtatgaaaatcatgatggatatggagaaatacacgaaacaatcctcaattaaccgaacgacgagagaactaatcaaaatcagagtctctcaaatgaacggctgtgccttctgcatagatatgcatacgtccgatgcccgcaaaatgggagaaactgaacagcgaatttactgtttacatgcttggaatgaatgtgatttttactcacctgaagagaaagcggctctcgaactatctgaacacatcacgctcattccatctaaaagggttcctgatgagctatatcatcgggtgcgggaacattatgatgaggaacaatatgttgaccttgttctgatcattaatcaaataaacagttggaaccgcatctctattgcaatggggaatcgagctgcttcaaaataagaagaaggagtaagattagaacaaatcttactcctcctagatatcgtgcctcatcatctgatgtttccgcttcaaaatcctaaatcttcacgtttaggtgcttttcaaacgcgattttcccgctttgtgtaatcctaatcgctctcgttttaggcatacgaacgatccattcttcttctaacatgcgcaccaatagggcgtttcctaatgctcctgcaatatgatgctgccgttcactccaatccaaacagcagcgggcaaaggctctcctcttattccgttgttgctcttcattgatgcctaacttcgaaaagaataaagcaccctctgaagtcacctcaaagtttaaatcaactttttttaacatcccctgctcaactagtgaatgtgccatttgcacgcccacataacctgccaaatgatcataacaggtccgggcgaaatgcaagtcctttttctcttttgactcttttaaagatttgacttttgctttaggcgcaatatgaagcaattgttcgatcacatttgcagcatctgagtcagccaatctgtaataccgatgtctcccatgcttctctacgctaatcagctttgcttcaagcaatttattcaggtgaaaacttgcagtttgaggtttaatgttagcgagatatgcaagctctcccgcagggtgtatccttccatccatcagactgagaagaatggaagaacgcgagggatctgatagcaacgaagagatttttgcaatattaggattcatgattttcctccttacattcatatttcgatgatagttgaaatgttaatcctttacaatataaatgtaagcgtgacaaggaggaaaaaacgttggacatcaaaaaacaagacactcgtcgatttaaggaaatcaaacccaagatcatgtattatggtacctcgacatttcttctaaccacattgaatgaggatggaaccactaatattagtcctatgtcttcttcttgggctcttggacattatataatccttggagtaggactgggaggaaaagccatcgacaatttggaaagacacaaagagtgtgtcataaacttgcctggcccggatttatgggaaaacgttgaaagaatttcatcttatagcggaaaaaagagtataccgcctttaaagaagcagatcggatttacatataaaaagaaaaatacgaggcagcagggttaacgcctttacaatcaaaaacagtatcaccaacacgaattaaagaatgccctatccaaatcgaagccgaagtgaaacacattcggcttccagaatatgaatcgtcattcgcaattgtagagacgcaggcactacattttcatgccgaggaaagtatcattctggacgaaaaccatatcaacccttccaaatggagcccgcttatctataatttcagacactactttggtttaggaagagaagtcggaaagacttttcgttcagagacatgattattttaagaccgaaccatgatttggtctattctagtaacccttgttattatcagatcaagcgatcattaggcttgatctcttttttagtgaaacatccatttaaggatataaaagttacctgcttgccaattctttaatcattaaacccaactcataaatccccttttgaaggtcttcaagagatgcataagcatatgataagcgaatataattccctttttcctgagcatagatactgccgagattgatcagaatcccttttgataaggctttagtataaagtaatttcattgatatggaaggcaatatttttatccagacaaaaaaccctccttttgggatattccatgtcgccacttctttcaaatgagtttctaaagcactcaaggccaattctcttctcacctttaattgctgcctaaccttttctacatgctgctggtagtggccggaagtaaaccactctgccgctactctctgggatagcgaactggatccgtaatctgtttgcattttaatgtcagataaacgttcaatcaccggttccggtccgacgatccatccaatcctcaaacctgggcttaatgttttcgataaacttcctatgtacagtacgtgtccatttttatcaattgttttaataggatatggcggaatttcatcgatccataactcacgataaatgtcatcttcaataataggaagctgtgtattctcacttactgctaggatttcttcccgtcgctttttagacataagaataccagtcggattgtgaaaacatggatttgtatataagatagcccttccccgctctcctcttgttaaatgaacattttcaggcaaaagtccttcattatccataggaagtccagtcagcttcataccagctgattgaaatacgtgtaatgaataaaggtaggagggctgatcaagataaacggttgatcctctttgtaacagccccattgatatcagctgcaaggcttgcaacgctcctgagacaatcagaatggaagaagatgagacgttgattccaatggtttttaaatagttgcttaatgcctccctcaaaggtaagtaaccttttggttcttcatatccgaatgcctccatgtgttgagataccttccccatcatctctttcataacagccaaaggaaaaatctcagctgaaagttcacctttactgagctgtataaggtctgtatttgattctgattgatttatctcttgaacgatttttcggcttggcatctgaatgccagaggtgacatattgatcccaatcgggagcagaattcttagccatcagtgtccatgtgttgttgataacaactgtgcctttccccattgtgccttctattagcccatcggccatcaattcctctaacgctgtaatcactgtgctccgatttacctgaaaatcttttgcaagcgtgcgctggcttggaatcttgcttccaatcggccactctccatttcctattttctctttaataaaatgaacgatttgtctgtacttagggagctttttcatctttttttcttctggaaagctcatagaatcggtctccttaaaataaattggttgggtcaaaatctattgaactggttgaagccatatcatcaaatctttattagtatagaaacacattaaataactggttggtttttgtaaagaggagtgagaggaatgcgaaagaaaacagttcaaataatgatatctcatagtctcatgattggtttatgggcatctgcttttccgggaattcgcgcaggacttgaagggtacacgccagaacaccttgctttatttcgtttgttaatcggctctatggcattattgctttttgctgttttgactcagatgcgcctacccgacttgaaagacattcctgccatttttcttttagggtttttaggatttgcattctatcacattttgctgaacatcggtgaaaaaacagttagtgccggagttgcaagcttactcgttactacggcaccgatcttctcagccatgctatcccgcctgttttataaagagcattttggatttacgaaatggcttggctctatgatcagtttattgggtgtattattgattgcatttggggcgggagactttacatattcaatgagcggtatcttggtcatcctgctggcagcattttcggagagtatttatttcgtttttcaagcccgctatataaaaaaatatggttttattccattcgttacattcaccatttggggcggaacaatacctatgcttgtgtttctgccaggcttaggcgaagagatgatgaacgcttcaataagcgcaactttgtctatcgtttacttaggattattgccgacggttattccttacttcgcactagcatatgtcacttcattcgtcggtgcttcagaagcaaccctttcactttatgttacaccggctttagccttgatcatatcttggctctggatcggcgagatacccacactgctctctctgctaggcggagtggttacagttggcggggtatgttttacctacctaaaagtaaataaaatgaataagattttcatcacccatttttctgctaaaagggtaaaaaaactctaaaacaaaaaagataccaacatcggttggtatctccttttaaggttctttcattaaggttagccagagtagtaaatagtgtattccgttaccgtcttaaaccctagtttagctgctaatgcaatggacgaattgttgcaaatatcacaatcccagctaggaacaatcccattttccatacaaaacgctataaacctatttgctacgcaataagctaaccccagtcctctatattcttcaagtgtatagatatccatttccgctcgattatgccctaaaaatatagaggtacactcacttactacgtgattgccatgtaatacggcaaatccaaaaccttttgaagcaaactgtgagacagaattccaatactcctcataatacgcgctgttaaacgctgtgctatgtgaaatgatgtcttcgtcaattcttttcaatacaagcccctttggcagttgcaaagtctttttgaaagattttggttgataagaaaatgcagctcttctcatttggtttaagtcatctttcagtatgggtttcagtacgctatcccatgtatcactggaagaaaacaaggtaaatcgttttgatgatttcacttgttcttcataatatcctgcaatgaaatcatgaaaatcccgattcccttggtctcccgcaataaaataaatgcctgattcagttcctataaaaaacgatttaggaaaggtttgatcatctgcataaacagctcccggaatggtttggtctaatattgaatagacaaatgtgggacaatatttgtcatcaaacattgtttttaagctactgtatttttttttgttaattcctgcaaaacagacaactcctttaaaacaccgtctccttcatgattctgttcacaaatcaattttcctctgtcaccagctaaataacttccctgttacgaatctcagacaaataaaaacaaaaacaggtgtctgcactcagctcgcagacacctgttgaacaacacattgtattatataacccaagaaaacgctgaatatatcgattctttattccccagttacagcaaactgttttaaacggtcaccaatttcatcacggaccctttggaaacacttcttctgttccgtgtgcttttgccggatcatcaaatttctccgatgtttgatttgaaatatcaatccctgcttctttcattgctttgacagcactcgatgtcatccttgagcttcgattcctgcgctgtacacattccacttagccccaaggtattttctcccccacccttcagccatttggctgcggcaagagttaccagtgcattgttttccttgatatagtgaccttgtccttttagaaacaagaatggattatcagcagccaaatatacaggccgacaagtgtgatcaataaagtgggtatcgtgaggataattcctgttttaaaatacgtgccccaggaaatcttcatacctttgtgcgaaagaacatgaagccataataatgtcgctaaggaaccaatcggtgttattttaggccctaaatctgaaccgatcacatttgcataaataagcgcttctctcatcatcccatgtgtatctgtaccggcaatggccaatgcgtcaatcataacagtcggcaagttattcataatggaagaaagaatcgccgcaataaagcccattccaattgtcccagcaaacaatccttgatcagctgcggcttgaatcacatctgaaaggacatccgttaatccggcatttcggacaccatacacaacaacgtacatgccaattgaaaagaatacgatagcccatggcgcctctttcaccactttctttgtatggacggccggactcttttgcgcagcgattaagaaaatgattgcaatgctgcccgctaccactgatacagggatagaaaaaaattcacttgcaaaatatccaattaacagcagccctaagatataccatgacagtctgaacatgttttgatctttaattgcttcaacaggttttttaacctcagtcagatcatagcgttttggtatgctttttctaaagaaaaggtaaagtacaatgatgctcgccagcagcgaaaacaggtacgggacaaccattctggatgcataatcaataaacgtaatatgaaaatagtccgctgaaacaatgttgaccaaattgcttactacaaaaggaagcgaagtggtatccgcaataaatccgctggcaatgataaaaggaaaaactaatttttcattaaaatgtaatgctctgaccatcgctaatacgattggtgtcaatataagagctgcaccgtcatttgcaaataacgcggcgacgatagctcctaatagagatacataaacgaacatccgcacaccgtatccttttgcagccttagccatatgaagcgctgcccattcaaagaaaccgatattatcaagaattaacgatatcagtatgatggccacaaaagccaaggtcgcattccaaacaatccctgtcacagttaacacatcatgaaaattgacaacacctgctattagagctaaaactgcgcctccacaggctgaccaccctatagataaatttttcggctgccatatgaccaatactagagttaataaaaagatgaatactgccaaaatcattgatgtcaatctaatgcctccttactggcaacacgcttgagttttcttttgtttgatatggtttaacaattcatcctcttgatcaatttgatgtaagatcaattgcaatgtatcaaactcaggacaggaaccatttattgaataataacgccattggcctcttctgtcctcattcacaaaacctgcgttttttaatttccgcaaatgctggcttatggcgggctggctcatttcgaacatatcaaccaattgacagacacaatattcttgttcaagaaataatctcatcatgataagcctagtttgatcactaagtgttttcaaacaacgagtcatcgccgcaacatcaatcgtcatatgagctcctccttcccaaatcaatatataagcaaatcgttatatacacgccaaatgattatacattcccctttacgtttccatatgtagcgctccgtatatcttaaggatcaaaactttgaaacgaaaacctgagtcgctccccgcgtttccttagcgcccccgtcattatataaacttttatttatataaacaatcccttctggtataaatattagactatttcagttatgggagtggtcatagagcccaagctgaaactagacaatcatctggatattaaaaaacaggtctctttagaggcctgtttacattgcaagtattttttccattgccatgacacctacataatggccatcgattttcccctgttgtttaaatactccaactttgcggtattccattgaagtatagaacccttgttccaatcgatgaaaaggaatgtaataatatgatgttatgtattcacgattgaatgacttctttttcgacatccgataagagaacttttccctcgatgattccgctcagcaacaaaaatcttatatttcactgtacgatggaaccaatttgtcatataatccgcagcttttgcagttcttatcagctacatactctctgtagcagaggtagcttgaactcccttaaacgcattcatcaccaaatcacgcacataggaatcattcacctcatcccctgttataagcagacgatagaaaattggtccgtaaatgagatctatgcttacttcaatatcaagattctctctcaattcacctttctgaattcccttttctagaaggcctttcgcttggaggcggcgaggctggaaaaatcgcgtgcgatattcttctgccaatttttcatccaactgccctgcacctattaattccttaataacggttccttcccggcttgtcaaaaacctagctaaattcgtggcgtgggttactatatcttgtactgacgaccctgtatcaggcacaggcagcctgtccgtcgcggtcgaaagaaagctgtccatgataacggcagccttgttagaccaccatttataaatcgttgctttactcactttcgcacgctcggcaattttatcgactgtcaccgcatcgaagcctttttccagcaataggtcataggctgcagagagaatcgccttatgcgttccttcatcacgcggccgccctcgtttactctgcacataaatcattccttcccgcaatataaactatacgttcagtatacttaaattgaataaaaaagaaaacagaaatccatttacaaaactgaacgtttagtatattatttttattaatcgacgaaactgaacgttcagtttataaaatcacttgtgagaagtcatgattacactcaaaaaaccacttaaaaaggagttcattcatatggctaatggaaacaaacaagcaggtcagaggatttcacccagtttaacccttcttctcgcaactgcatgcggtatcattgttgctaatctttactatgcacaacccttggtcggattaattagtaaggcaattggactttctccaagcggtgctggattgattgtcacactcacccaaatcggatacgttgccggcttactattccttgtccctttaggagatattatcgaaaacaaaaaacttattgttgtatcgctccttctaagcgcagcggctttgacactaacagcatttgtgaagcatggaacactgtttttagcagctgcgtttttcgtcggattgggatcaatcgcagcccaagtgcttgttccatttgcatcataccttgcatcagacgctgcacgcggccgggttgttggcaatgtcatgagcggcttattactcggtattatgctttcccgtccgatatctagtctagtcgctgatatctgggggtggaatgcaatattcgctttgtccgccgtggtaagtgttatcctggccatcgtattatcaaaagtgcttcctgccagaaaaccaacagcaaatacaaactatactgccttactcggttcaatgtggaagctgctgcgcacgactccagtcttacgccgccgtgccatctatcatgcgtttgtatttggagctttcagcttgttctggacaactgttcctttattattgtccggtcctgattttcatttttctcagaaggcaatagcactctacgcattggtgggcattgcgggtgcagtcactgcaccaataggcggccgcctggctgatcgaggcttaaccaggcttgccactggaatcgctctcggtgttgtcgttgtctctttattactgccgctcatgattcagagcagctcccccgtcggtataacagttctagtggccgctgctattctgttagatatgggtgtatctgcaaaccttgtgctcagtcaacgtgctattttttcgttggcgcctgaaattcgcagtcgattaaacggattattcatggcgatcttctttctaggcggtgcgatagggtcatcaattggaggatgggcatatgcctcaggcggatggagtacagcattatggattggaatcgcttttccggtcatcgctttgctttatttcatcacagagaaataagtatttcaccaaaaataagcagtcaggaccaagcaaatagcttatttttggtggcttcttctttttttgctatatgttaaaatccctctgctgaacaagaaaaaatcctgcttggtgagtacaggattttcaaaaatcaatctttatgttaaatcgacactctccagctgtttcaaatacctttgcaggcgaaccttcgggtttaattctatatttgtaatatgctttacataccgattcgcactttcggcaatttcttggtcactgattgtattggcgcgatattcggcaaaggaaggcagataggtcatgcctactaaatgggcagatgcttggaacggttttgtcagctcgcttatcgaaaacaagttatatccgccggcttgataagagtgttcaggtgaaccgatggacatggcagttacccactctttccccttcaatttatttccgccgggaccatgagcccagccaaacgtaaacacttcatcaaaccactgttttaaaagcggtgggctgctgtaccagtataatggaaactgaaaaacgatacggtcatgggccaggagctgctgttgttcaaattccacatcaattggttgatcgcgatatttttcataaagatcatggacagttacatctggttcacttaaaacggcttctttccactttttattgatacgagaggattctatattcggatgtacaacgagtacgagtgttttcatatgatccattcctttcattccttagatgtgacatcattatatgatgtatattaaaatataaaaagtacgcacattgaatgtatatagtatcaaaaagtatactattaggagtgaacagcttgagaaatcgtaaactcggcattgattattcttctgatgactttgaaggatgtccggtggagacaacattagatatcatcggaggtaagtggaaaggcattcttctttatcatctcattgacggtaaaaagaggtttaatgagtttcgaaaactatacccaaaaattacccagcgtatgctcacgctacaattaagagaattggaacgggatggcgtgattcaccgcgaggtttataaacaggtccctccaaaagtcgaatactctttaactgagtttggaagaacattagaacctgttatcctgcacatgaaggactggggagaaaaatataaagacaggattgataagctcgaagcagcacgtaaagctgaagataaaatctaataaccagaaaaaataccaagggttttgacgcccttggtatttctgtgattcagaccttcaccggttattcacccacaagcctcaaaaaagtgtttttgattaaattacccgcggcatgtcagttacggttaaaaaggtcattctattttttagtgatgattaagatttctaaaattgctgcccttcacttcagctacatcatacacggtaacaaaggcagttttatcaatatcattaataatttcctttagtttggtttcttctaaacggttgatgacacatgtgatttctttaaatttctcgtgggaaaaacccccgtaagcttctttatatgtggcgcttcggcctaattgatcacgtattgtctctaccattaattcaggttgggttgtaataatttgaaaggttttagagccgcttaagccttcctccacaacatgaatcactttggatgcaatgtagtaagcaatgactgaaagcaatgccccttgtaagccaaatactgtggaaacaaaaataaacacaaataggtttaagaatagaatgagatcgctcgttccgaatggcagttttcgggatagcagcacagcaagcatgtcaattccatctaatgcgccgccattacgcagcgccagccccattccgaatccaaggataatcccgccgacaacggtaattaacagggtatctccttctatgatagcgggtgtgtggtggaaaaagcttgtccccgcggcaagcgatacgattccgataattgataataatgcaaagcttttcccaatttgcttatatcctaaccagacaaatggaatgttgatcacagcaatcaaaatccccagcggcaagttgaatagctgtgaaccaacgatgctaagacccgtcacccctccatcagatacactgtttggaatgagcactgtttctagtccatatgccgctatgattcctccaatgataaccatgatgatttggagaatcattttcgctttaaatttcttatgttttttgggtgtattcataccattcctcatttctcaaatatttctttatatttaaatataccataatagatattttcagctaaaaacatgcgtttttttaaataaagtaactaacagtaaggtaaccctctttgacttagaacattcatgtaccgtgccgcctgttgagcaagcggcccctttcacttcagatcgtgaatcgccctcaaacttcaacaccgaaaatcctaatttattctgatatgatacttaaaaaaggaggtttgattacaatgaatagcctgtgccgcagtaaacaagccccatttgaatacaccttatctcttatagggggcaaatggaaaatgagaattctctatgagttagggtgtgaaaaaacgatgagatacggcgagctgaaaagggctatgcccttcatcacccataaaatgttaagcgcacagcttaaggaattgcaaactgacggccttattcatcggtctgaggtttctcacaccccactgaaagtagagtattcgttatctgacagagggcgatctttgtatcccctcatagatgagatgtgtaagtggggaatggcacaaggagggcctcatatgtaaagctacttacaaaaaagtgcgtacttgtttcccaatgagaggaattttatactgaatgaaaatatttcttaggaggaaataatgacaaaacaagtctatatcattcatggctacagagcctcctcaacaaatcattggttcccttggctgaaaaaacgtctgctcgcagatggggtccaagcagacattttaaacatgcctaatccgctccagccaagacttgaggattggctggatacactctctttatatcagcacactttacatgaaaatacgtatttggttgcgcacagcttaggttgccccgccattttgagatttttggaacatcttcaattacgaaaacagcttggcggaatcatacttgtttccggctttgccaaatcattgcccactttacagatgttagatgaatttacacagggatcgtttgatcatcaaaaaatcatcgagtccgcgaagcaccgtgctgtcattgcttctaaggacgaccaaattgtgcctttttcattcagcaaggatctggcacaacaaattgatgctgcgttatatgaagttcagcacggaggtcattttctagaagatgagggatttacttctttgcctattgtttatgatgttttaacctcttatttttcaaaggaaacccgctaacatctttcacccatctgcttcaatcgagcccgcgaaaagcgggctttctgagttatcgtttgatcaatacagataactcaccttcaaacacttttacttctttttgattataagtagatagcaatactgtgagtattcccaattcatttctctttggctgcttatcaagaacctcaacaattgtaaacaattcatcatccggatatacgggttttatgaatgtcatatgattcatctctgttccggctataatatcgtctccatagaaaccttcttcaatccaaagtttaaaagatatggccagtgtttgtatgccggaagcgataattccattaaatctgcctttactcgctttttcttcatctacatgcatatactgagggtcaaattcacccgcaaaccgcataatatcatcttttgatacttttaatgatttcgttttgaagacctggccaattgtaaactcatctaacttcattcttacacctctattttttcaattgtctattttgtttattttagcactgtgaggagcaaataaaaaattctgtttttcgctaaacagacgtatcgtggcctggactgcaggcactcatcatatacttaaaaaatattgaacagctctcaacacttagtcgtcacttggccgttttgctaaactgaaagctccctcatatcttccaggcagccttcagtttttttatgccttctcttatgtcggattcagaaacccctgcaaacccgagcgagaccgtttttgtaggaggatgatgttgataagaaagagaaacaggataaatttttactccatgttttttcgccttctcaattaactctttttcaccaaatggcaaataaacgtcaagtaagatacgaagcccagagttttctccgcggattctgacatgctctcctaattccctttgcactgcctctaatacaatggctctttttttgcggtaaagttttctcattctgttgatgtgtttttgccactctccattttttataaattcagctagggttagctgactgtggcaggacactgtctgcttatataaggacgtgatttcatgacccttttttaaaagaggcgaaggaagaatcatatagctgatacgcagcgagggcaaaagagacttagaaaaagtgcccatataaatgacacggttatgctgatcaagcccttgcagagaaggaaccggctgtcctgtgtacctaaattccccgtcataatcatcctctatgataaaggattgattttcggccgcccatttgagcagctgaattcttctgtttattgtcattatggttcccagcgtaaattgatgggaaggtgtgacatatacaaggtttggctgctgttctttgatcttctgtatacagattccctcatcatcgactggtataggaacaatattcatgcggttggcttcaaaaatcttgcgtgctcttggataaccaggatcctcataccctatagaaatattcggctcaaaaacttggcacaagatttgcagcagaatagggttcccggcacctataatcacttgttcagggccgcaatgaaccccccgagattgatacaggtactctgcaatgagtgttctcagctcaaactctcctaaaacatgtcccggccgataaagctcgtgtccatattggtctaagctattgaccatgctttttcgccatgcggaaaaagggaagtaagaagaatctacattcccataatgaaaatcaatccattgtttattttcttctgcttcttgttgaatgggtgttgtgcttggcattctatcataagcaaaatcagaatcatgataatcagcaaaccacccgcttcttggcttgctcacaatataaccttcagcagcgagctgttcataggcacgttctacagtcgtttggctgatggaaagctgattcgccaggagtctttttgaaggaagcttcattcctttttgaatacggccccgatgcatattttctttaaaataccgataaagctgctgataaagcggaatatccagagttctattcaaaaaaggcgtgatatccatttgcgcgttgttctcctaactggtatgcatttttttatgaaaactggctgtttataaaaggccaattccagtttatagtcattgtaatccttagctgctggttttgttaagaaaatacagacaatgaacaagaaagatatgtggagtgattataatgaacaaaacaacaaatggctggataaatggttttataggcgtactcattttcagcggctcgctgcctgcgacccgtttggctgtgtcagacttcgatccgttatttctcacagtttgccgtgctgcgatagctggtgtactggcgggaggtctccttctcatcttccggcagcagcatcctgccaaaagagatctcatttcattgttagtggtagcgttcggcgtagtgattggtttcccgttgctgacagctttagcgcttcagcatgtcacatccgcacacgccattgtcttcattggacttcttccactcgcaacggcagtcttcggcgtactgcgcgggggtgaacgccctcgccccgtcttctggattttctcagctgccggcagcttgttagtagcaggtttcgccctcattcaggggggaggttcatccccgcttggcgacgcgtacatgctggcttctattgtcgtatgcggtcttggttatgcagaaggggccaaactttcacggcgtctggggaattggcaggtgatctcatgggcactcgttctgtcgcttcctcttatgctgccattgtcgttcttttttacgccggactcatggtcggcgatcggcgttcccgcactgctcagtcttgcatatgtatccttattcagcatgctgattggcttcgtgttctggtatcgaggtcttgcccaagggggaattgcagcggttgggcagctccagcttctccagcctttttttggactgctgcttgcctcagtgattctgcacgagaaagtgggctgggcactcgtagcagtgaatatcgccgttatcatgtgcgttgcagcagctcggcgatttgcaaagtaaggcagacctttaagcataaacttcaaaaatgcatgaaggtataaaaataccaagggttgctggcccttggtattttgtatgcgatcgagcagacttgagtctcccgcttagacatataagtcaacacccatttacctgccgccattatcaaatccgctctaataaatcccccactttttctgccatgacacgaggtggataaggcatttcgtttttgtttgcatttatatcccactttacattcaatacctgaagaaaaaggggcaaaacttcttaagattcttaggttttcgcgatgctattcaagatcgtttcctcttcttaaacagttttcaatatcatcctatctattccatggtaatatttagatacataaacttatatatgaagctgacctgaattaatagagaggaatgaaaaaatgaagaaacgcagaaagatatgttattgcaatactgccctgctgcttatgattttgcttgctggatgtacggacagtaaggatggagaagcacaacaaccttcaaatcaagcttctgctgtgcaaactgacgaaaaacacactgagcctgaagagagcaccaaaatacgcaaggatgaagcggagccaataacagaatcagaagaatccgcaacaaaagctgcaaatgatacctcttcagcagaagagaaaagcaaagaagacaatgtattggcagcatactcttcggaaaaaattgaatatgccagagtttggcttcaacttggacctaatcaagagatagatgaattaaatgttcgacatattgcggctggcgagccaattaatcctaatgatgatacaagtgccagctatccagaaaatgtgacccagttggcaggttctcgtttagtggatggatcagtcacttatcatggcaatggggatggcacaattcatgtatataatgtgcctttacgctgggattccgctgatgatatagaaaaaggcgtcatgcgggaagtgactgagagtatcataaaaaacagaaaaacagtgtacgttgatacaggcgacgatgaaaaaatcaagcggctcattgatatcatgatgattcattaatcagtattcgtttgtctgcacctgactaaaaacaatggttaataaggtatattaatacaaaaacaaagtttggagtgtagtaacttgctaaaaatcttccggttctattagttctcctaggcattctaaatgtaatgagccataccattgagctatttcattggatagatttctaggtgttgcattaatattttataacgctgtctagtggcatacaatgttagaagcatttcagcagtaagtgaatgttgtcctaagaaaaaacaagcatcttactatgcttgtttttcttctatagaaatgatcttattacgctatgatgctattcctttagcctgaaccttggcgtgcctaatcctttaatccctttccatcgagaattttttgcacatatttttcgactctcgattctcgggttttggattgtttggcttgagaaaaataaagagtgtacgctctttgccgtcccggggtcaaagcttcaaaagcaattttcaatgcagggatttcatcgaatttattttgaagttcttcaggaatgttcaattcaatatttttgttaacatccactttcaaaccggctttttcaacttcaatggcttcgtgaatataggctttcaaaatgttttctagctcatttatttcctgaacatttgtaaaccgaatctggcgcgccgcctgtacattctccgtttgttgaatgagaattccatctgtatcctgtaataagacgcctttgtggaacagaagcgcgcaatattctttaaacccatgtattaaaacaatatttttattatgatatgtgtaacaaggatgcatccacttaaaatcttcagtcagctcacagtcaagaatgatggttctcaacttctcaaattcttccttccactttttcgctttacttaaaaattcatcaaccttcggatttgttctgctatttgtcatgaaggaattcccctctttccaatctttttacatttacgtgaattcacaataatgaagtccagttttatttttgacatctcggtatttattttattcttctataggttccttctcttattattcaatagattaagctcaaagtggggatgatgcaacaacaaaaaaagaaggcccacaagccttctctttttgtataattatttcactgacaatctgaaaaaataacaattcgatgattatatatcttttttattcttgccaatgcataaggttacggcaacactagctatactgactaaagttcctgcaatagaaactagaattgtcaaaaagccattgggaataagaaatccaattggaatgagccccagaaaagtgaaaacgataaaacattggtatacaccagatattattcttacaaccaaattgccaaaaaaggacatgactaatggagggatcaataaaaatacaacgattccaattgagatcatcaagataataggttcatcaaatgagatgacatgatctccaggcgactctttagcagccgctaaaacaacaacgatagacatcattagtgtaacaataacaagagaaaacctttttaacaacgttatgactcctttacctaaagcgagtaatcctgcctttttcaaatccgataaccattttatgtgattcaattaaagaatatgcagtgagtgacacagctataaggaatcctggtcaaatctttataatagatttaatggagcaactatagttcgttagaatattagatgctgcaatatactttatctaacaatataacaaattaatgtaaattaaacaatcctaccctttagcggcccctagaccataccaccaccggaatgagtaataaggacaaaatccctccaataagtgataatgcgaggtaacttgaacctgccacaatcattccagataatgctccgccagcagctcctgacaacgcaatcagaacatccactgtcccctgcgttttagctcgtgtggcagtatcagttgaatctacaataagggcagtcccgcttatcaaaccaaaattccaccctaatcccagtaaagaaagagcaatgacgagaagaatcatagattctcccggagcaaatgctgctattacacctgccaaaagcaacgttgttccagaggaaatagccattgcggtacgtcccaacctatctacaagaacacctgtaacaagtgaagggagatacatagcacctatatgaaaaccaataacaagaccgactgcacccaagtcatgcccatgatgtctcatatgaaccggtgtcattgtcataatagctaccattactatttgggtaagaaccataaccgttgccccaacgattatcccttttttgttttctgtatgctcagttgccgccaaatgtcctttatcaccaggctcttcatttgccgcttctattgttcttgctataactaatggatctggacgaagcataatgaaaaggaccacacctgctaacatatatgctgctgcggctaaaatgaaagggccagcaagtgatggaacaccaatagaaagagcgaaatcccccatcacattcactaagcttggacctgccactgcgccaaatgtagtaaaaaccatggttatactaacagcagtcgctcgctgcttatgatttgctaagtctgtacctgcataacgggcctgtaaattagtggctgtacctgcaccgtaaataagcaacgaaataaataacaagaaaatactatttatgattgctgccataataacgcctattgctccaagtccgccaatcataaagccagctgaaagacctgttcgacggccataacgttgagaaagtcttccaacaattaatgcagatcctgctgaccctaaagtaaataaagcagaaggcaaaccagcaaacgcatcagtgccaagcatttgctgtgcaataagcgcaccgacagtcactcctgccgccagccccgcaccgccaaaaatttgtgagatactcacaacgaatagtgtacgcttgtataacgatttttgtttttctggtgaactgatgtagctctgtaatgaagcagtttgaacatctattgcttttacgctgtccttgtctaacatcatctgaccttcctttctaaaagccaattttgtataaacctccctctagatgtggatcatcataacacgcacaaaaaagccatacaatgtcataattgtatggcaaacaatattaggtaagatcgtctagcaaacgtctcaggatcattaatccttgttcaagctcttcaagtgtttttggtgcacagacagaaacccttacagccctttcaggacaactatttcccactacaaagcgttcagccgcatacacttgcacgccaagtcgagcagccaattcttcaaattcggcaccagacattttacccggtaacaacaaccaacgaaaaatgcctgtttcaacacctaaacatgtatatcccgcaacatatcggtttacgagttgatttctgcgaatggtttgttcacgatgactctcaattaagacttcaaattgatttgatacaatcgtgcgagcagtaagttcagctaatagcggggaaacagttatatttaaattataaagcgcctttgatattggctccttatattgtctcggcactgctacataagccaaacgcaggcctggcgctaacgattttgataaacttgcaatatgaataacctgttgcggtgcgaatgaggcgagtgccggaagcggatttttgttgagaagatggtacgatgcatcctcaataacaaacagattatatttctttacaatgtctgcaaccattcttcgattctcaacagacataaaggaagtcgtcggattatgataatccgggattaaatacaaacctttaatattttcgtttttacacgcatattcaagtgactccggactcatttcatcgttttctgattttatcggtacgatttgcacactaagcaatgatgcaacagtttttaatccagggtacgtatgatggtcaactccgatgcgatctccaggcttacaaagactcgccaatgtcgctgcaatcgcattttgccctccatttgcaaataaaatgtgatcaacggatgtttcaaatccgcctctttggatgagctttacagctgcatctttttgccaaaggctttcacctgcccggccatagctaaaccatttttcataatcctcctcatgaaccatgtttttcagttggtataacaagggctcatatgaagcgtgatctggaagtattgctcccatttcaattaaatgtgtcggcttagtatcctcaagtaaatacgcattcgacaacgcatcatacgatacaaatgtgccgctccctacagtcgcactcagcagcccttttaactcacacactttaaatgcttttgaaatcgtactcacatttaaatctagataatcggccaattctcgctgtggaggaagttttgttccaggtaataaaactccgtttaaaatatcctgttccaattgccctgcaagtgctttataaataggcttttcagctttatcaatcgatggcttccagctcatcggataattttcaaaagaattgataggcatgatacgcatcctttttcactcaattatatgaatgtgccgtttataagacaattataactttcttttattgatgcctttttatgaacagcatgcttcaataaaacctgtacaaatacaagtgaatcacttactttatttcatataagtcatcctgcaaaactgtgcacagaatgtcggataaatacatttcactcctgttattctttggttaaaggaggccaaataaatggatttgcttaaaagtatgaatagggcgttaaagtatattgaagaaaacctcactaatgatattgattttcaagaggcagcaaagcttgctttctgctctgaatatcattttaaaaggatgttttccttccttgcaggtatttcattatcggaatatattcgtcgcagacgtcttactcttgcagcttttgaactgaaagacagcaatgtaaaagtgattgatattgcaataaagtacggttataactcaccagattcttttgcacgggcattccaaaatttacatggcataaacccatcaaaagccagatttaatggccattcccttaaagcttatccacgaatgaccttccagctaacaattaaaggaggaaatgaaatgaactaccgtattgaagaaaaagaggcatttcgcatcgttggcattaaaaaaagagttcctattattttcaaaggaattaatccggaaattgcatctatgtgggaaagtttagatgaaaaagcaataaataaactaaaagagctatctaatgtagcaccatcaggcctcattagtgcatccacgaatttttctgaaggtcggacagaggaaaacggagagctcgatcactatattggcgcagccacaacgaaacggtgtccagataacttctcacggcttgaagttcctgcctcaacatgggctgtattcgaatcaatcgggccatttccggatacactgcaagaagtatggggacgcatttattccgaatggtttccatcgtcaaattacgaacaaatagaaggtccagaaatattgtggaacgagcataaggatgtaacatcaccatcttttaaaagtgaaatttggataccaatcacaaaaaagtaatacgtttttcaatcagagaagaaaaattgaaggttcttgaagaaaaaatacctagggcgtcaaaacccttggtatttttgatactgccgagagggctcaaactccaccagtgtttttcattgccggaccggtcatgtaagcaaaaaaagcccctatatatcccgatttgcatgattcctaatctttaatatcgatttttcactctccatagaaggctctttatgtaaagccaatattaaagttatccctataatacaaatagcaccaatccattgaaaagaaccaaatggcgcttttaaccaaacgacagttgttacaacagctgatagaggctctagactgcctagtaggcttgtttcttttggagagaggctttccaagctttttatgaagaaccagaacgcaatcattgttccaaataatatcacgaataagatatatgcatacgcctcagcagttaatcgttgaaaatccagttgccatggcggatggataaaacccaatgcaaaaccgccaataatcatagcccaacctacaacgacaagagaatcaaatttatttaataaaccaacggcatacaaagtataaaaagctgccgcgaatcctgataaaactccccatactactgcagctgccggcactgaaagttgagacattgaaccatttgttaacaaaaaaaagcaacccactaaagcaagtacaacagttatgatatcttgtttggtaagaaccgtttgttttcgcaacagcgtgtagataatgacgattactggggataaatattgcaataacgtagcaacggcagcattcccatgttgaatggatgccatatatgtgtactgcacagctagcattcccaataggccaaaaattagaagctggccagccgacgctttgtgtttccacacctcaataacctgggaacgatcctttctgaacagttgcagcattaaaagtaacattccagccgtaagcaagcgtgtcgttacaagccaattgacatcaatttgatattcttgaaaaagttttttggctactgtgcctccaatcccccaacatgtcgcccctgtgataacatagaacaatcccattcttctattggaagtattcatacatgactcctcactaataaatataataatagtgttataataaatgcaaaacatgataaaaaatactcaaattgaatgaaaaaatataaatatattgaggtgtgaagtcagaatgaagaattttgtgatcgatcaaaatttaaaagaattaacagagcaccgaacggtagaattgccagttgcctgctacaagacaacgatcaatcaaaatataaatggctatattccgcttcattggcatgatgaaatccaatttgttttgatactaaaagggatagctctctttcaaataaatgaagaaaaaatagaggttcacgaaggggatggattatttatcaatagcggctacctgcacatggccgaagaaaaggaaggctcggattgtacgtatatttgcttgaatgtgtcaccccatttcgttttatctcaggaactgtattcaagctatgttcagccctatatgttttcaaccaatttgccctatttatttttggctggaaatcaacagtgggcaaaaaatattctagatgctgttaaaaaaataaatcaattgattcaacaaaagacatcgctctatgagattgacattacgatgcaattaacgttaatgtggaaaaacctggtcgttaatggttttcaattagagtacgatcaatctgaaatgataaaaagtcatcgaatgaaacaaatgttaaactggatccatctccattatgttgaaaaaatcacattagaggacattgcaaaagctggccaactgagccgttctgaatgctgccgttattttaaacgaatgctgaataagacgccattacgttatgtaatggattatagaattcaaaaaagcttattattactgcaacaccctgaatccaatgtgacagaagtgtcttatcaagttggatttaacagtaccagttatttcataagtaaatttcaacaagcgatgaatatgacgccattatcatacaaaaaaatgaattcataaagtttattctattaataaatggagtccctgttaatggtactcccctagcacgatttttacgccactactgcttgaccctaaaattctaggtggccttttgtatttgggaattgtttcaacagcttgtgcatttttattgtggaaccacggcttacaattattaaatgcctcaagtggaggcctctttttcttttttcagcctctggttggaaccttactcggatggattctgcttggagaacaaataggcgggacattttggataggttcgtttttaattctgagcggtgttttattagtcattaaagagaaagaaaaagaagtgaagtcataacaaaaaaaagcaaactattttatatagtttgcttttcaattaaccttgttctttcccctttacttctttatgttctggtcttcatttataatctctcctttctttatttttcttctcgcctcaatacccatttgaaggttgtcaatttccctgataataatgccaatttggtggctaaatgtttatcaacaaacctttttctgcttgcaagataagtgaaaatgcatcattaagtaagtcggccgttatccatatcaaatcggtaaagaaattagaacttaatcatgtgctttaaatatttttagctgacatttcacgaatatcgttctttcttatctactcaaatcatttctgtaatgtcattgagccaatgaaaaactgctcacacggatcaattgaccttttcctgattggaaatccgacacgttccctattgtttttgcttgatctgttttttcaaaaaagttattgacatcaaaaattcgatcatgttattattaaaattttgatattacacctccatatatggtaatcttaagaaggataccatatatggaggtggatgatatgtttcaaattggcgataacattgtttatccaatgcacggagcaggtataattgaagccatagaagaaaaagaattcttagaggaaaaacaacagtattatgtcataagaatgtcaatcagtaatatgacagttatgattccaacgagtaaaatattgagttcgaatatacgaccagttaccgatatacttgcattaaaacacattatgcacatttttcagcatggagaatccgataggttactgccatggaagcaaaggtacaaaataaacacggacaaaataaaaacaggtgaaatacaagaaggtgctgaagttgtacgtgatttaatgcgtatgaagaaagaaaaagcacttaatgcaagcgaaaaaaaaatgctggataatgcatatgaatttttgattagtgaactggaagtaattaaaggaatcactgaaaaacaaataaaaagttttggttagatacatcccaaaagatatttcggaatattatgatgaaaagcaaatcttctccaacttatgtttagaacattaacgacctcttttgttattcctacattctaatccatttttattatttacatttcttctgcgaagattgaagttttaccaaaaaactcaataaaatagtcactttttttagtatcctgattcacactggcacggacaaggagccgtaaggatggaagagaggtagggctttcattgttttaggtatctctaagtgattatttccaggagaaaaaaacaatcgatctcctcattatttttaagaatttcttatatccactgcaacattgaataataattgtttatcttcttctcataaaagagatatgcgagttgataacatttagatgaaaccatttttataattcatctaatcttacttaaatgaacgaacaggttagtgaaaaaaagagtcagttatctatatttgaacaaaacattaaataatttatatacattccgcatattgtcaatccagtatgttatactgtaaacaaacctttgaagttttaaatctttttctattaccttgtagcatctccctactcgaacgttgagtagggttttttattgagtatgatatagacataaaaaaacaggccctatataaagagcctgtttgtataaacgattgaagattaagctttttgaacgttagcagcttgagctccacgagcaccttgctcaacgtcaaacgatactttttgaccttcgtctaaagatttgaatccgtcactttggattgcagaaaagtgtacgaatacatcgtctccattttcgcgttcgataaagccaaaacctttttctgcattaaaccatttaactgtaccttgttccatttttgttgcctcctagtgtgtaaccacacagtatatactatccttgcccaaagtatcatcaagacgaaaagtcaatcttcatactatcctttacaccgaacaaaaataattcttctttattatatcaggaatcggaaataactgcaaattaatattgatggcattatttgttaaacttgacctcaaatcatctttctttgctttattaggaaattcaactcaatcgcaaagccccctattcgggaaaatcatttccagcaaattaatcaacaaatggatttccatatttatcacaaaaatgataaaaaccataacgattcatatacatcattttctctatgttctcaggagtatcaaaatcaatcatctctaaaattaaattagtaaattcaataggggcagttccattagcagtaaccaaatttttatctcttactgcttgtttctctacaaaactgctaatcggtttatattgtttgtaatctttccataagtaaacaaaattacctgtatggctatgattattcagcaaaccattcttcgccaaaaaatccactgcaccgcatatcgctgctattggaatgtttttttgaaatgcagtttttacaaaatgtaatagttttttattgtcattactccaggaatccccgccaatcataactagcaaattaaaatttgcaggttctaaccctattatgtaatcgacagatgttttaaaaccacctattgagcttacaatagggtctaaagaaacagtgtgaaccgaccaatcttctctttgatttaatgcagatgctaagtaaacaccttcccaatctgcatactggtctaatataagaaataacgcctttttcacaactatataccgccttagattataagttttttattatccaaccttttcgatttgttacgaagaaaaaatactctatcttccgtacctgcccttccccaacaatttggggtcaggtgagtgcgataaagaggagtgttcatcacatccctgtaatctttgagtaacgtttcctcttgcaacattcatacgataatatttcatcagaaagcattaaatctcctgttcatgaaaataatcaacgacttcaattgattatataagctgtaatctccaatttgtttcatttttcaaggaataataaagaaggatactacataagtaacatccttctttcccaactttatgacttttaatttgcttgctgtgcttgttttactgattctttgctaaaaagtccaacaatattccacaacacaattacagaagctattattaaacgagtagtactgacttcttggttagtaaataatttataaccatatattgatcccaatgctactatacaaaaaacattgaaccatttactccaacgcaattaaaaaactcctttttaattaattacatctccatacaatctgtatacatttattatagtaccagtattttattgaaaatatataaaatttttcaatatctaatcttaaacctttcttaactgatcctacaaatcattactttcacacttgttacgttggcaaaataaaaagaagactacacgttgtaacacccttttttatgctttgacttccatataaacttttgagcttggcatcaaccgtccggctaatatcttattatttagaatgtgtagcgatacatagaaaaactaaattagcaagaaaaaaacatgttatatcaaaattgaaccaagttttttccaagattcctcagacgagggattttacttctgtataacaaaaaatcactttgtcctttataaagacaaagtgattttaaaattagctattaggtaaatctacttttgcaggagtacttgtccaaggtttgcccattttctttttatgagctttatcttcaaaaaattgaactgtagcatactgataccaactatcagtcattgctcctttttcgtataaatcatatttataatacgcatcagggatttgttcttttgcccaataagagaataaaatagtggcagccttactcccccatcccaagccagggacaataccgactaatgacattgtaactgataacgcatttttagctgcttttgtatgcccagataaagtccccacataatggtatccctttttaggttttgcagcctgtgttgtgaattcatttgatttcaaattattgttttcataatttgttcttttagcaacattttcatcatactcaaagtttaaacctttttgttctatgccatcgacttttacagtatgattatttccgttcatctgaactttgtgagtttcatttccactcacatactcaatttcaactaatttcccgttcgatgaaatcttttcacttttcattttgtaatgtagagctagttcttcgtaagaaggggttgtcttagagtcctcctttgcagaagcgtaacctgcaggtaaaagtgagcctaaagtcaatgatgcagccataacacaagtaataactcttttctttctcaattgaaatcctccttgtgttacaccttaagaatctgaattactaaatacttgcttaattttataagcaataacagcgaggtataaaattgcaacaaacactaaaactccagtgccataatcagtttttgcaactagaaaaagacttaacacaccgaaaataatgtacataacaatatcaaagatatttttcttgttgttcatataaactcccccgtttagcaattgattccaggtgcatatttgattgcagccccagtgtattaaacacttacaattttgtccaattgaaactctctggcaatattactttaatcatatcgcaaaataattttttgaattattttcagcacacctactctaacatgattcttttttgatttacataaaaaatcgaaaaattgagtcatttttccttggagaataagtgtgtaaatcttaaaaaggactattcattcattttgaaaattagagatacatacgctaatcattttattttcattaaaatccttttcgtgtttgttaataatatggagaggtgatgaaaacaaaaagaaaacagttagaccaaaattgactgaacttaatgccacaagaacaccgtacaataataaaagtgataaataattatctcttccgttcattacatgctctctgaatcccaaataattgtgtagttatacacatgccactaatgccatgtcaactccttactataataaatagaaaaaggaggttccggtaaagtaatgtctacttaggttcttcaaagacagttatataagcttatgctttttcctgaatccttctaaaataccaaataactactggaatgagtaacaatgataaaacggctccagaaattgatagtattgtataactagaatgtgcaacaaccattcctgacaaggctccacctgctgctcctgatagtgctaataaaacatcgaatgttccctgtgtttttgcacgtagagatggatgtgttgaatctataataagggcagttcccgttagtaaaccaaagttccaacctacccctagtaatactagtgctaggattagcaatgataatgagtctgccggtgcaatagctgccaccaacccagcggcaagaagtgtggcacctgaagcaatagccatagttgtgcgaccaaacttatctactaataaaccagtcaatggtgaaggaagatacatcgctgcaatatggagtcctataactaatcccacttcgcttaaaccatgaccgtgatgacccatgtgaaccggtgtcattgtcataatagctgtcatgattagttgagctaaaatcataatgacagctcctaccattattccttttttgtctatagcaggattttttagacttcctcctatttgtactttatcgtcttttttctcagcattcgcaatagctgttgatacaaacagcggatctggacgaagaaaaattaagagaataattccagcaattataaaagctgctcctgacataataaacggaccagctaaattgggaacaccaattgaatctgcaaattcccccattgtattaactaagttaggacctactacagctcctaaagtagtagaaactaaggccatacttgcagcagttgcccgttgtttctcatttgcaaggtctgtcccagcataccgaacttgaagattagaagccatacctgctccataaataagaagagaaacaaataatagggcaacgctgttaattaaagccgcgattatcacacctatagcacctaatccgcctataaggaaaccacctgcaagtccagctctgcgaccaaaacgttgtgaggatgctcctataagcagggcagctacggcagatccaaaagtaaagagggcagttggaattcctgctacattttccgatcctatcatatcttgtgcaagaagcgccccaactgttatcccagctccaagtcctgctcccccaaatatttgtgaaaaaatcaagatttttaatgtttttttataaagttggttttgtttttctggtgaatcaatataaccttgtaaccaaagaggctgctgtgttgatatatttgtatctttttttgtcattaccatgaattctacctcctaacgacacatctttgttgcttttcaagtttttttgtcatcattggaacattccatttttgttattccgtatatttaggattttcgatatatttaaaatttaaaatattcattattagaagaagctcatgattagtttttataattatgagcttcttctatttatttgtcggtgttcatattaaaatgtgtaagactcgccatcttctggcactaaaatattacttgagaatcctttttctttactaaagttttttaattcttctctagatagtgtccaatggttaacagcttccatatgaacagatataatcttagcatgaggagcagccttgtgaacttcatagatgtcttcttttcccatgatgagtgaacctaaatctaatctttgattgtctccaccattaaccacaatgatttctggttgatgtgtatgaatctcgtcttcgatagcatcataccaaactgtatccccagctacatataaaactttttcacttgggtgcttgaatactaatccacaaacatcacccattaagtttaataactcttcccctctgccatgttcaccttttgtttttactaattggatcccttcaaaaacagtgtcttgatgtagcacttctacatttttgaaaccacttgcttttacttcttttgcatctgcttcattttgaacaaacattttgatgttttttggcaatacgttttttgccacatcatcaaagtgatctaggtgtagatgagtaacaattaccgcatctacgccatccagaatgttatcaattgatgttggcaaactcaccaaaggattaaataaatcttgtctgatcgtttcagggaaagtagcgtacgtacctttctctgctaacataggatctatcaaaaattttttatttgcgtattttacaacaattgttgcatttcgaatttgtgtaatattcatatttacaactcactttctttttttatttgtcttagatcgacagagttaagtgtataatatcagcagtgttcgaatacatagataaaaaaaagtgttttaactctttgactttattttcgaaaggaattaacgttcaaatagatcaaacagataaaaaattatagagaaattatgtataatagccgaattcaatgaaagatctgggagagagtacatttaacatgcccagcagctacagctagagtagagaaattagaagagaatggagttattgagggatctaacattaaagtaaatcaagcaattaggtgctttatgtaaaccttcatcaatatctatatttatggcaaaaacaatccctgtatatggtcttactatggatcaaaaacaggacatcttgatcttttatcagatgggaataatgatactgaaaaacaataaaagataatgaataaaggatgtccagaagtatttttctgaacatccttttttaagttgttgaatcatctttcttgtgaaaagaaagacgttatgttcgcgcaggaaattcttttattttaaaaatgcctctgtggtttttactgttgcatagacaccatttaatgcggccataaatgcgtaatggacatgctcagcaggaacgattttatcttcaatttgcaatgttgttgttgcgcaagcatcttctaccacttggcatacataaccatgttcaactgcagaacgaactgttgcatcaatacacatatgggacatcataccgcaaacaactaattctttaaccccttcttcttgtagctttccatttaaatctgtattgaaaaagctattcggcatatgttttacaatgactgtctctttctctaatggacgtactgactcatgaatttcgacaccttctgtatttggatggaaaaaatgagcgatgttaccttctgtgatatgctgtacatgaaagacaggtgcgcctgtgtttctaaagtgtgaaagtagtttagccgcattttgtgctgctttctctgggtttgttaaagccatcttcccatttggaaagtaatcattttgaatatcaatcactaataaagctgttgtcattttttcacctcttaaaatttttatactgtataaggatatataatttccattgaattttcgatggtctcatgaaatactattttgtaaaactttttcactgtgaaaggagttactatgcaaattgattcaattgattttcaaattctccaattattaaataaaaatgctcggatacaatggaaagaaatcggtgaaaaaattcatatgacaggacaagcggtaggcaatcgcatcaaaaaaatggaggataacggtatcattaaagcatattcgattgtggttgatgaattgaagatggggttttcttttacagcctttgtcttctttttcatgaatgcatatacgcatgatgatttattgaaatttattgctactcgtaatgaaattagcgaagctcatcgtgtttcgggagatgcatgttatcttctgaaggtaacggttcattcacaagaagttttaaatcaccttctgaatgatttattgaagtatggaaactatcagctttatttgtctattaaggaagtaaaaaagcattataatacttcattaatgtctgatgaataatgcgcttgttattataatgtataaaaaggccccagcttggtaaattccatatccaacctagggcttttttagagcatatatatcatgttatatgaccgcacatctccgttttataaagttaactatttaccaataacaatcgacactttatagtttgcatgtttatttaagtcatttaaaaattgatctaatacctcgtttgaaggaaatttacattcaagcaaatagcaaccgtctccactaactttataattgtttattacatagttatcttgtgtttctataaaagctaaatagggttgatgatggattttttcgatataaatattaagaaaagcatgtatagagaagcctaatttcacttgattcacttcgatactacatccttttattatgccattgtctattaactttactactcttgatgcggttgctggtgcagtgagatgtactttttcccctaattttttcattgtaaggcgactatttttagacagctcatcaagtatttttttatctatttcatcaatcattttcttgtatcctttctgaaaaataagatgtattttacatattttgttcactgaacatttttttatgtttgcttaaaactttaaaagtaaagtgaaattgtgaaataactttattttgcctatgtattgatcgtttgagaaagtatatatttatttgcatgcaaatcaaagaggaatggacaccatttaatatgaaacaatttttcaaaatgttttttccattgatcttgtataagttcattattttagaggtgaaattatgaaaaaatttgatatatctgttttatcagttgctccattaagacaaggagaaacaatgaaacaagggattgattctgcagtgtcattagctaaagctgtagataatatgggctataaacggatttggtttgcagagcatcataatcacgacgcttatgcaagtgcagcaaccgtatcaattgtacaacatatattagcaaatacaaaagacattcgcgtaggttcagggggtattatgttgccaaatcattccccattaatcgtagcggagcaatttggaacacttgaaacattatatccaaatcgtgtagatttggcattaggacgcgcacccggaacggatcaaaaaacggccgatgtgattcgtcgttccaaccataatggagtgtttttctttgaaagagaagtaaatgatattttgcgttttgtcggggataagagtgtacagggtgaggttcgcgcttatccgggtattggaacgcatgtgcctgtttttgtgttaggatcctcaacggattcagcggaaattgctgcaaagcttggtttaccctatgcatttggcgctcaattttcaccccattcgatggaagaagcgctctctatttatcgagaaaatttccaaccgtcttcttatttacaagaaccttatgtgatcgcttgcattaatgtgattgcagcagaatctatagacgaggcatcttttatttctgcaagtcatttgcaggtgtatattgatatttatacaaataatttaagtaagcttattccacccactgaaaacttcctagaatcgttatcacagtttgaattagaaattctccacagtcgactggggtatacaatcatgggtgatcgagaaacaattcgtcgcgaactaattgatttccaacaaatgtatcacgcagatgaattaattgtgttatctaatatttacgaattgagcaaggaaattcagtcgtacgagattttaaaacaggttgtggatgagttgtttaaaaaaagaatggagcaactttagaaatcgagtcagttgtattagcttatgttctcctcaagcgcgattgttgaacaagaaagaaaagggtgatacatattaatcatgtataatatgtatcaccctttagtttttttgaacgaataggacatggttcgtttcttttacaatgaacggatatctttttcctaataaacagaaggaaccgccgaccgtttggatgacttactttaagtaactggtgagttttggtgagcaagtcttctcccatagccgtattttccacacaaaaaaataataccaaaggtggttaaacccttggtattattgagatgcggccgagaggacttgaacctccacgggttattcacccactaggccctcaacctagtaaaatcatatctttatttacaaaagcctttatttatagcattaagttattttatttacactgattttcatgatttgttatttattctgggcagtaaatgggcagcaaactcatagttcgcccttttcaacaactaaactctataaacataccaccattgtttggtcgttctgatgtttgcagctaatcttctttctaatagtttattaaaatccagtacattacgatctcttatcagaatcatttagtaaggcagctgctacttttaaactttcataatcatgctcgtttttttcgactgtaccgtacgtttttaaagatgatgtaactgtccctattagtttatctgcttttttatctccatcaggaagttcataaagaacttttcttattgtatttctccaaaaggttagttcttttttataatcgtttaacttagctaagaggaggatttgttttttcttctcatgatattttatcctatcagtttcctcaaacgcttggttcaaggtctttcgcagctccgataattcctcgcttttcttctttgattttttatcaagatcttttgcattatcctcaaattctttgatttcatttttcatttttgcataatacttatcccatcttttgttcataatcaatgctagtatattaagcattataaaataaatagatgacgtaattataagattgattaattgtttttttgcaggattaacaatctgagattcataatttacagaaatgttatttccatttttatcaattctaatttccttatcgtttaactttttttgtgttgtaattagcaactgaacgctattattttcaacgattttcgcaatctcaaaagtggaattactttcaactcctatattgttcttatctgattttacatttataggctcatttgaactaatttgttttacatctagtttttgcggaaaagttattcttaattccttaatatcatgatagggacttatatttattggcgtgatatactgaccggaaacttttgtaggttgtccaatactaactgtcgaagtaccattgtaataagacccaacccaactaatgataaaagtgatgattgttggtattagtatagtccaaatgtattctgtgactttttcttttttaaacatattttcccccacctagcttgcctttatataatctactttttaaacaaaaaataaaatttaatataatttctttctgatagttagttcactttttataaataaaagaaaaagcttaaccttcgaaaaaagattaagcttttttcctcttttccaattatctaagctatgcccctacccgatctgcagcaactttaatttcagtattatgatcactttgcaaataagttattgaaaatacactacttaaaatcactgctgccaatagaatccggctgattttcatcaataatctccccttttttaatttttcgtcttgcttcaatactcatacgataatattcattagagagcattaaatttccttgttcatgaaaataatcagcgacttcaatcgaaaaattttcaacatcagcaaacatttttctcgaagccagatatgaaaatgcattctttattaattgagtctcaccatcagaaaaaaataatccctctaatattttgaatttcgctgagtattccttatcatcacttttatcggcaataaatcgccctttcctaaagtatatcaaagcaacattataattttgttgttttgcttctacataggttagagtgaataaagtctttgttaagaaactatgttttgatttttcaaaaatttctaacgctaaaattaaatgttgtgaagccttcttatattctttcaattcatcataacaaatcccaatattcatatgtgacattgcaattaaatgctctatgttactttccttggaaatttccaaagacttcaaaaattgttccaaggctctttcatattccaatgaatcgatcaagtttcctgctacaataaattgacaacgcacagtctggacagcatattcttcatactctctaaatattttgagtgcacgatttgcataattcatggagaagtatgtttgtttcatataataatatacataggacactttgaaaaaaaactctgctttctctatttcatcctcaacttctgacaactttgattcagctattcgataagcacttatcgctgaaattaattctttacgcctaaactcgtacatacccttaaaaagtaaaaatagtattccaacatgccagttaattgcccttgcttctcaatttcttttatagtctcataagcattattgagatcttctatttccttagatttcatataactcagcattatctcatgtctaaattctaatagttgataatataacagggcatcttgattttcttccatgtttaacaattctttctctacttctgtttttataatctcggcttgctcaacttgatcattttttattgatgtataccattcatttaactttttcgtgactaagtcgtacggaattttatctttatctaagaaaacaccccgcaagaaaattcccccatccttacataaaattgtgcgaatttttacattaattgtattatgtcagaataacctttattttacaaagatgaattgcaaaaaggtaccttatatctattcctttgcggttttttttcggtcatagcaattcttttgcgacttgacagtaacattgcaaacaaaaaaagaaaaactctattcctccttctttcttttatttttttatgaattacccaaacaatccagactgctttaaaataagtagttagaataggagtctatgttatataattagatatgaaatgtttacaaacaatggattaaattaggtcggaggaaatctaatggacacattaaaaaattaaaatttgaggctaatggaattataggagtacttctagattactctcgcgagcctgtactcacaaatattattgatcaatttcgaacatctcttgaatcaaatgatattgagttaattcgttattcactagaacaacttaagacttggtatgcacgaaaccgcaatgaaatatataaaaatgaatttgtttttaatgagtttgaacatcatgaaacagaaaataaaataaaaaatttttagatgaattgcctgtagtagatgagactgaaaaaagcagcataactcacttttcaagtgatcaaaatagagaattagagaaaaaaatatttattagccactcctcaaaagacaaaattgtatgtaatgctttcgttgaattactagaggatataggagtgtcttctgaagatataatatacacttcttcaccttatcatggtattcctggagatgaagatattttcgaatatctaaaaaaacatctttttaagggtgcatatgtcttttatatgttatccgataattactatgatagcgtatactgccttaatgaaatgggggctacttgggtgaatagcaataactgctctactttcatcctccctggttttaagggcgaaataaaaggagtaattgataaaaataaaaaagcattctccttggaggaaccaatagacttatttaatttaaaagaaaaaatactccgtatgtatgatctcacattagaagataaaaaatgggaaaggataaaggctaaatttaatacgaaattaaaataacttaaatgccactgctagtagcaccaatagtgtaaaaacaacttttacccataaatctattcttagaagacatatttgatttagtttccaacttataaaccttataattttcattcttaattagctaagttcttaccctatctctgttttaccaatgtcaataaaactaaaagaggagtaaacacacggtttactcctctaactctgtctcttctccttttacttcttcatagtctggtgttttctttgataaccccagacgatcattttccccattccccggcatatcagtcatcttttcatatttatctccaaatttttcataatacttaaatgttgttaattcacgtgaagagttatccggcatataaaatgcaaactgaatatatttgcccccttcatagactctaacaatcgcattctctcttttaatatttatctctgtgtcatttcctttatgctctttatattggctaattacatcatcaatcgcatcatcatacttgcttccaccacatgcagttaaaacaaacatcatcatcaaactaaggaaaataaaaaggtttttcaaaataaacattacctcctttttcaatatttagtataaacaaacaaattgatcttttccaccttttatccatttcccttaacctgcacattatcgactaaccaaccatccttttcttttttcatagtcgtttgtacaattaacacttgattcgtagtgactgaatttgcagttgtggcgacttcaacaatgtttaaaaacaattcatgagactcatctaacggctttgaataactctctagtgatagtaattcactttgcacgctgactgtgtgcttttgatcagaacgagaagggaatgcataatcaaacccttttccagttgtgtgcttcttaactgtttcatatcgtatatctatgtcggagtaattaaaaaacgcttcaaaaaatgccttattttccgaagcgctacttgttgattctatatggttcaattccttaattttttcgctcaaaacttcatttttatcttttaacttttcaatcttatacgtttgctgtccaatcgtgaaaaatccagttaacatgactaataataaacaagctgaagcccatgcaatatgtgttttcatattttcactcctagttatttaatgcgtccaaaagatacaaggtgatctctccagtaacctgatttcagatcagaatattggattccactgtcatttgaattaaacattctgccattgcctacatagatgccgacgtgagtaatggcttttccttcgtatgtgccgccaaagaacactaagtcacccgcagtcgcttctttttcacttattttcttggttgccccatgttgttcttgtgctgttctaggaagagtgattccagctttcgcaaaagaccactgaacaaggccagaacaatcaaatccagtttccgggtttgaacctccccaggcatacggttgcccttcatatttcaaagcttctttcatgaccgtttcatagaaatccatagagcctttcacaggcttcacatttttatcagagcctttcacatacctcatgacatggtcaacataacttgggtcaccgtagcttttccagcccattttaaaagcttgcaatcggctgaaatcaagtgctaatttctttgtgtatttcccgccattctttttgacatagtctataaatccagaaccaaagttgtatgcctgtaaggttaaacgaacatcaccgccagcctgtttaaaaaccttcttaaaatgtttaatgccgacttcaattgaacgttctgggtcagttatggagttgggaggtaagccgatactttcggaactttgcatgatatctaaagaacgcccaccactttcttgcatggtgagcgccataataatattcacttggtcaaaaacgccttcttgacgggcatatttctcaaatactgctctaaatcgttccacttccggcgcaattccaactgtttcatattcgccatccccgccgcctataaaatcgtccccgacttgattttctcttgaaatcgtcataaccactacgatacataaaacaaaaaagaagataaaaggagccgagaataccaaaggaagaactacctttttacttatcatcttgttctttcatcccttctcagtcgatcttctacttttgatgaagagcgtcttgcaatttcattcaaagacacttggtcaaatgaattaacgctttgttcagtccgtttaattgtttgtgatgaaggctgtttttctcttgatacagtcttattttcagcaggagcaacagcctgtttttcatcaacacgaataccatctgaatgaacttttgcgggttcagatggtctgattttacgttcgttattggcaataggttgattttctacttttgtagattgaggactttcaaaaccgagctgcggttcaggttgattcatcatgactttttgatctgatcgtttgatttctgctgttttctcttgtgctacaggctcactattggaaacagaatcatctttctggacttcaaaatcttgttgctgatctgtttcaagattctgattttgttcgtcataaatatacgctttctgatcagtacgttctgtatctttttcattctcttgtaagacaggcgcacgattagaagtagattcttcttcatgctgtaatgatgcatcgtcagtttgttgctggttattgggctgtttaagaagctgttccacatattctttttgatctgttcgtgctgattcatcttttttatcctgcaagataggtgctcgtttggataaatcctcattcccttcattcaaagcatctttcaacataggagagtttattccgtcttttctcaatctggctaaatgggattgctgtttattttcttttgcatttgcaaaggcttctttttgtttttgcttttcttgttctttcgatagagtttgaggattgcgttttaagcttcgactgttatgattagctattccgttagctgtttctttttgcggggttcttgaaatagcatgagtattatcatatcccatagcagtcccactcggtgaattaccgccaccacttggagcaccagttacgccatcagcattcgaaccgtcttttcttcccccaaaatgctttgtaaagtcagtaaatacgccgcctccgttaccccatactccacctattttcttcgcttgttcccaagcaggctgaacaatgttttgtctcatgttttccatcatattattatcaactgaaacaacttttccagcagtcacaaacttgataatggcatccctcttgtgaaaaccaatccacaagattgaagcaaggacagcaacatttaaaagatacattccaaaaccatttggcggtattaacttgtcaacaataaaacaagtcacgtacacaaacagaacgataacccctaacattgctttcagtaggtaaacactccccaagcgtccaagcgtaacaaatcccgaataagctaattgaggaacatacgctaagatgaaagcaaatggcacaaagaaaactatcactaaagcgacaacttgaagcaagaaattaaagaacgctaatgctaaaaatggtatcccaatgacaatagaagcgaccacagcgataaaagactctcccagctgattaaacacatttccagaagtcatagattcatttttataatcatcaatttcagtctcttttatataatcttttttatctttttctccatcctctgaaagcttataagaaagcagtttatctatacgattaagtccgcctttatctgtatcttcctcattgattttcttttcgcttgtttcatcaaaattcacaattaaaaaaggcttcatcaaagcaatgtcaaagtaaagattacgcataaccgcaactgtgccttccatttcttttcctttttcaatcgctgaactgtctgcaaaattgccttcatcttgaacaatgccaaccaatccattccccgcagttaaaagctttccttgagcttctacagacaaggcattcaatactttcatgtaataaccagcgttcgacatccaaagcccaccgatcaccatgacacaaataaatagaatactccgccgcattgcttcttttacgctacctctcacacagaataggtagacaacataggcgcacgtgaaaataaataaagcttcaccgaaattctttttcagtgttttataaactgttttagagacgtttgtaatagaatttgcgaactcgtcaatcggttgcaagttatacaaaatatccatccccgtatcaaccacacggacaatgtttcccgcaaaagaaaaagtgacgtttgtcagcccaacaaacgcccccttgattaaatcgtcagatgcttcattattcgcttgatagcgtgagattggaaaccttttcaccttcaattccacgccgccagctttttcgacttttggctgcgtcgttgtatctccatcagccgaaaataccgttacagctgaagcaacagttaaaaacagcaacacaatagccgacacaatcaaaattcttttctttttcattacaaccacctcctaatctaaccgagttaataaataaaattggtatctggctttctctaagtctctttgcgttagcaacacgttttcaggatatcgttcatacagagagaaacagattgctttttgatatttcatatgtctgaaagtctttcgattttgctcaattctgatacctaataatttttgcagaaactgtgccgttgatttatgtccgataaaacttttgtatcgaccatcataatgcttcagccattgtttaacttcgtccaatgtgattttctcagctttataaaagcctggactcgtgacaacaagagagtttaagaaagctatttccatgtacgattcaacccctttttacaaatatttttcttccgcatatgcgacggcttttttctcaactgttttcagagcaccttgccattcttcgaataggcattcaatcgaaattttagaggtgcggccatagtaatctttaaataagcattgaccttgaaacatggattccatcatttttttgttatcttttgtgacctccatgttcatccatttcaacacttcttcacgctcgtttggttcgtcaaaagcaaaggcaacgccaaagtttccagaatcctcttcttttaaagcgtcttttgtggattgagaaatgaagtattccgcattgttgtatgagcgaccaatccggcgcatttgtctttctactttttttccttgttgtgacgtggtgaatatccaagcttcatctataaattcaacagtctgttcgtcttgattcatgccgaatagctcgcagaacttacctagtgcaaacatgaccgcactagactttagttgtgatatcgtgtagttttcaagtcgctcagcatgatccggcaaatccatattttcaacttctaaaatggtaattcgcttttctagtgacaatgcaggatttgaaccatcatgaatacaaagtttcaaaatggaatctgacacgacctcatttaaatagtcaccagctttttgtacagcttcttcgggatggctctgcatcttccgaataatatcaagtgagccgacctgttcacctttttgtttcgcatcaatcacttctgacgtagcacgaaggaaagctgtgtttatgtcgtccttccctttaaagtcatatacttgttcaaaaatgacttgaactagctcttttgctttcataggagggaggaaggagatagggtcaagcgctccccagttgtgcgtgttttcatgatctagcgtgatatagttgtatttctctaaatgtgcaatatataagggaaagttctctctaatgtactcatcattcaagactctttgaatccactttctcatttcctttttagggtctatatacagagatttgatgtttaacatgctgatatagttaaagatcaatttcgctagatatgacttgccgtttcctgtgtctcctgtgattaagcagtgaggagaacgtgtctttgaaccttttaactgctgattcgctaagaaagggtggaataagacaaaatcacggctggacataatggcactttctaagtcggtgtgctcttggaaacgatcaacccaaccgagaaagaacccgattttcgaaccaatatcagagttaacagcaaacagactttcagccacaccgtcttgcgttgttttttgaatccagttcttatcggttatgtctaacttttcaccaggaagcattttataaaaaaggttcaattgatcagccaccggaagccgacaagtaatgccagcgccttttaaatgccttttgacaatcgttgcttttcccacacattctttttttgtctttccatgaacgactatcaccgacagccagttcatcacatgcacatcttctttctttatttcatcttgtaaatgccttatcattgtggcacttgtgacagtggaaacatcacttcgatcgcctgtgctttgttgttctttttgttcttctttcaattgctgtcttttgaggttgagggcaggcttggtaatggactttgattccgtttgaattttcatctgaacttcaacagggaagggaagagactgtgcttcataaaacaaatcactttccgacatattgtgaagaaattcgtcaatcacgacaaaagctgaatagccttcatcttgatcactatgcaaatgcaatactgatgggtcagtggggtctatgatcgtgtttgtaatagagcgaacatcctttatctcactttcttcattcgtttggtgctttaacccacgtacaaagtgataacggttaatgtatgtcatttctgtttctgaaagccgttctccgcgaacagaagccatgatattcgctagtgtttcttcgacttcctcatatttttcaaaaaaagaggtggaaacattttgttcccacccgagcattttcacgactgtatcagtcgctgtattgaaaaaagatagtatattgtctttaagttcgacactaatatttacaagactgcttttcagttttacacctaaaatgaagtcgtactttgtcagccttcctaatcgctgttctaacagccttacggtttcttcattgtagtaacgtgccacatccattgcatctgccgcaatatctgtttctaaatccttaaatcgtttttctaattcatactcacttggatacatcatcaagtgaaaatcctcataagatgtaatttcttcaaaaagatgctgccacttctttttatacgattcaactttttctttattttgcataggaatcgaattgctttttattcggtagtacgcccacacgtcgcccgttcttgttaacagcaaattcttgtgtattgccttcataggcgtttttagtctcatttgaataatccaccaccttcacaagttttcgaaactcaatttgtttttcgttacttaaatcaatctttcgatcattgcaatacttcttttgtggaagcttgatgaagaagtaatactttgcgaaatcaaagaaatatatatagatgtttttgccttccggctttattttcgttacaagcatcgttaaaaaaaatggtatcccaaaaatcacaatgacgtaactgttatcaaaagcgtgagggaaaatcatcctcacgccgtaccagaatccaaagcataagccaacaaaaatgaaatagttaatagccggtattaactcaactgcaaagggtaacgaataattttcggttaattgttggatttttttcggctctctcattgccttccggtagttgaacaccagacgccccattcagatgcccccttacaatttttccattagcgcattgatccagccggagaattctgaccagtgtttaataacccacgttaccgcactgccaatacagcaaacaaagataatgccgcccatttttaatttcatcagattctttgcggctatgaacatgaccacaatcgtaatgaattggataacaacatctgatgcccaaccttttacccctccaagtgttggaaggtctgcgccaagaataaagaaattcatgaaatccatatttaaacctcctattgatgtttgagtttatttacataaaactgaccgctgttttccgtaatctctagactgaatttttcatttaccggaatgtcattttctttttccttaaatcgaacagcacaaaaaacctcgaaaccttttttcgtctcgaagattttcactgactgcacttccccaaataacaagtttccttccaatgcttccggctttttcatcatataaaccatttcttctttcttttcagaagcgtatttctcaaagaaattttgaagaaatgattcgatagattcttttttctcgcctgcatattcgtctctagtttcttctttacccttaaaagcaatatcgcctttcagatcataaatctgtgtaaaataagggacagcagacaccgcaaaggaatcacctttatttgtgactggaatattcagcaacatttgtttttcgtatttctcgtttgttttaaccttttctttcaccttctttttcttctttccgtctttaacttctttttcaacttccttttctacagggtatagattttcatatgtgaccttatattgaaaaaggctgtttttatcaccttctttcacgttatataagctgtaaccctttaactctcgatcaccttttaaaccatccacattgaagcgttcttcatcttcaaaatggttatcttcctgtttaaccatatagctttcaaggctctgcatacgtttttcaatagattcttgatcgttcttcacattcatatattcattgatgaaccctgacagaaagttttcggcagcagtcaccgaaattttttgtttatcgtcatttgttggcttattcgtttcgtctttcatgtcattaagttgggagcgagtattaattgacagaagcacagcaagcagacagataaatagcaagctccctacacaagaccatagtgtgacggctatcagctttgacctgtcacggggtactttttgtttgtctttttccggtctttcaattcgtttcagtttttgaaaagcagaccgaaaaaaggattcttccttcttatcagagccaatttctttattgagcaactttttcacactccttctgttcaatttgtttcgttctttccaagaaagataaaaaggatgctacacgatgtaacaccctttttatgctttgattctccatataaacttttaagctagtcattcgaccgtctggcaagtatcttgttttatagaatgtgtaacgatactcagcaaatccttttactcgttctccttcaacaaccaacatgcaatctctgcttaaacttctcacaaaaactaaagagggaatgcccacattaaaacctaagcttttgaatcgtttatctacagcagacaccgcacattttcaccccttattcgtagtagctaattccttcaaactccacgcttcgttcgtctgtctccatatcttcatcttctaagatgttaaacgtagcttgaagttttgcattggcgttatttataacagcaagtgtttgaacaatgattctttgagctacatcactgtaaaaaacatcttccatcattttttcaatcagttcctcagcaatatccaaacacccaagggaatccaaatcactctcaagtcgggcctgattcaacagattaatattaaacacctgatgttccccctttaaagtcataaggaaaattgtccttactccgtaaaatgcattacttcaaattctacatttttaacatttgtctcaccgtcttcattttcaagaacattaaatatcgcatgaacctttttagtgtagttgtttactactgtaaagatatcaatcgcaaatctttcggcagtttcggtatgatacaaaacatattcctgcatcttttctattaaatcttctacaatatctaaacagccaactgattccaaagcattttccagtccagcctgattcaacagattgacattatgcatcttatccctccaagttagttcttgggtttcacccaaacccaccaacggtagctcgttggattgctgttaatctatccccctattcccccgaatcatcgggggactccctcgccggtaggcaggaacaaacggttgtttgttcaatgccaagagggtttgggtagcgctgaatatgtcaactccttatcctcacttcgttccggtaccgttgacacatacgtttaatcgcatcacctgtgtttattaaggtttagcagcttggttttaaacgaccatgtcagcaacatcagccatatacacatctaacatttttttatgtttgtcagccagttcagcttctgcaatcatatctgacagatcggttttccctaaatgttcatcagcttcaagcaccattttcatagtgggagcacaagagttacgaagccagtttcttgatttctgatagaagtctttttgtggtttgacgtacaaaggaagtctcccaacatcgcctataaaatcagaccaaaaaaggctcgttttccaatgctctctagtgatgttttcatcagcatcaacgaaccttacatagttattaatgatctgcatagcgattaaggttaaatcctttgttttcaataaagcatctatcgccacttgtgcacgttcatttttaagccgcaattcataacgattccaatcgcctagttcttctaacggaatgttatacttttctgcttgttcatagtttttctcataaaagcaaaggtacgcttctgactttttagaaccgaaatatattgtcgtcccgcctgtaatgccatcagatagatcaaaggagccattgaaatcagattttctaaatcgtgaaatacattcgcccttttgggctttctttaacagttctggtatagaaaagtatgtctttttatcatcaatagctaaatcaaagcgagtgaacgaaccgccttgttgcatgcaatcttgaaagaagtcgtaccatgttttcttccggcattccaagaaggattcaaattgacggcaaccttgaccggacatttctatcaaaacacctctgttgtcatccggcgcagaataaaagactttgatatagtccagttcatacgtgccaacgtagccatagaaaccagattgtttctcagtcataaagtctttgctaaggtgaagaacctcttcaataattctgtcaacatcatgagttttaaaagagactcgaatatagtcaaccattgataccaaaggactttcaacggcttcatttttttcttttacgattactacccccctgttagcgtgggggggttgttttagctcatccattcgcttcgctcactccttcgccgctggccgtctggtcgcttacgctgccgctggcgactgccgtcgcctgcgctccctcgactccaaccagcgcatttttaatagatgacataaaatcatatcctttcggcacgatagggctgtaaaactccaacactgaacctgtgcccacattggcatatcctcgccctgtctcctttttattcacatatgctttttcaacatcgccaaacatcattccgtaacccgtatcggacattaaacccaatgaaacacgaaagctaaactgatcacgaataccgtcagctaaatattttgcatctggacgttgtgcgcctaaaacgagaaaataccccgcctgtctccccaacatgaccaactgtttcatgtaagaaagggcttcgtttctttctttcatatctaacaaatccataaatgccacatattcatcaaagaagataaaaacaggttttaagcctaaataagcatagttttcacctgtcttatagttagacatttgcttcatttcatccattcgttccatcatgccatctacagactttctcaggcacataagaataccgttcttttgggaatagacctttttcggaagtacttcttccaagtctgctaaatctgcatttttagggtctagtattcttacatctgcccccagtccaacacatgccttaatgatcgttagcatgaagtatgttttccctccacctgtaccaccagcaataagcatgtgcggcaacttatcaaattgccatgagatatgcttcattaacggaaggactccattctcagctactgcatcatcaatggaaatacgattctttttgacatcgtaaagaagcttaaagcatacaaaaccttcttccatttgtttatcaaccaagtcacaaaataagccgttttccaaatcctttcctaagtctaggaagcgattctgaaaacggctcatgtccatagcaatacgaatatagatgtggttgtttttgacctggtaatacattctaggaaagtatgtgatcttttcctttgagtcagtttcatttgaaaagatttttcttactttcacgttttctttttcgtaaaacttgttagagaaaatcattttagcaatcttttgcctgtgaaggattttcttatagctgtcaaacaaaagaaagtaagatgcaactatgcttccaacagcaattagcacagagcataaaacgcttttaatgattaaaggcacattccattcaaaattttttatcacttgagatagatcaaaatgaatgagttgttctctccaaaaaaggaacatagacaataaaaaaacaggcacaaagatgattgcgcctgctaactttacgttgtttctcatgtacgggcggattcgtttgcccctgtatttccaaaatcttttgtttaagaaatcactcatatacatcacccgcctgccgatatgagagcatcatgttatttcttttcattcccgccagttgccgcggcaggtttcacagaagagccacctttaacaacaatatcatcagcttcaagtttccacatcacattggcatacgtcgaatccctttgactagtcgccatagcgctaatttttggatttttcaactcaatatctgcaaaaggaggaatttcttttgccccagcatactcaggaatagttacttcaatttgaccaccttggacagcactagcaatgttataaatcctagattccagtacgtcagtacgcttattattttcacgatcataaacatacctttctctgttaagtcccatgaatttcatgtctccaaaagtcatattgatatccggtacaataaagtttaagttcatttttcatatccccatttcatttttttataatttatttacaaaagaacattaatttcgattttatgtttttgattcgctccggttctgtatccatcttggcgcttatcagttgctaacggctttacgccctcatggcaacctagtaggctaattatagccatcaagctgactacagctattccgcacgcttattctagcctgctacagcatttaaagtgattgctgttcatcactcaaatactcacgcatgacatttcaacaagaataccgtataataaaagtgtctagtttttattttccggcgttcttgatgatcattcgtcaaggcgctttttttgtctatatgtagttttcaaggaacaaacactcctatcgacataagttatacaaatcatcgttatacaaagtaaacacttggttatcctttttactcaatggacgagttgaccagatacaccaccaatcccagccttttaacaactcagatatttcttcattagccttcaaatgattatcagcatcaacaacgaatgtttcacaagtggcatagtctttaaaatgattcaaatccttatcagcctttaaagcttcaacatcagtaatgattgttgcattcactcttattttcatcgcatccctcctttcaaaggattcttaacggctccctatagtggtatataacgtcacactacggatgattgccgaagcttttcaatgtcttttcttccaatgccgtaatgcttacatatcctgcgatatgaaacgccttttcgcagtaattcattaacattttcaattgttaagggaaggtttaaataatgatttataatgactgaattcagagcaattttcattcgtgctatccaatcaccttccatttgtctagctaaagggacagcttctttcataaacgagtttgttatatcaatgtttataaaaatcaccccgtttgagattttgggcctttgtaacaataacactcttcaaacttagctctactcaccttaccttgaatgaccatatatccttcttctttcatttgagcattcaaagttctaatgatgtcataagatttagcctgtttaactccaagaattttttgaatatctctcgcagttaaaaactctcctttcaaaatatcacctcctcgttaactcaactctttgtgaattaactttattataaaactccttttcgtgtaagtcaacacaaaattcaccttaaagtgtatttttttgaacatatatggaaatattgataattaaactctccataaagaagaaacaaacactcctaaaaggagaatttagaattatttatttaacttataggtgaaattaatgaattctccaaaaaatgttgttattatttttataaaaatcaactctttgtgaaatggatgataaaaatgagcctaggcaaacgattaaaagaagctcgacaaaaagctgggtacactcagaaagaagccgcagagaaacttaatatcggtaacaataacttgtctaattacgaaagagattacagagatcctgatacagacacactcttaaaattgagcaacttatataacgtatctacagactatttattaggaaaggatgaagtaagcaagaaaaacgaaactgatttactcaataaaacaattaatgaagccatacaggaattaaaggatgaagatacactcctttttatgaatgatggtgaatttgatgaggaaactgcacgccttgttaaaaaagcattaaaaaacggaattaaattcattgacgaattaaagaagaaagagtgataacaatttatacaagcaaaggaattaaacataaagtgcaatcagtaattaagacacatggtacaaataatgtctatgaaatttgtgacatccaaaaaatttatatactcaaaaatgatcttggacaagcaaacggtttactacaacatgacaaagccacagatcaatatttaatccatatcaacgagaacctccaacatcaacaatttgtaattgcccatgaattagggcattactttctccataaaagattgaacacttttaaagttgtgaattgctctaaagttctaaaagataaacttgagcatcaagcaagcctatttgcatcagaattaatactgacagataaaatgcttaatgaagcccttccatatatacagggttttagcaaagaacaaatagcagcatacttcaacgtaccatcatttgttactgattataaactttctcaaattggctcatttagtaacagaatctattcacacgaaataagcgcttttggttaaaggagaaataaaatgtctgtaaaaaaacttgaaaatggtcaatatcaagttgacgttagctttggatttgacccgattactggagaaagaattaggacgagaccagtagcatcaaccagaaaagaggctttagaattagaagcaaaattaagaagagaatttcaagaagaaagagcaagaaagtccagatcagtaagctttccgactctaatttcaatttatttagcaagttgtgaaatagatagtaaaccaaactattatcagaatcagaagtacattataaacaaacatatatctgattactttttgaaatctgatatacaaaaaatcacacatagagaaataactgatttcagaaaacatttaatggaaacaggtctaagcaataaatcggttaataatataatgactagtctaagcaaaatttttgatacagctgtacatgaagaaatcttaaaaagaaatccgtgtgacaacgttaaacgattacctttaacaagaaagaaaatgaagttttggagaccagaagaattcaaaaaatttattagtttaattcctcaagatcaattattgtttaaaaccttttacactgttgcttttttaactggactaagatgtggtgaaatgctcgccctgcaatggaaagatattgacaaaatcttattagaaatagatgtgcataaatcgtgcacctggcttgatggtcaatttgttgttactactccaaaaactaaaaattcgattcggcgagttagcatcaataaaaaattgcttaagctactagaacgttggaaagaagcacaagaagagttgtttaatgaattaggtattagacattcacatgatacctatatctttcaatataaagatacaccttcaagaaaagatattttcagtcggaaaattaaatacttttgcaaggatagcgatcttactcctatacgtttacatgattttagacattcacacgttgcactattaatacaccaaggagaagattacataacaattaaagagcgtttaggacatggttctgtaaaaacaacaattgatgtttatggacacctatatccaaacaagcaaaaggaaatggctgataaattagatgacttactttaggtaagtgggcagtttgtgggcagtaaatcatttgaaaataaacacaaaaaaataccaagggtgtcaaaacccttggtatcattgatgcggccgagaggacttgaacctccacgggttattcacccactaggccctcaacctagcgcgtctgccattccgccacgaccgcgtgatcattaaattgtgttgtgctggtttagtaggctcttaacctagtaaaacagatttgcgtgcactttgtaaataaagtgcgggtgaagggactcgaacccccacgtcgtaagacactagatcctaagtctagcgcgtctgccaattccgccacacccgcaaaaagacaaatggtgagccatgaaggactcgaaccttcgaccctctgattaaaagtcagatgctctaccaactgagctaatggctcttactattagatttcaaaaataaaaatggctgggctagctggattcgaaccaacgcatgacggagtcaaagtccgttgccttaccgcttggctatagcccaacgaaatggaatgacccgtacgggattcgaacccgtgttaccgccgtgaaagggcggtgtcttaaccgcttgaccaacgggccgatggttgagaacttatatcgaaatcttatggcggagaaggagggatttgaaccctcgcgccgcttacgcgacctacacccttagcaggggcgcctcttcagccacttgagtacttctccaatatggctccacaggcaggattcgaacctgcgaccgatcggttaacagccgatagctctaccactgagctactgtggaataatgagacaagacttattatatcagccttgatttgcagtgtcaagaggtaaatgtttttatttatctctcgtgacgacttttataatgtaacataggcttgccatattcgtcaacctttttcacgaaaaaattctttttatttttccgcggcattttccgcatctgtatctgtcagggttcatggcgcgcttctttatatactgttggccgcaggtcgtacagatatacatataagtttttttgttttccgcttttttcttaaggggtgtacagaacctcggcgcgttgacctgctgcaatagcattctaaaatctctgtctctgtgcttgtacccttttccttcaagatgaagatgataatggcagagctcgtgcttgatgatgccaatcagttcctccctgccgtgttcaatcaaatattttctgttcaattcaatgttatgggaggttaacaggtacctgccgccagtggttttaagccggtcattaaaaagcgcctgatggcggaacggctttttaaaatatgtttcagaaatatcctctgtcagcttttgaagctctttgttatccatggtgcacctcacttaaaaaacattgaacgggacaattcaccgttcgcatacaatatggtaatcactgtccctcttatgataaaagctgaggaggaatgagcctatgccaaattggcttaaaaagcagatgcaaaaagcgttccttgaaaaagataattaccaaattaaactgctgaatcaatgctggtatttctataggaaaaaacactgctcgtaagcagtgcttttattttaccatagacagcgatactctgcctttttgtacatctacgccgtcaacccaaactgtcacaatatcgccgacagatacgacatcaagaggatgcttgacgaattgattgctcaattttgagatatgcacaagcccgtcttgtttgactccgatatcaacaaacgctccgaagtccactacattgcgcacggtgccctgcagttccattccctctttcaaatcttccagctgaaggacgtctgttttcagcaaaggcttaggcaccttatcgcgtggatcgcgttccggccttgtcagctgttcacaaatgtctttcagagtgatttcgccgattcccagctcttttgccgtttcagagagcgccagctgattgattttgtccttcaattccgccgtgccgatatgttctgttgaaagtccgagttttttcaaaagtgcttttgtttctttatagctttccgggtggatgcctgttctatccaaaggctctgtcccttcctgcactcttaagaaaccgatacattgctcataggttttcgcacctaaccttgggatgtccttcagttcttttcgatttgaaaactttccgatttcctcacgttttttgacaacgttgcctgctacagacttcgataatccagctacatattgaagcagcgcggcggaggctgtgttgacgtttactccaacctggtttacgacagtttcgacgacaaaccgcagagattcatttaagcgtttttggctgacgtcatgctgatactgtccgacaccaacagacttcggatcgatcttaacgagctccgcgagcgggtcttgaagtctccgagcaatagatacggcactgcgctcttcaaccttaaggtcagggaattcttctctggcaagctctgaagccgaatagacgcttgctcccgcttcattgacgatcacataataaattttgcgcggcatgtctctgagtacattgacgatgaattgctctgtttctctggatgctgtgccgtttccgatcgccaccatctcgacttgatactgctcaagaatctttttcactttttcatgggcttcttttgttttgttgactggcgcatgcggatagatcacatcaattttcaagacttttccggtctcatctgacacagcgagcttacagccagttcgaaaggctgggtcaacaccgagaacggttttgcctttcatcggcggctgcaaaagaagctttctcaagttctctgagaaaatatgaatcgcctgttcatcagctttttctgagagctctttcctgatttcacgctcgattgccggctggatcagccttttatagctgtcttcaattgtctcctgcaaaatctctcttacggatgttgagcgatttttgatgatttgtttttctaaatacgccttaatgtgatccgcaggcggttcgatcgctacctttaaaatgtcttctttttcgccgcggttcattgccagcaccctatgcggaacaacttttgcaattggctcttcatactcgtaatacatttcatacacatttttctcatcggtgtctgccgactttccggctgcagacttaatggttcctcttttgaaggtttcctggcgaatccactttctgaaggtcggctcgtctgagatttgttccgcaataatgtgcttggcgccttcaatcgcttcttctcgtgtgaacacttctttttcttcgctgatgtattggtctgcagttgctgccagatgatcatcttggggaagtgtcaggatatagtcggcaagcggctcaaggcctttgcttttggcgactgtcgcctttgttttacgtttttgtttataagggcggtaaaggtcttccacttcctgaagcttcaccgattgctcgattttacgttttagattatctgtcagtttatcctgctctgcaatcagcctgatgacttcttcttttcgctgattcaggttttgtatgtattgccagcgttcagaaatcgtctgaatctgaacctcatccattgaacccgtctgctcttttcgataccgggcaataaacgggactgtattgccgtcctcaagcaggcggatgacactttcaacgtgtttttgtgataaacctatttctttcgcaatttgctgttttaaaagggctgacgtttccatgtaaccaaagcctccaattttgtcgttctttctctagtgtatcaaaaaccgaaaaaaacacataaaaaaagacagctggcgctgcccgtatctttactcatgtttcaatagttcctgtaagccgctcagaaaattctcttttttcatcgcagctgcaaagaaggcttgatcaatcttctcaacaattggcaaagccgctgttactttttctcctcctatttctgtaagagacaggaggacctctcttttatcctggggatttttgcttctttcgataaatccttttttctcaagcgtccgcacaacctccgaaaccatcatgatattggtctggctgaagcttgcaagttttttttgcgtgacggtttctccgtgagcaatcatatacttgcacgaggtcagcagaacaaattgaacgtgggtcaggtcaaactcagccaatgcttttcctactttccgctgccaactttgcgtggcctgccataataaaaagcccgggcttgtgttcggaccgctaaatttagagtgccattccacttatgttaactcccatcgcttgtgctattgtcaaaaaatcttttttgcttatttcaaagtgtcctctgcgaaataaaaagccaagatgcttggtttcctgaacaaattcaagctttgatttaatgtcgtaaaaaccgattttatggcatggataatagtctatatctaatcggtatggaataaaattcggagccatttgatacggatagatgtttccgctttttactttgccgatcgcagtaaagcttcgcagcagtttgccgtctggatatgcgtctctcggagaataataaatcagccaatctccctctttcattttggcgagcggggctttttttccatggcacagctgtgcaaaaccgccggcagcgccttttaatacatgttgctctgacacaacgccgatccagtaatttgtgttcattttatcactcctccgtaaagatggacaagcctgctgacagccgtcggcatgtctttagacagttcagtcccaatgatttctccccacttttttgcttcagcgccttctaatacaattccatatgtgatacacaaatcttctttttgcttttgaagcacgtgaaaaaactccattattacattgctatgcgggcatgttgaccatgacagaaaacgcccgatgtttctccacatgctcaagccataagagaattgtttttccttgcagaagcaatgttccttccgttccattttgaaattgtcctttcaaagaatctgatgcaatacccgtctcccattgatccattgtttctgtttcctgataacagttccaggttttcccacatccacatcagctatcgctgtgtattcataattccacatcccataagctcccagaatgataagttcacttattaattataataagcgcacttattaatagtcaaccgcaaaaaaaagaagccggatgtccagcttctttttctggttttttaggacagctgtccgagaatataggtcaggtcatcttttctcgatgtcgtatacattttcagcgaattcgatatttcttctaccgattggccttttttcaaatgggagcggatatcaggtacgttgagtccatctgtatgtataatgaactttgaacccttttcataggtggcggtgtgcgttttgtatttttgcggcttgcctgataaatagcccgaaatcggcagaggataaaagctttcaccagacggggaatgcagaataaaccgtacatttccgacagagcagtacgtaaactgcctttgctcaaaattgattttcaggatagatgctgtagcgcctcttttgtttttcatcgcctgattacagcgttcgataatgctttctacgtcttcactcgcatagttttccactaagtctttgatggctgcagaggattcgttagcaagtgatccacttcccagtccgtcagcaaccgcgcaaattaactccttatcatcagctttcataaaaaaactgtcaccgcaaatcgatttcccttctttattcagttgatatactagagtttgaatatgctcgttttcttcaacctggatcattacattaactccatcgagggatcttcaatcaaggcctctctgagcttcttcacagctttgcgttgcaagcgcgagacgtgcatttgagatataccgagaatgtccccagtttctttttggcttttgttttgaatatacgtaaggtctatgatttgtttctcacggtctgaaaggacatgaagcacgctttgcagcatcaattgctggttgacccgctcatatccgtcctcctgtgatccgacgatatcaagaatcgtgacagtgcttccgtccgaatccgcttcaatgctgtggtcaacggataaggcttgatagcttttgcccatttccatcgtttcaagaacctcttcttcagaaacatcgaggaattcggcaatctcttcgactttcggcgatctttgtgtttcagtggtcagctgatcaaccgccattttgattcttggaccgagttctttaattcgtctcggcacatgaacgctccatgttttatctctgaggaaacgtttaatttcaccgatgattgtcgggattgcaaaagcttcaaacgatttgccgacaacaggatcgtatcgcttaatcgcgcctagcagcccgatcatgccgacctggcggagatcctcgtggaagcttttgccttttgagtattttttcgcaagcatgtcaaccagatttgtatacacccgcacaagcgtttcctgcgcttgttcatcttgctttgtttggtaatcgcttatgagccgatcgacttcatctttagttagtttcgtagtttttgatggttgtgtcatgatcaactcgctccccatttaaatactttgtcatcgctacggtgacgccggagtggttttgcactctgacttcatccatgagcgtttccattaaatatagaccgagccctccttctgataattgatcaactgtgtgcgaaggtgtgtacggccctagatcctgctgcttttgatcaaagtcaaagctgtctccttcatccgccacaataacctctaaacggtcttcaaacacaccgaatcgtattgacacttccccatttttatcttctttgtaagcgtgctgaaccgcatttgtgcacgcctcactgactgcgattttcaagtcttcaatttcatcgtacgtatagcccattctgcttgcgacccctgacagcgtcagtcttataattcccacatattcaggttgggccggcactttcatttcgatgtaatcagcattattcttcattgcactccaccttctgactttgcagaaatatcaatgatgtccttcaagcctgtaatgtcaaacagtcggatcagccgttcagaaagattttcaagtttcagcgaaccaccttgttttttcaccattttaaaggtccctacaaaaacgcccaatccggtactgtccatgtagctgacatctttcaggcaaattcttaagtcagctccttgttctgccagaggaacgagcttctctctaagcaccggggctgagtatacatcaatttctcctgcaatgtttacttgtatatcattctcgttttgcttcacatcaacatttatattcattcgtatcacctcaaattttccttcaaatcactagttgctttataccctcgtctgacagacgttaaacctttctccgcaaaacaattaacgtaaaatcatcgtgaagctgaaaatcctgcaatttgaggaggctgtcataaatgtttttgaccatttcctgcgcagaggaacacatatgttcctcaatgagcttctgcagatcaggacgctccaagaaaccgttttccgttctgcattctgtgacgccgtcagaaaataaaacaatcatatcgcccttttccagatgctgatcgaattgtttgtagtcatagtcctgcgagatgccgagaacgagtcctttggcctctaaatcgtaaaacgtgttgtctttttgagaataatagaatcccggttcatgtcccgctgaagcatatgtaaattgatgcttgtccatattgtaattcgcataaaacatcgtaataaacatactggcatcaacgttttgttcaacaacacgattcaaatttttcagcacttgagaagggtgtatgcccgtttccggcaaagagtccattgcgtatttaatcatggacatgcataaagccgctggaatgccttttccgatcacgtccgcgattgcgatattgatggattccttgtctttgacaaagtggtagtaatcaccgctcatctgtttagcgggaacactgatggcgccgatatccagcgcttcctcctgaggaactttagttccgagaagcgtctgctggacatttgccgcgatttcaatttctgatttgatttcctgctgtatccctctaagggtttgatgctcctgataagccattccatagccaatcatgacttctattaaaaaatccagcgaatgaaacacatcttccgggagacttggatacagctccttcagcacttttctgtgaatgctgatgatttcttccggaggaatttggtgctcgattgtttttcggctgaatttttgggcttgatataaagatgtttctgttaattcggctatatatcgactaagcagctgatgataccgctgctcaataacctccctaaaatccacgttcttacctcctaccgaagccatttgatggcttgtatctctgttccttcccccgctacggaatttaagctgaattcatccatcagccttttgaccccgggaagtcccgcaccaagtcctccagacgttgaaaacccgtcttccatgacttttcggatatcaggaattcccggcccttggtcttccgctatgattttcaggcctttttttcctctgtctgcgacctgttcaattccaatctgccctttgccggcatataaataaatattcctggctaattctgaaatagccgttgtaattctagcctggtctaccgtgccgaaacccagttctttcgcaacgtttcgtcccagctgtctggcggccacaatatcccattctgtcatgattcttacacaggattggtcgttcattcgctattcccccaattcccgcttcaatgtctcaagcccctgctctaagtcgagcgcagtttcgatttcctcaagcgcgattccaagttcaatcagcgtcactgccacagcgggctgaatgccggtcaagacgactttagcccccattaacttagacattgtaatgacgtcccccagcactttcgcgataaatgaatcaatcatatccacagatgtcaggtcaatgacgactccgttagcacctgtttcgtatattttatttaataagtcttcttgaaaagttaatgctgtctggtcatcaagttcccactgaatggacactaataagcaattatacagtttcaagatcgggattttcggatgtctcaaaatgttattcccccaatgaaacgatttttcgatccgtcatttccaatgctgtttgaattcctttttgcagggtattcttagttataacttgggataaatcaatccccaggttgacgattgtttgagcaatttccggacggattccggccagcaggcattttgctccgacaagccttacagcttctgatgcctgaataatatgatgggcaaccatcgtatcgacgacagggacacctgtaatgtcaatcagcacgacttgggaacggtgtttgacgacgccattaagaaggttttccataattcgtttcgcgcgttcggtatcaattgttccgacaagaggcatcacagtgatattttcaaacaccgggataagcggcgcagacagctcttgcagcgcgattttttgcagggatactgttttttcccatgagattgagtattgattaaaaatttctgtgttaatcgggctgaaaaagcgatcaatctgccagattaattccgtgctctcttgatctggcaatctcttatcattcattttcgtgtagagacgcttccagaattcggcaagtgcagtagccaaaaacttcatagacagtccgatttggaccgctcgaagcgccagttcgctgatttggctttcagcagcattttcgtccttaacagacagcagcagaatgtcgatatattctttagatatattttcatacacttggtcagtcagctgataggattcttgctcgcttaattcttttagtgtgtcagtccacagttggagcagttcattttgattttcggcaatgaactggtatacagtctggttcgacatcaaattcgcttacctcccaataaaaacaacatattttttcgttatttcactattatatcgtttatgttttttgaaaacaaaaaaagttgctctatttgagcaacctgcaaatatgtctaaaaatcaatgagtgccaaactgatttgtaaggcttcatcaaccttatccatcatttcatcatccagatgagtaatcttatccgttaacctttgcttgtcaatcgtccgaatttgctccagcaaaataacggaatctctttcaaaaccgtagcgttttgcatcgatttcgacgtgggttggtaatttcgctttctgtatttgtgctgttatggctgcaacaatagcagttgggctgaagcgatttccgatgtcattttggatcactaaaaccgggcgcaccccgccttgctctgagccaacaacaggagataaatcagcaaaataaacatcgccgcgtttcacaatcaaatgattatcctccgctgactaagcgctcaactgtcgtttcagcctcgcactccgcaaagtgagcctcagaagaaatattcaggttgattttcgccatttccatatagccgcgtctcatcaaatcacggttgtgacgagttgttcgttcgctgacatacgctctcactgcttgtgatatcagttcgtttctgcttcgtttctcccgcatcgctacaccatccaattcagctactaggttttcgggcaagctgattttcatttcggttcttgcgctggattcagacaaaaaacatacacctccaccaaacttacggatacgactcttttatccatccagtgataatgataccattattcactcttcaagcaaagctgttttatgaattctccatttaggtaagttaattgcttatatttacctgcaataaaggatttcttacttccattatactcccattttccaaaaacatacggggaacacgggaacttattgtacaggccacctcatagttaatggtttcgagccttcctgcaatctcatccatggaaatatattcatccccctgccggcctattaatgtgacttttgtgcccggcggatattcctgatccagctccaccataaattggtccatgcaaattcggccggcaattttcaggcgttttcccttcacaaggatgtcggtccctttcaattttcggagccagccgtccgcatagcctacaggcaccgtcccgatccatgtgtctttttccgctgtgtactcggctccgtagctgacgctctcgccttttctgatcagtttgacatgtgacagtgtcgaatgcagggtaaatgccggacgcagctgaaacggtatctcgtccgacatgtcagcagacgggcgaaggccatacatgccgatgccgaatctgactgcattaaaaaagccttttttcagccggagtccagcggcgctgttcgcgcagtggaccattagattctttaacggcagcggagcaatcagctctttaaagcgctcaaactgcattaagaaatagcctctttctttttcatccgctgtcgcaaaatgggtaaatacccctttgcactttaaacgagggttgcggtcaagaattgccatcacgttctgaacttcttcctctgtttttacaccaagtctgttcatccccgtatcgaccttcagatgaaaatgaagagaaccttttttcgtgtggcgggctgcctcctgaagccattcaacagaataacctgttaaggtcacgtcatactcagcagcgattgccacatactccgggggaaccgcgccaagcaccaatataggcgccttcaatccctttttgcgcagtgaaatcgcttcatccaaaatggccacggccaagcatgaagcacctgcgtcaagagcagcctttgctgtttctgcatcaccatgcccgtaggcgtttgctttcacaactgccatcaagtggacatgttcaccgatatgttttttcatattgctgacattttcctttatcgcggacaagtcaatttccgcccacgtatctctgtaaaaaggttttgtgctcattacgacacttcctagcttttattcaatatcatttacatatcatactaaaattaaaggctaaagggaaacgatgtctaacgaaaaaaaggccaaatcatgtttggcctttggcggttatttcgatgattgtccctgcatgcttttcgctactgtcaccatttcctctttagaaagatctttagaagagagaaggtaatctacgccgtcatatgtccatgataatgatgcatccgacagggcgccgatggtgtagccgagatttaccggttcgccgttcagcgtaacggaggaggaagccttggcaatctgggctttttcctgaattaacgtaaatgatttttctcctccgtacgtcatgatgatgcgcttcccgtcttcagtagatatatctttttcttcaagcagcttgacgccaagcggcagttccagcggcgttttgaccgcaaatgtatcggaaggctttgcgcttgtggcgacatccatttgagaaagggtcatatttttcttttcatcaaatgattctttatcaaattgtttattaaattcaaagctgctgaattctactttgaccatcactttccggtcagtatccatcactttgacagatgacgggctcatatcttttttgttaaatgtgatttcttgcgtgggcagcattttgttatgctgatagtttgtttttgtttcaaatacgtatttcttttctttcgctgtgaaaactgcatccgaatcgttttgaacatcctttacgagcgattcaaacagataaacctggctgctgttgttcggccaatcgctttgaaatctgaagctcttatttaaagacggcgtgagaacgaatactccgttttcatttcgtaaaatgacttggttttggtcctttttcggattttctaaataaaccctgtacagagacggctttttgtgccagatttccacattgtatacttgaggctcactccctgtctcgatggtcattttcgcttttgctttgtacgaggtgtattctttcgccttttcatctaacccggccacaatatcttgctgtgttttttgcccgcaggcagaaagaataagaacagcaagcagtcccgttaaaagcaaaacaaagctttttctcacctttttcaacccctttttctcaattgatgtaaaaggaagaaatcgcttgtttgactttaacggtacgctcggtacacgtttaggcagaacagatgcgtaccataaaagcctcaaacaacttgtctcccttaatgcactatcaaatatatgagtggggtttccctaatatgcagactagcttgacaacctttcaatcacaacctgcgcggcagcgtattcttttgtatgagtgatcgatacgtgaacggcggcctggctcagtttcgtacaaatgatatagggcttgccattttggtctttcctaatttcaatgtcctgaaagctgagctgcctcccaatgccggtgccaaatgctttcgagaacgcttcttttgccgcgaatctgcccgcgagaaattcgttttttcttttctctgaaagctcatagtattggtcaagctcgcttcgcgtcaaaatccgctcggcaaaccttttctggcgcccagccatagaggcgatccgtttaagctcggtaatgtccagcccaatgccgtaaatcatgtatgataacctcctttgcgtacgtactatttaaatggtttgtctcataaacgtgttactatagatataccaaaatgaagaaaaggggctcggaatgtttatacggactgaaaattttcaaacatttatcaggctttaccccgttgtcacctttatattggctttgcaagctgttctctggctgtttttttcacttcctgcccattcagtcgtgttatggagggataccgtcacaggctataatctaggtgtcgcaaacggtgaatggtggcggcttatcacaccgattttgctgcacgccggtttcacacatctgctgtttaattccatgtccatctttttatttgccccggctttggaacgcatgctgggaaaagcgcgtttccttcttgtatacgccggctccggcatcatcggcaatatcggcacttatgttacagagccgcttgattacgtgcatgtcggggcttcaggcgccattttcgggctatttggcgtatacctgtttatggttctttttcgcaatgagttaattgggcaggagcattccaaaatgatcatcacactgctcgcatttgccgttctcatgtcgtttatcaactccaatattaacatgatggcccatttgtttggactatgcggcgggtttcttctttcgtttttatgcgtgcaaaaaaaagagcggcggtattaaccgccgcttcagattgttgacaaaatcctaaaatggttttcattttaggattttgtcatcttttcagcgtgattgaaaacccatgaagtctaggaaggacgagcataggagcggactttcacaggatgtgatgacgacggcgtttaggcaggacgcctgagaatttagccgttgatccacttcgcattgagcaccgaagcgcagtcctgacaacgaatgcgagggtttgccgacacgctggagcggcggtattaaccgtccgctttttcatatgagtaccactttaaaatgaaggctgcatcctcttcacctacgtccctcaccgttaactcttccatatggctcgatgatttcaccgaagtagaaatggtatacaagcggcctttcttttggaaataggattggctgaacttgcagacctgcattcgttttttcagtacaatggcggttgttctgcctataaatctagacgtcagctgaagacggtccccgttgatcgtccatgcagcctctttatacgcgagatagccgaagagcaattctatcggcagcaggatcactgacagatagccccatggctgaaagaagatacataacgggatgatcaaaaagagtgaaaaaatgacagaacggaacaaatagcgtttcaacgcgcgccgcggcaggcggcggcagttttcttccagcgtgtattccggcgtaaatgttcggagcatgtgcggaagcttttttttatgaatcattggaaagagaatggtcaaagcgccttcttctttttcccggtcgccgcctcctgcgctgacgatggacaccgttacaaagccgaaaagctggcgaatgatattttctttgattttaatggcttgtatttttcgcagcggaatcgtgacttgatgtttttcaataattccccttgaaatcaccagttcctgctctttttttatgatttgaaagttcgcgtatctaaacatcatgcccgcgatgctgaaaatccaggcgataaataaaccgataaaaatgagtaccgcataaataccgatgctggcgtgctgaaggaaggaaaatttatcgaataaccaatccatcggcagcacttcatcaagctgggaaataagtgcaaatacagcggagataatgactccgattccgccggaggtagaagcggccatgagcaattctttcgcgttcatgcgatagtgctcttgcacctcaacggacggatccaactcctcttcagcttcaagccgttcttcatcaagttcattttctcgtctttgcgcttttttcttaaagacagcttctttgatgcgttccgcttcttcaacagaaatagcagaaagaacggcttctgcctccttgcctccgcctgctgtttcaatttgcagcttcacaagcttaaagatttgctggacaaggcccgcgctcgtattcattgtttgaatccgatcaatcgatatgtatcgttttttcgtaacaaataagccttcttcaattctaaattcatcatcttcaattcgataggtaaaccttctccatttgataatgcttgccgctacaagccagatgaacagcacaccgagcgcaatggctccgtaaaaacggacagtatggtttgaattgacaatatacacaaaaaagaatggcagaatgatattttttatcgtttgaataatggtatggcataaattcaaaatgactgccaccgggtgcaggcgtttcggttcagacatcatcgtcagtcaccctcgccagacgggaaatggagtctcttagccgatccgcttcctccatctctaaagcggggatcgaatgaacggtcgcggctgtggaaattttcaccgttgccaggttgtatttttttaataatggcccttgtgacgtatcgacgtgctgaactctgaccatcggaacaatcacacgtgtcaccacaaaaatacctgactgaatatctatttcatgttcatggacttcatatcgccacaccttatgacggaccttcggaatgataaagaccgtcacaatcgatcccagcagccaaacagcgccgagcacgccgctgatccagtacggccaatgaaaataatagcttaacactgcaactgcaatgacaataagcaagcaaacagcggatatgatgatctcttgaagtcgccaaacctttaatccgtctggactgatttggttttttggctgctctctcaaaaatacctacctccctttttttcgtcgttatttatacgtctcttttacagaaaggtttcattcttaagcatacagagaaaaatggcttccgtcagctgaaagtttgctgaataacaaatcacgaacataaaaaagcccaaaacatcatgttttgggctctgaatcgatcaaattagtaagattttttctggcgtctgtcacctgaagaacggcgatcgtttgaacgctttttgtcataggaagaacggttgttgcttttcccttttccgccgcggtagccgccgccttgaccgtctctgcgtttagaagagcgctggttcttgtagcgtttgctgaccatcggcgcttcgtctgttaagcgaaccggtgtgtcgtctggctcttttgtagccattttgatagccgccgcaaccactgttactgcatcatgatcttcaagcagctcagctgccgctgtcatgtagaagttcaggttgttttcactgattgttgtgcgaagacgttcaacagtaacctgttgctgaccttctaacgcttcatcaagtgtaggctccttcatgcggtccattttgcgttttgttgtttgttcaattgcgcgaagcatgcttttctcacgcggtgtaatgaacgtcatcgccatacctgtttttcctgcacggcccgttcttccgatacggtgaacgtagctttcaggatcttgaggcacgtcgaagttgtatacgtgtgtaacacctgagatatcaagtccgcgagcggcaacatcagttgcgactagaacttcgattgcgccttctttaaatttacgaagcgcaaccatacgtttcgcctgcgttaagtcaccgtgaataccttcagctgcatatccgcgaaggttcagagcttcagccagctcatcgacacggcgttttgtacgtccgaatacgatcgcaagctcaggagactgaatatcaagaaggcgagtcagtgtatcgaattttttacgttcttgcacttccaaatagaactgctgaatgttagaaaccgtcatttctttcgcttttacttttacgtgttccggctcagtcatgaagcgctctgcaatgcgtttgatcggcgcaggcattgtggcagagaacagaagtgtctgatgctcgcttggcacgtttgaaaggatagattcaatatcgtcaatgaatcccatgttcagcatttcatccgcttcatccattacaacggtatttacattgtttaaacgaatggtgcggcggttgatgtggtcaagaagacgtccaggtgttccgacaataatattcggattcttctttaacgcccggatttgccgtccaatatcctgtccgccgtaaataggaagaaccttcgcacgtttatcttgtccgattttatacaattcttcagatacttgaatggctaattcacgggttggcgcgattacgattgcttgaatattaggagactcggggttaattttttcaacaaggggtataccaaacgcagctgttttacctgtacctgtttgcgcttgtccaatgacgtctttatttgaaagtccgagcggtatcgtttgtgcctgaatcggtgttgcttcttcaaatcccatacgattaattgctttcatgagatcagaacttaaattaaaatcttgaaacgttatagtcaaattattcaaactccttctaattgctgtttcagtaatgtcgtgatttaccacttataaaactgccctttagacaagaaggacaggatccatccgtatacaaagcccgaattactttaagttttatcttaccattacactatttgtttttcaataagatgagaagcagatcggcatctcgaatatgccggctgctgctccatccgctcccaagaatccagcggagaacttcgggtcacgatgaaaagtccggacgaatatgttcgtatcgcgaaataacctatatatattgtatcatagccgcagccggccagatatacataattttcggccggcatacattagtgtttgcatatcaggttattttatgatgcaatatgcgttttttcgcaaaatattttcttatgaaagcgggctctctattaaatctttaacgatttcttcaagcttcatacctctggacgctttgaataaaatcaaatcgccttttgatgcgttttccttcacagcttgaaggagatcttttttctcagtgtaatggctgacgcggtctttctcaaagtgtttcagggcgccttccgcgataaaagctcccagttttccgtacgtaaagacgcggtcaattttatcagggctgatcacagcgccgcactctttatggaacgtttcttcaagatcgccgagttcaagcatatcaccgagcacgagcatttttttgccgtagccttcaaggctttctgtcaattgaattgcagctttcatggaagtcgggctcgcattataagcgtcattgattatcgaaaggccgctgtctgttttgatgagttcaagcctcatcccggttacctttaggccgctcagtccttttgccgcatcctcaggcgcgatgccaaaataagcccctgcagcaattgcagccatggcgttcatcacattgtgcttgccgagtattggaataaaaaacgtgttttctatccctttgattgtaaaatgggttccttcctcactctggctgacatcctgaagctgataatcattatgcgttcccgtaccgtacgttttcgtctggcagctgtatgcattttgaagaagcggttcgtccccgatataaatcagcactccgtcttctttaagcccgtttatgatttcaagcttcgcctccgcgatgccctctctagagccgaggtcttgcatatgcgattcgccgatattcgtaatcactgccgcatccgggtttgccagtcggctcaagaggtcaatttctcctttggcgctcattcccatctccaatacggcgatctccgtattttcaggcatcgctaaaaccgtcagcggcaaaccgatatgattattgaagtttcctccagttttgtggacacggtactgggtccccaatacggcgtgaatcatatcttttgttgtcgttttgccattgcttccggttactccgatgacacgcgtgccaagctcctgcaaataagcttttgcaagctgctgaagtgcagtaagggtatcgtccactaaaatgacggcgtgattctcgggcggatttggtactgaccgatcccaaagaacagccgctacaccagcttcaaaggcctgctccacaaaagagtggccgtcaaaacgttcccctttcagcggaataaagagctgatgttgttccagttttcttgtatcggttgccactccatgaatgactgtttgttcatattgcggatttgctagtgtgcctttaaccatttcggcaatgttttttactgttcgcttaatcaagtaaggtccctctctttcttttgtatatacgggaaaaaacactgcccttttaccggcagtgtccttcttcattagaatgtatgcttaatcaattgtttttcagcgtggcgttcttttgcaagctccacaagctgttcaatcaggtcagcatattccactccggcttctttccagagcaacgggaacatgctgaaaggtgtaaagccaggcattgtgttgacttcattgatcagaacttcgccgtcagctgtcaggaaaaagtccgctctgacgagtcctgaaccgtcgatcgctttaaacgctttgatcgccatatcactgattgttgcgtattcctcatcagtcacaatcgccggaatcatcagatcagtatctccatcctcatatttcgctttgtaatcgtagaaatctgtcttcggtgcgatttctcccacaacagagcatttaggatcatcatttccaagaacgccgatttcgatctcgcggccgttaattccttcttcaacgacgactttgcggtcatattggaaagcaagctcaaacgctttttgcagttcttcacggtttcggcatttgctgattccgacacttgagccgaggttcgccggttttacgaagcaagggtagcctaattcctgttcaacctcctcacagctttctttcggagaacgagtccagtctttcttaaggaaagctgcgtatttagcctgagcaaggccaacctgcgcaaataaatgtttcatgacaactttatccatgccagctgaggaagcaagcactccgttgccgacataaggaatgttcaacagctcgagcattccctggatcgtaccgtcttctccgttcggtccgtggaggagcgggaatacgacgtcgatggcttcattttgctgtgacgcttcctgcggaaacatctcctggttcagggcagctggagaaaaagcactgcctccttgctcaaattgaagcattttcacgtttgaaacaggttcagttaaacgggcgcctctaacccattcgcctttttctgttatataaatcggatgtatatcaaacttctcagtatttagcgctttgattacagccagagctgtctgcagggaaacattatgttctgccgactttcctccgtacactaatcctagacttgttttcaatggatactccccccactacaattcatctttactatcttatcattttcaccggaaaatgatctaattatttttgggcatgctgatgttgaatgcatttgtatgtaattcctttttattttatattaaaatggcattgaaaaggagatgtgacatatgaaaaaaatcacaacaaacgaacaatttaatgaactgattcaatctgataaagaaatcattgtaaagttttatgctgattggtgcccagactgcacacgcatgaatatgttcatcggcgatattttggaagaatacaaccaaaacgactggtatgagctgaataaggacgagcttcctgacctggctgaaaaataccaagtaatgggcattcccagcctgcttattttcaagaacggtgaaaaaacagctcaccttcacagcgccaatgccaaaacgcctgaagaagtgactgaatttttatctgaacatataagctaattcgttaaacagccttattttatgtcgtcaggctctacatgaacatgaacatgagtgacatcgtgttcatgttttattttgtcttctacttcatccgccactccatggccttcttctactgtaagcttcggatcaaccgtaatcaccatctcgatatgaactgtactgcctaaatacctcgctttcacatcctttaggcgatgcacattttcgatcctgccgacggtctgtttgtaaggctcaagatcttttaaatggaagccgtctgttaaggaatgtgaagcgtctttaaagatatcccacgcagttttgcaaatgatgatgccgatgataaaagccgttaccggatcaacccacggcagcttcagctgggacgaaaaaacaccgataaacgcgccggcacttacaaaagcgtctgacctgctgtcctttgccgctgccatcagggcagagcttttaatggacgctgccagccttttgttatataaatagatgccatacataaacacagcactgcctaacgccgtccatgccgcgataagatttggcgtttccgttgtgccgcccgcaatcgcttttcctccgccgattaacacttcaatgccgactgccatcataataaaagacgcaacaagagacgaaattgtttcagcccgataatggccgtatggatgatcgctgtcagccggtctttgagaaatccgcaatcctatcagcactgctactgacgcaacaatatctgttccattatttaacccgtctgctctcagcgcttcagaatgatatagaatcccgataactagctttacaacagcaaggatgacatatgcaaaaatattgaggagcgcccctttttctccctttttcagattttctgtccgctccattgaataccagcctccattctattacatagtatggttcaaaacatgaaaaatagcagggtgcgttcaatgaagcggaatatttcgacagcaaattattgcccgggaaactttttgtcgatttgttgaatgtttgtaaattggccaagaataggactcttttcatctttacaggctattgcggacattgtatactgaagttaattgataatgattatcaatatcgtttgattggaggttggtgacacaatgacacctcagtctgcagaaatcagaaaaaaacagctcattcatctgttaatacagaatggtatatacaaaaagtcaaagcgtcatctgtatgaattgtcgctgacggagttagaaagtgaatacaaacatgtcaggagggcgccggagcatgccgaagcgtaaagtgaaaacttaccaacagctgatccaggaaaacaaagaggcgattatgggcaatccaaagctgatgaacgttatttatgacaggatcgaccgcaagcatcaaaaaaatctgcaagagcaaaacaatacataaaaagagccggtaaggctcttttttttatgactcaaacgcttcagctgccagcttgtgtatcacggcgtcatccatcggcgggttgtgaagaccggcgcgcacatcacggtaatagcgctgaagcgggttggttcgttccaggcttttggccccgacaattctcatcgctttatcaacaacagacagcgcagcgtttgtgacgatatgtttcgccgcaccgagctcgctggtcaagtgtggacgccgcaccggatcgtcatacaattgagcgatatggaaaagaaagtgtctggcattgagcagttcaagctccatttcgcctgttctttgctgtacggccgggacattcttgatcggtccattcaagctgtttggagaatactcagatgcaaattgcactgcatagtcacgagcagcttgagccacaccaagataaatcgcaggaatgtgaagcagccagccattcggcttagctccacgaggcccttgaagcagttccaccagcttattctcatcaagcattacttcgttcagtacaaggtcatggctcccagtcgcccgcatcgccatcatatcccacgtttcttcaatcgacaagccgggatcatctttatgaatgagaaacacgcctgttgtttgtttgtcctcaatccatgcggttactaaaaaataatccagagcttgtgacatcgtcgtaaaggtttttctcccgttcactgcccatttgccatcctttttgacggcgtgtgtaccgggacgccctcctcttgtcgggcttccggttttcgcttcagtcgccgccctgttaatgacggctccgttttggacttccttggcaacaaatgcaaatacgtcttcatcccagctgttgccttctccaagctccccgatcacgctcaaatgccagccgatgctaagagccgtcggagcatctccccgtgcaagccgttcttgaaacaagagcatatcgtaaacagaaatgccccctccgccatgagatgccggcaatgttaatgctgtatacccagcatcacgcagtttttgtattttctctgcaggaaaacgtccctgttcgtcatcttcagcagctgtttgctgaaattcatccgcaatccgtccgattttctccatccattgccgctgttgatcgttttgtataaataatgacatccggcagccccccagttttaattccgataaatttaatatgtattatagatttcctgccatttttccgcaactgttaaccttttgcccagtatagaaaaacacgccgttccccaagggaacagcgcgattacacaggatttgcatcccggtcttgtttcatgccgagataaatcagcatatatgtcaggtaacccatcgtcatcaccaggccgccaaagaaaaagcttgagaaaatcggctcttcaaaagcggtcactgcggccaacacaatccagctggcatacagatagatgataaaatagcggatgcccgtcttcattttatatatcatgtacagtcccacgagagaaaacaacccaagcgcgagcctgaaataaacaagatgttcaaactgaaacatgaatgacacaaatgagaatccaagcagcaatacgatcggtaaagcggtaataaagttcctcaatcgagacacctccgtcagtacctttagtataaaccaaaatatcaaatgatattgatttacgtgagctttttcacaaaaatgtcattccttgcctttagacccgaacatcccgtttacagaagcaccaccagccaacaacgatgaagaatatggcatgtatgatgagaattccaattgaaaacaatggcgtcatgcctgaaaacaacgctgtctctccgcttctgtattgcgtaaagtcagtgttcgcaaaaagcaaaaagctgccccacttgttttcaaacaacttcatgagctgaacaagtgtactcgctccgtataaaacgacaaaagaaacaacaactgctaccgcgctattgcggaacagcgaagaacaaagcagcccgaataatcccatcattacagcttcaagccagtttgacccgatcagcgccaaggtgttgaccagcaatgtctttgattccgcagtcaccgatgtgccaaaaaacaagagaccgaataataatgccagaatgtagtatgccaaatacaaatagaagctgaccatcacgactgtgattaattttgaccaaaagaccttttggcgtttaaccggacgaatgagcaaaaatttgatcgtctttttatcaaattccatcgaaacaattgttgctgcaattacgatcgttaaagcctgcagcaaaatgttcaggctcggtgtatacgataaatagccgatgaagttttcatctgttccggcactgatgacaatccgtttaatgatcaatgccatgaagaattgaaagacagccatcaggataagagaaaccaaagtgaccttccgattaaaaagtttcatatgttcattccaaattaatttagacaagctcttctccctcctcttgatgagctgttgtcgcttttataaattcgtcttccagtgactgcgtgtaaggcgtaatggaaaatacattcagatcttgtccgacaagtgatcggttcagctccggtatgttttcttttgccacctcaactacaatcgtcccgtcttggctctcagcttgatattgattgcctgtcagccaattgagcgctttttcttgcggctgcacttctataatcgctttttctgtggtttgatcggttccttgtaagctgacttccgctttgatctcacctttttgaatgatgatgacacggtcgcacaagtcttcaacctcgcgcaataaatgagtggcgaacaggacagctgttccttccatttctgcgagttccttaatatgatcccgaaaatccttcatccccgcaggatcgaggccgtttgtcggttcatctagaatgagaagcttcggccggtgaagaattgcctgggcgattcccagacgctggcgcatcccaagggaataggttttcaccttatcatgaatcgctgacgtcagcccgacacgttccaccacttcatcaagccgttcatccgctatttttttgtgcatattcgcaaagtgcttgaggttttcccagcctgtcaggtacggatagaactcagggttctcaacaatcgctccaaccgcttccatcgctttttcaaactctgtatcatgctggaatccgctgattgtcacgcttccgctgttttgtttcaacagcccgacgatgatacggatgagtgttgtttttccggaaccattcggaccgagaaggccgatgatttcaccctccatgacgtccatgctgatctgttttaaaatctgtttagacccaatttttttatcgaggccttcaatatgtaaaatcggctcagccataaagccttcctcctttttcgacaaaaaataaacagtgcccaacattaggcactgtttgtattatagcatttgttgcttccaaatgtttggttaaaccgatgatgagcgtttgctccgactgtttgttcttttcagtttccgtactgatgacaagcattgtcacctgttgtgttcaccactgtgcaaggcaatgccaagctccgattccgagtcttaattccatgccctgaacaggcaggccggcagatcgaggcacactcattattcgattttaaactactttttatcgctattctctcggggtcctttagacctatcttccttgttggtgacatccagaatatcaaggagaaacacaaagatcggaatcccgataattaaaccccaaatgccgaagaagtgttcagagaaaatgagtactgtgaaggtgaaaaagattggcagctctgttttcgccgacatcagcttcggatttaagaaataggtttcgatcgcatgaatggcgaatatgacaaggacaatgtagagcacatacattccaccgccagtgctgtaggcgataatgctgagcggaatcagggaaatgacgacgcctgctacagggatcaatccaaggaagaacaccataatcgaaagcccaaacagctgcggaaaatgcataatccaaagcgcgataaacgtcagaatacagttgacgagcgcaatgataaattgagcctcgagcaccttgccgaacgttcttgcaaatttgcttccgaaaaaagcaatctcctcataaaagaccctaagtttgctcgttttaaatttcgccatgaattcagaaagccgttttttctcaaataagaaaaacatgctaagaatgagcgccatcacgacctgcaagccgaatgtgctgatatcggccagatacgtatacactacattgaagccctctttgacatatgaactgatgttaatatctccgaagacactggtgatctcatcaaagaaagggatgctgtcaggatgatacgcaatatgtttaatctgctttaccagctgctggatctgcgccgcgacgaccggataaaacacaaagcccccgactgtaagcagcacagccagcaacatgtaaagaaacgtaatgacaacccgctggctcacgcggaagaactggcttacaaactgccgcacgacaagctccaaacgatccattagaaatgtgaaaatgaaggtaagcaatattaagttgatcatgctcttaaatagatataacacaccagttaacacgacaaagatggagaaacgccttactcccgggtgctgaaaaaatttaactaaagcggccatttatacactcctgttaggacaaacgtccttcattcaatatagtatccatttgtaaattatataacaaaaaaatgctgaggtctctgtccttaccttaataattcttaaacaattaaaaaaacggcccatggatgggccgttcttttttcagactgctgttttcatttttttcatgccttcaacagcctctatgctttttgcttcatcaaattcattttcgcttttggcaacaatgatcgtggcgattccgtttccgatcaggttcacaatggctcttccttcactcatgaaacggtcgaccccgagcaggagtgcaagcccctccagcggaatgacctgcagcgctgacagcgttgaggcaaggacgataaatccgcttcccgtcacacctgccgctcccttcgatgtcagcatcagaacgaggataatcgtaatttgctggccgatgctgaggtctactccaaacacctgtgccaaaaagacagtcgccattgataaatagatggatgtgccgtcgaggttaaacgaatagcccgtcggaataacaagcccgacaacggatttggaacagccgtagcgctccattttatccatcatacgcggaagcaccgattcggaagagcttgtgccaagcacgatcaaaagctcatccttaatgaagcgaaggtaattccacaggctgaatccgtaaagcttgcagatgatatttaaagcaacaaatacgaacaggaacatcgtaatataaacagacatcattaagcttgccagcggtttgatggaatcgagcccgaagtgtccgattgtatacgccatcgccccgaatgccccgattggcgcggcacgcataatgtagccgataattttgaaaaaaacgtgagaaaccttgtcgaagaaatcaatgacgctttttcctttttcgcctaatgccgcaagacccactccgaaaagaatagaaaagaataagacctgcaaaatgtccccttttgcgaaggcatcaaccatgttggacggaacaatgtgtgtaataaattcaatccagtcgattccctgaccgccattttgcgtgtattgtgatacatctcctttttcaagcttgctgtaatcaagacccgcacccggcttcataatattgacgacaaataaaccgataatgagtgcgagggtggtgacaacctcgaaatagataaacgcttttccccctacttttccaaccttcttcatatcgcccatttttgcaatcccgagaacgattgtgaagaaaatgattggtgcgatcaccattttaacagcgttgataaatgtatcaccaagcggtttcatttctttgccgacatccggccagaccagcccgacaatgaccccgatgatgaccgcggttatgacctgaactgttaaatttttaaacagtttcatatccttcatccccctgtcctattcgccttttgtgtctttcttactagaatgatagcgttttcatacagtctggggaagtttatgatcataacggacattttggtctttttggtctcaggtttatccttttaacacgtagcggttgaccggccggccgactccgccgtattgaacgtccaatttgatgatcccggttttttctaagtaatcaagatatcgtctggctgtcactctggcgatgccgagcgccttggcaacctcttcagcagaaagggatgcggtttgctgtttcaaaaaagcagtgacttcattcatcgtgaagtgattcaaccctttcggcagatcctgtacggcctgctgcggaatattcaggatcgcatcgagctgttcctgggacagcgtatcattcgcttcgattttttgtttatattgcttgtacttttcgagtgcctgtctcattcgctcaagcttaaacggctttaagatatagtcaaccgccccgttttgcagcatgagtgagatcgtttccttgtcttttgcagcggagacgacaatgacatccacttcaagcttttgctttctgatctcctgcaaggtcttgatgccgtcttttttcggcatgtacacatcgagaatgacgagatctggctgttcttctttaatcagcttcatgccttcctctccgtttcctgccgttgcacagacagtaacgcctttaacagttgtaatgaaatccttattgacctcttgaaccatcggatcgtcttcaatgagcagaaccttccattctttacgagccatgctgtgcttcctcccccttcattggaaaaacgatagaaaaagatgtcccctgccccgcatgtgaatcaacttctatcgtgcccgatcctttgtctatgatttgtttcactagatacaggccatagcctgtgccgccagttttattgaccgtaaaacctttgtcataaaggcgaggcatatgtgtcggttcaattccgcagccgttatcttctattaaaatagcaaggatatcatctgtttgttcgatactaatgtcaattcgtttgtcttcagattgaacggtttcaaatgagccgaaggcattttcaatcagattccccaaaagcacgacaatatcatgctgatcaacatgctcgggaaattgctgaagactgctgttttcatctatatgaacagcaatgccgagctctcttccccttctgattttacttaatagaaggcctgccgcagcgtcattttgaatcgagcggtgcagaaattcagtcacattttcctgctcagttgacgcctggaatgcaagctgcaaggctttttcagatttccccagctggatgagaccggcgatcgtgtgcagcttattcatatgctcatggttttggacacggagcgcctccacaaagtttctgacaccagtcaattcctctgccatcttggccgcttccgttctgtcctgaaaaatcgcaacggcgccgatcacttttttcttcatgacgatcggaattctgctgctcatgatcaccttaccgctgacacgaatttcttcattataaaccgctttgttccgctccacgatttcgggcaggcgcgaatccttgagaacctcccaaatcaccttgccgattagatccccctgcacttcaaagatctgtttcgctttttcattgaagatcgtaatgacgagacgattgtcaatagcgatcaccccttcattcatcgagtgaaacgtcgctgtccgttcttcatacattcggacaatctcatggggttcaagctgaaacatttgttttttgatatggcgggccagcaaaaaggaaccagcaaggccaaagccgagtgtcagcacaacgatgaaggcgatatcacgctttaaatgaagcaggatgtcagcgatccccggcagcgtttttccgacaagcaccacgcctatttggttcaggtcttgatcctttaccggataaaaagcgcgaaccgccgtgccgatctcgccctttgcttcagagaaataaatgtgctccgcaaaagctgcctcctcgtctgcaccttctgatttcttgccaatgcttgtgctgacaggatgcgtatatcggatgtgattcatatccatgacgacaatatagtctgcttcattaatcatcctgatttcttcaaccgcatggcgaaccgcttctgtttgtttttttcgcgccaaggcttctttcacttctgtcatctctgacaccgtccgggccgtattcatcagccgctttttcagctcccgctcctctgtatgctgaatgttgccgatgagcacaatgccgccgatcaaaaaggagaaaatgacgagtatataggataagatcgtgattttccaacggattgagagcttctttttgttcatcagcttctcctttcaggtctttacgaatgtcatagcccccattatccttaacataggggagggcttttcatgaagagtttgcttgcatgtctcgcactgatgatcgctggaattgcaaccgctttatttatcggattccatgatcataccggcaataaaaagattgtttatgatgacgaccaggaaggcctgcaggatcaaatcgtgtttaaattcagccacgtggttgctgaaaatacgccaaaagggctggccgccaataaattcgctgatctggtgaacgaaaaatcaggcggaaaaataaaaatagaagtatttccgaatggaagcctgtactcggacattgaagaaattgaagcattgcaaaacggcgatgttcaatttatcgccccctccacatcgaagctcggcatgctctcgcctgaatggggagtgctggatctgccgtatgcatttacagattacaacgccgtcaaaaaagggctgaacggaagcatcggcacacagctgtttgattctctaaagaaaaaccaattgaaaggattggcctattggacgaacggctttaagcaaatcacaacaaatcaagggccggtcaaaacaccggatgacttaaaagggcaggatctgcgcattatgcaaagcgatgtgattgaggatcagttcaagctgcttggcgcaacacctcatcaggaatccttcaattctacctttcagctgttagaaaacaatgtagtcgatggcgaagaaaatacaatttcaaacatctattctaaaaaattttataatgttcaggactatttgacaataagcagccacggttatctcggctacgctgtcatgactgatgaacacttctggaaggcgcaaacaccagaaacaagacgcattttgactgaagcgatgaaggagacaacggagtggaatgaaacgtatgccgaacaaatgaacaaggagcagctggaagaaatcaaaaagaattctgctatacatatttatgagctgtcagataaagagaaacaagaatggatgaagcgtcttgaccctgtttaccggcagtatgagcccatctttggccgggagctgatccgggaactgttggagctgcgaaaagattcatagttcccatctcgatacgctgtttttcgtttatctttctatcgatcggaaatataaaaagagataaacgaaaaaggagatgggtacatgtttaagcacacaaaaatgctgcagcatcctgctaaaccagatcgtccagatccattattcgctaaaaaaatgcaagaaattttaggcgggcaattcggagaaatttcagttgccatgcagtacttatttcaaggctggaacacaagaggaaatgaaaaatacaaggacttgctgatggatacggcaactgaggagctcgggcatgttgaaatgatcgcaacgatgattgccagacttcttgaggatgcccctcttgatcagcaggaaaaagctgctgaagatccggtcatcggctccatcctaggcggcatgaaccctcaccatgcgattgtatcaggacttggcgccatgccggaaagcagtacaggcgtaccttggagcggcggttatatcgtagcaagcggaaacctgctggcagacttccgcgccaacctgaatgcggaatctcagggccgtctgcaggtcgcacgcctgtttgaaatgacggatgacaaaggcgtcaaagatatgctcagcttcctgctggcgcgtgacacgatgcaccagaaccaatggctcgccgccattaaagaattagaagcacaggaaggtccggttgtgccgggtacattcccgaaagcgctcgaaaaacaagagttctcacatcagcttatcaatttctctgaaggcgaagtaagcgccgagcaaaactggctgaatgaaaaagcgccggacggagaagcctttgaatatgtgaaagaagcaaaaacgtttggagaaaaaccggagttaaaaccagcaccgccttttgttcataatacacttccgggacgcgagtaaagagacaagcccaaaacatgatgttttgggctttgattatgccttcagaaccgtccagtttggttcgtaccggatatcggggttatgtaacagatcgtgaacgaacggtttatcctcttcgtacaccgtcacctctatcgaaagaattacagccttctgatcgttttcctcgtatatgctgtcatgttcgttctccataaaatgatcataggcttctctgttttcccatacactgatgatttctgcggtgagcggctcgtctatcgtttttcgccagccgccggcctgtttgataaagccgcttatatgcgataacgcttcccactgtgactgcgcttttgcaaatgcttcagcgtttgcagcatctacttcacatatcatctttttgattagcatggctgctcctctatgatgacggtttcggcttgtttatgctccacacagagatttaccgttctgacgtaagagcgtgtgcggtgaaccgtgcctttagggatcagcaggctgtcatttgctttgagcaccgcggtttctttgtccttaaaatcgatcagcagctccccttcaagaacaataaacaattcgtctgagtcagggtgatggtgccagtcatattctcccgtaaacaccgcaaggcgcacgcagtggtcgttgacctctgagattgaaaaattggcgtgcttttctttgacttcatttgcgatggcgagcaagttttgcatcttggacattagcgaaaacccctttttcacttattgtatctcaatagcggcataaattgagaagattccaaaaaaaaagcgatccagctgatgtgccggatcgctttttatttacaggttgtctgcctttatgcttttgattagtcgttgttgcgggcgtttccgccttttgagccaatttcttggtagaattctttatcatgatttttgcttgttgcctctccgccttttcggccgatttcttgatagaattctttgtcatgattttcgctagtggcttctccgcctttttcaccgatttcttgatagaactctttgtcatggttcttgctagtggcttctccgcctttttcgccgatttcctgatagaattctttgtcatggtttttgctagtggcttctccgcctttttgaccaatctcttgatagaattctttgtcatggttcttgcttgttgtttctccgccttttctacctgcttcttctctgctcattttgttattgtctgccattttgaattcctcctttaattggtgttggttgttgtattcccgctcacaattcttttaaacaaacaaaacacattgggtatgtttccactaaaaaaagcaggcggatcgcggtgtccgtctgctttctgctattccatctctcgttctgtttctttcagtcgttcaagaatgcgcctctttttgtacagcatcatgcctgtctcggtaatgtcgtttaatgttgagcgattggcagcggcgccaaaaaccattccggcaaccggcactatctggaaaagttttttccagccaaacgtgtctcgatagcccaaaacgacttctcgccagccttggatttgagaagcgacattcttatatgtacggtcttgatcgtagtgttttaattcctgcaaaatcgatcttttgccgacaacatcagccgacgtaagctgcaggcatttcacaatgaagactcgttcttttttctcctttgggtcatagccgtatgcgactgcgatatcctgtaatgtttttagtgataagccaagcactgccggaatgtctgccgccagcgtaaacacgccgcccacaccggttgtcgcgccttgaacggttgctgcgttggttctgtttttgcccattccttccgcaatttcatccatgacaggaagaggcgctttccggatgtcctccagcgattcaaagatctcctccggcagtttcttttgaaacatcctgataatctgtttttcagatgtcaggtactgtccgcctgtttgaacaaagctgccgacctcatccaagagcttgccgatctttttctggatgaattctggtgtcagcttgtccaggagttgaaacgggagacggctgagcttttcccaaaaccagactttttgctgatctttttcccatttctctatctcttttaattgctgatgtaagtcttcttttcgttctgttggcacccaacccgcacttcccttccgttttttctactatatagtataccttcattttttcggatgcgtttttatttttcacctgcgggtaccatttttataaaaggaaaaggagtgatagacatgccttggtcgatgaaggattatcctgcttcattaaaaaatcttgagaagccggtgagaaaaaaggcgatagacattgcgaatgcgatgattgatgaaggctatgaggaagggcgcgcgattccaattgcgacaagcaaagcgaaggaatgggcggaaaacgcctctacagatgaaattgatgatttcctgacgcatgatgatgagacagaacgcgatgctgatccaagcagcggcagcggccccgagctcatgaataaagcagagcatgttattaagcataaaaaaggctgggcagtcaaagccgagggcgccaaacgtgtgtctgaaatcaaggatacaaagaaagaagcgattgaacgggcaaaggaaatcgcggcgcataaaggcactgaggtcattgttcatttagctgacggcagtgtgcagagaaagattaaaacaggatcataaaggaatatgctttcaagtgtttcgaaatgatcaggagcggttattgattggtaaatcatttatgagaggtgatcatgatgcttagctttttggtttcattagttgttgcaattgttatcggattaattgggagcgccattgtaggaaaccggctgccgggaggaattttcggctctatgattgccgggctgatcggcgcttggattgggcacggacttcttggcacatggggaccgagcctcgccggctttgctattttcccggccatcatcggggcagccatcttcgtgttcttgctgggccttatattccgcgggctgcggaaggaagcctagactcattagatacaggaggcatcgtttcgaaatgaaacgatgtctttttatatgggaccttatcacgaatccctacatatcatgttacataacagggaaaaattcagaagtgtattttgaacattttcggttgacaagaaaccgggatggtcatatgatgtagataaaataatttgccttaaggaaactctttgttgtacggcaaaaacaaacagaattcaggtgagacatgatgaacaaggacatcacagcacaatctccccgttccaaagccgtccaagatgcgcttgacgggaaaatcagaggattcagagggctgctcccttttctcggccctgcatttatagcagccattgcctatattgatcccggcaacttcgcaacgaatatttcggcgggttctaaatacggatatatgctcttatgggtgatcttattttccaatatcatggcgcttttaattcaatccctatccgccaaactcggtattgcgacaggcaaaaatctgcctgaggttgcccgtgaagaattcccgaagcctgtctcgatcggattatggattcagggcgagttggtcattatcgcaactgatctggcggaatttatcggagcggctctgggactgtatttgctgttcggcattccgatgcttgaagcgtctattattgcggcgatcggttctttcgcgatattggagcttcagcgccgtggttatcgctcacttgaagcaggtattgccggtatgctgtttgtggtcgtgatcgcctttgcgttgcagacctttttcgcaaagcctgatgccgtgtcagtgatgaagggcctttttgtcccggcgtttcatggcaccgacagtgtgcttcttgcagcgggtattcttggcgcaactgttatgccgcacgccatttatttacactctgcccttacacagcggcgggtggttggcaaaactgatgcagaacggaaaaaaatctttaggtttgaatttattgatattttaatagcgatgctgattgcaggggctattaatgcaagtatgctgattgtggctgccgcattattcttcaaaaacggcctgtttgttgaggatctcgacgtcgcatttcagcaattcggacatcttgtcagccctatgtctgcggctttgttcgggatcgggctgctcgttgccggtctatccagttcgtctgtcggcacactttcaggcgacgtgattatgcaaggatttatcaactaccgcattccgctgtatgtacggcgttttatcacgatcattccgccgatcttgatcatcgcgtcaggtgttaatccgacgaccgctctcgtactgagccaggtcgtgctgtccttcgggatcgcctttgccctcattccgcttattatgtttacaagcaataaacggatcatgggatctctgatcaacgccaaatggatcacagtggtgtcttggctgattgctgtattgatcgttgctttgaatgtgtttttaattgtagatacgtttcgataaaaaaaccggcttctaaagccggtttttatttttccgcaaaagctcattgataccctttttgacagaaatttgttatgatagaagaaaaatcggagttttgatgatgtcagtatttattctgttttatttgtggattgttcctattgttatcggcattttatgttctgttgctgcccataaatccaagggaaaaatgagagtcgcgcccggcattgccatgatcgtgctcagtatcatttccctaatcacggcgtttacggccggacacacaaatttccacgtgtttatcggcggcatgtttttattcggcaccttcttggtcggttctgcttttcctttcttcttcgggctgaagaaaaaagaaaaataacctattatgagaagagttctgtaagatttgataagaataagcatgcaaggacaaatgcatcttcctttgaaacaagatgcatttgtccttttgtctgtttcgagtatggcgaaatcagttcctaatacatataccgatcattttatgaattcaaacatgctgaaaatacatttagtttaccaaaaaaaaaaaaaccaagggctcttagggcccctgtttttttaaaataaccgtttcaaacttttcttcagtgacggcatttcaaatttttggttttcgaagaagtttttcagcatgtacttgctaaagcctttcgcctgcccgtaggtgattttgccaggaagcggcggttcgtttccaatcatgacatccactacgaccggttggtcagagtgcagcgcctcatgaaaagccggcgcaagctcttccgctttggtcactttgatgccctttgctccgcagctttctgcaaatgcggcatagtcgacattttgaagttttgtgacatagtcgatattgcctttgacctgctgctcgtactcaatcatgccgagattttcgttgtttaaaataacgactgtgatcgggagcttatatttaacggcggtcggaaggtcctgcatgaccatggaaaatcccccgtcaccgcagacggcgatcgcctggcgttccggttcggacaagctcgctgcaatcgctcccggcaggccgcagcccattgtcgcaagccagctggaaacgatgaaatcctgattcgcgttcattttgaaatgacgcgccatccagactgtcacagtgccgacatctacagagagcaccgcatcatcggctgccgcttcctgaagacgggccacgacctgctgaggtttaagcggtgttgttgcctctgtctcatctttttcaatttcgttccaccaatgctgcatatgttctgtgcaggcattcaggaatcttctgtcttccttgcgttcaatatactctgtcaattcgcgcaaaccgagagccgaatcacagacaaggcccgctgtcaccggataccgttttccgatttttgccgggtctgaatcgagctgtatcgccggcgtgtcatcaggcaaataatcacggtacgggaatgacgttccgagcatgattaataaatcacattcctccattgcctcgtaagccggctttgttccgatctgaccgaggttgccgagaaaatgtgggtgcttatcgggaacaacaccctttgccgggagtgtaacaacgatcggagcggcggctttgtccgcaaattctaagagctcccgtttcgcctttttcattccctgccctgccaggataatcggtttcttagcgttattaatatattgggcgcaggtgacgagctgttcttttttcggttctaggttcccttcaatatacaccggtgaagtatacacgggctcccgtttgattttctccgcaaacaaatcatctgacacgctcaataccgcaacgccttttttgctgtaggcggtcctgatcgcctgatttaagagatccggaagtgattccgcgctatgtacctctctgttgaacacggccacgtcctcaaacatttgctccagcttaatctcctggaaatagtcccgtccgacttcgccagaagaaacctgtcctgcaatcgccagcacaggggcgccgtcggctttagcatcatataaaccatttaataagtgcaccgctcccggccctgcgattgacagacagactccgatcttgccggtgagttttgcttcagccgcggctgccagtgccgctacctcttcgtggcgggtttgaatgaacttcagttgatttctttcgtgtcttaattcttcgataaactcatttatactgtctccggggatgccgtatacatgatcaactccccattgctcaagcagctctgtcattgcttgtcctgcagttttgtgtgccataacgtatcctcctttttccttttttcaataccacaggagaaaggctttaaaacccggagacctgaatcacttgcccagtcttcttttcaacaggtcgatcgccgcgagcaacccgctatccttgacggtgacatttacatcttgagcgccgttcttgaaatcattgatctgcctttttcgattcggcaccataaaaagcggcaaacgccccggggaaacccactttaatcccgctgtctctgtgccgtcagccattgcttgtccgcctgtaatgcttccgaaaaacagatgctgttcatcttgaaactttggcctttggtaaacacctattttcgcagaaagcgctgcattgtatcccgtttcttccaatatctcccgcactgccgcttcctcagccgattccccgggatcaaccctgccgcccggcaaatcccatagagggacatcttttcgtttcaccagcagaatttgctgactttcgttcaatacgatcacaaaagcaccttgtgtatacacccccatacctccttttcccgctaaaaaggaccaaggtgattcccttggtcctagagctttactttttaaaatgatacggcagtgtggcaaccattatgtcctttttccagaacagccggactctgaggaggaaggccgattggttgtgaaggatggtgtgccagcgttttttcgttataaattgcggaaacagcaccataacggaaaactgctccttcttcgcttttgcctcaactgtttccaaaaacttatcaaacggatggacaaggcttctgtaagaggagtgaagcgtcacgagacgcactccgttattaagctcttcccaacgtttttcgaatttcttttcctgttctctgtcaaatgacacgtgaacggcgatcacctgatcggacagtgatttcgcatagtgaatcgatttttgcacgacggtggtgacaccggccacaggcacaatcacaacggtgcctttgatttcttccggctctttgtctacgatgcgaagctgttcaccaaccgcagtatagtgatttttaatcgcaaaaaacagcaaaacgacgataggcataaagattaacacaggccatacgacattaaacttcgtcacaaacagaatggatagaaccataaatgatatcagagcgccgcaggagttgatcagcatttttccgatccagccttttggtttttgcttgatccatttcatgcacatgccggtttgtgaaagcgtaaatggaataaatacgcccacagcatataacgggattaagtgctccgtctgtcccccgaataagataatgagaacaatggaggcaaagcctaaaaagataatcccatttgagaagcctaagcggtcgcccctgactgtaaacattcgcggcatatactggtctctcgccaggttgaaggcaagctgcgggaaggctgagaatcccgtatttgccgcaagaaccaaaataagcgatgtgacaccttggatgacatagtagaacacattccgcccaaaggtttcggacgcaatttgtgaaaccactgtttcatcaggtttcggcgccgtaccatacccgtacgcgagaaccgtgatgccggaaaacagaatcgccagcaaaatccccatcatcgcaagcgttcttgccgcgtttcgcgcaggcgggtttttgaatgcaggaatcgcattagaaatggcctcaaccccggtcaacgctgagcatccggaggaaaaagccttaagcagcaaaaatagcgtaatgccggctacaggtgtgccgagcgatgtatgatgggctggctggtctatttgtcctgtcataagtttaaacaacccgactgcaatgagaaccaaaagcgccaccacaaacagataaaccgggtaggcaagtatggatgctgattccgaaagcccgcgcaggttcaaaatcataatcactaacacgagaaaaatagcgatcggcacatgataatcatgcaatgcaggaaaggctgacgtgatggcatccgtgcctgcggaaatacttaccgctactgttaaaatataatcaacaagcaatgaaccgcccgcaatcaatcccggtttttcaccgagattttctttagaaacgatatacgccccgccgccctgcggataagcgtaaataatttgcctgtatgaaagaatcagtgcgagcagcaagatgagaacgccaaccgcaatcggaatggagtaccaaaatgcggctgcactgattgttgccaaaatgattagaatttgttctgtcccatatgcgacagatgacagcgcatctgaggaaagcatagccaaggcttttaatttcgtcagtttttgctctccagctgcttgggattttagtggtttcccaatcaaaaaacgtttgattgaatgatacatcgatgtcttccccttttaatttctcatttttcaattaaaacaataaaacatccatcagtgtcttgctctcacatgttgatgatagtcctttctgctatgatgtctctgtatgcgatttgcattcaaaaatgaacaacaaaaaacacagaggcaaacggatgcccctgtgccataacatcgaacacaggtttcattcatctcctctcacgaacgcttacgaggttagctgacggattcgggcatatgagagttagccctacctaaaaaggattcaccccaacggcaaaaagccgttctattgggtcccccgctctgatttcagattaagcgatttgttttctaaaagagatcatactcccgttcccgcacgttgtaaagaggcttattggctgagagaaaaaaataaaatgacaggttccacaaatggaatttacttaccaaaaataaaaaacagaggctaaaatcgcctctgttttattctgtatctgtctttctttttttgcgtcttacggcaatccaaatgaacactgccgcaaccaccataatgagtgccagcacaccaatatacatccatttctggctatgatcctgtgttggttgttctgcatcggaactgtttgtttccgatttgagctgctggtggtttgtaaacacctgctggctgtttgtttcattaaggacggttgccgactcatcgttgctgttcagataactgatgatctcttttgtgacagccgtgccatctccttttgacggtgcaaagacagccattgtatagcgtgaatcccaaaccgatgcttgggtaaataccacttgttttgtcgtctcattcagcatctcgaaactagatacatcaaacgagccgttcttttcctgcggcacaagcagatctgatgatttctccttcagaagagaaaattgattgatccctcctatgaaaatgaggtttcgtcctttcgcatcatttgctgtaacgtcagatgatttctttaccgtatatgaatgctgtgcttcgttgccaaaggattctgttacgagagaaagctcctctagcttcgattggcttacggtgtcaggaagcacgattaacgttgtttgatcctggtttccggcgtaaggcagcggccactcttgaaaatccgctgacggggacatgcctttgatggcgtatgataatgtactgtttttatcgataaaaacccacttttcttcatcagtggtgttacaagggttgttttcctttaaaccggtcgtgacgaactgaatatcaatgtagcggtttttttgcagcagcttagggtccactttcactgtgacatgatagaatccgtttttatcttcttttcctaattcatcaagccggaccgagtgcggctggccgttgatcatcactttcagttctgcagcctgagaggctgactcgttttcagccgttgaggcttgaatcgtttcagactttttcagtttaagcgacagcttcgccgattggttttcatctaaaacagccgaagccggataaaaataatgtgctgaagatgttttgtcggctccaattgtgatatcacccgctccaaaattctcaagggtcagcttatcgctttctttttttcagtctgctgaagcttgctgattgaaagtgtatcgccgctgagctggcctgtatatgtctgatctgtcatcacgctgattttttttgtgagcgcgtcctcggacgccgcttgcgcaaacagaaccggctgctgtttgccctctgctttcagcacccgctccgcaagcagaaggttttctccttttgcctgtagcccggcttgtttcaacagttttttcactttgccgttccaatgcttgtccacgccgataacaatcgtcggcttatcgatttttttcagttcagattccgtgacatacgcaatactgacactgctgtccaccgttttcaaatagccttctgttttaacagcagcttctatttctgctgaacttgggttatccggaatgacgatagctgtttcttccgctgtatttccagattgggcgaaaggatacggataatggtccagcgacgttcccttcgcttcactgctgtcagcaagtgtcagccggctgtccggataaattttgatccagttgcctgatgtatcctgtctgacgcacacgccctctttcattacgccgtagaatttcagcgatacgttgtgatagccttgcgcagactggcttttattcagattcagcttcactgttttccgtttggaatcaccatcaagctttaacgtcttgaccggttcatcatcaatgacaaccgttaacgatgatggagaaattaaaagatttgatgcctcgtattcgattaccaattgctgattgcccgaagaggcgcctgccgggatctgatacgtcagctctgcgctgtcttttgatccatacagtgtaatcagctcgcttgtcagcacctgctgtttggcttgttcttggctgcttttcccaaggagcgaaccgctgacctgtacgtctttggcaagagccgtttgtccagtcatcgccagcagcatgaagcttgtgagaaaaatcattatttgtttcaaaaaggtcacccgcttttatgttgattgtatcgttctgtcttgtaccatttgacctcttgcttgaataaacggtgcttgatttctacgaataaagagtagataacaagcacaatccatgcctgcgagtatgtgaagtacatgagaaatacgataaaaaagttttgcttgttcatttctgttttttcaatgctcaacgtaatcatgacctctgtcataaataagaaaaacgccaaaatccagagaatcattgccaaaaatccaacagacaaatgcaaatcataaaacaaattcactacaaaaatcgcatttgacatgatcacgccaaagaaaaacaggaagtacgtaaagaaaaaataaaacaaatcaaagataatccgttttcgtttcagcttaaaaaactgcgccaaaaatttgagcacgacatattgattgccgcgcgcccatcgggtgcgctggcgccaccataccttccatgtttccggttcctgctcccacgtgatggcggcagggaaaaagcggatgtgatagccgagattatatacccggatggtcagctcagtatcctcagcgagcgctttgtcatcccagcctccgagcttttcgataatgcttctgcggatcgcgaagttggtgcctgggatcgtggcgattttgaaccacttccatctgcctccctgggccatccactgaaaacagatcgtttcgatattaataaacctcgtcagcagcgtctttgccgcattgatgacgcggaatttccctaccacggcgcctgccttttcgtcattcatcaggccgagcacgaggtaatacacggccattttctcaggcgtgttgtcggcgtcatacacacagatcacatcgccgttcgattcggcaaaacccgagttaagtgcagaggattttccttttcctgcatttggcggcttcgtaatcaccattttgatgaaatcgtatttctcggaaaattcattgacgatatcacccgtccggtctgatgaattatcattaacgacgataatctccagccggtccttcggataataaaggttgaccatggccttcagcgtctgccgaatcacaacctcttcgttatgcgccgggatgaggacgctgaccttcggcagttccttcatattttctctccacttcgggatattccgttcgaaggtcatatagtggcgaaacccgccctgcatgaggaacatgtggtagagaagcataacccatattaaacttagcgagataaagaacagcgtattacccaaggcttcttctctccttaaaaattcgttttttcaatgtggctctcaagtaaaacgtataactgacaaacatgatgacaaataagagcacaacagcggagagaatccataacgccttttccagaggggtttgccggtgatgatcgaaaaactcgtaaatggggcttacgccgtttttcacctgaatcgttccgtcaccgcttgtatgaatttccactttgtctgttttgacggtttgtttcgttttctttaaatcaagccattcactgtctggaatgcgttccatctgatcaaccagctcaggcagatatttcatcccaaggtacgggtgataaaatcctccggctactccgccttcaaaatcaatcatctgggagatatgctcctccatctcaccgagcgggttttgcttcgatgtgtcgacaaagccgatcgtttccggataaagcgtcattccgtgcagcatcgaaggagcagtcacaaacggaggtgcaccggatgttttccatgttgtgctgctgagctggacctggccgaaaatgcttgtaaaatactgcgaggcgatttgatagccatattcggacatcgtgtaatgcggcgcttcaaacgccagcgggtaaagacccgatgatgtcaaatcctcaatggcacgcgtcagtttttgttttgtatacgtttcttccttttcccgaaatggttcaagatagctgtgataggcttgttcgttcgggaagtcctgttctttctccaaaatggacggggggtcttcggcatttccggatgtaatcggctgatccgcctttgcatcccaaaattcaaatccctctcctgtttcactgtagcgataagcgtgagtatagccgtgaactatgatactgccgcccatgctttgcagcttcttcagcaccttgaccatcttcggttgattagacaaatacactttgtcgcctgtttccggattcaagtaaaccggaatgaccgccaggataaaaggaatatgccgcttatgcaggtatgtaccggcttgaagcagcagtttttcatcagacatcgggctgatatcctcgagacgcaaatacaataacgtcgtccccgccttctctccgaaagcttctctgagctgtttcgccacgatcaaattgtcatttaacaaatttgttaatccaatgtacacattcccttttttgttttccatataaaagaatgcgttgtgccttcatccgctttgaaggtgtaaagcgccgttcctttcaggcctgatacactcagcacgttaagcccgctttccagagacacatcggccttttctgacctgctgtgaacctgaaacacattttctttgcgggctaatgaaagcccagaaaattggctgatttggcctgcgttatagccaatggcgacaaccggttttttcacgccgctgataagagacagcaatttttggctgagctttcttttcgtttggccgtaataaatcacatggtctttccctttgaaatccgacgcttcaacgtctgaatcttttttgactgtcacatgggatgtaaagtggcccgcaagcaaatcgagcattttgacttgtgacgactctttgccgtccaaggttgagtagatgatgagaatgccggcatcctgatctttcgcttgcgcagaaacgggaaaagacgcaatagctgaaaatagaagcatcatgacgcatagcaatgtgattcctttatagttcattcatcatcatctcgttttccagttcttctaaaaattgatcagctgtttggatatcgttgcggtagggcaaatagcaaacgtggaacgtaagcgacacatactttccattttccagctgatatgtatccaattgtttcttcagcttagtcagaacggccggcatatgttcagcaggcgtgtgcgtcagcacgatcccgatacgctcgtcagagggacggaatttcttatccgtttcccgaacgcttgtcctgatttgctgaccgacatattggaagaggcggtccgtttctttttcaccgtacaaagacttaaactctttgaaataatgcatatggagcagcaaaaacacaaaagaattgccgtagcgctccgcccgcttgatttcttctgaaagttccagcttcatcctttgcttgttatcaaaaccagtcactctgtcaacagcaacatagcttttaatttcggattgaagccgtgtcattgagcgccgaagctctgctgtaatatcgtggattcttccagaaataaaagaaaacagcaaaagcgcgattccccacacgacaagcattcgcagcccttcctcagccggaaagagcgatgtctgtccagtctggaaaaacatcattaaggtgccgagaacaaagagtacgattaaggtcactgccagcgcgtaaatcgggccgaaccagatgcctgcggcgatgacgccaaatgtgatgcaaaggatcagagcaccttctgattgctgggctgacacataataaataaacaaagacagggccgcgatgagccctgaaaaataagcaaataatttttgtgattcactgaatgatattttcattaaaaagcttcctttcggctaacagcggcagcagattgtcaaatgaatgcgtctgagtgccgctcatatagcctccataatacgatttcaccggatcatgaatttcaaagtcattcattctatcatatatggctttgatgacagaactgttttcatgctgttttgtcaaaaacaatacggctaaggcatatacggatggagactcatattggacggcaggctccttcgtatatgccgaataccgcccgtacagctttccgtttttctgaaattcctgcttgatccagtccgctaaaacagatgctttttcatccccttccggcaaatgccaagcagcgtaaagctgatcaatcaggttgatttcactatcatatgtgtattccttcgtctccgagctgtatgtcttcggcagaaagccattttttaaaggagctgaatagagaacattggcattccgctgttctgtttcttcgtctatgattccattcttctttaagacagctaaggcatcaggcatgacgtatgaaagcgtcacatcctttgaagcggcctgtgagtcgtaaaagtctgtaaaaaacccgttgttcatattgtatgtcttcaaagacgtgccgatatccctagccgtttgcgcgtagtcgctgcggccccattttgcggcggcttggtcaagagacagcataattctcatatcatctatcagcgcattcgtcccgctcgcttggccattttgaatcttccacgtcaccaagtgattgctcatcagaaatgaatcagtcagatgctgatattgatcctggaaatgtggtgcgtcatttttgctgagcagaaactccatccacagtccgagagattccgacaagtaagaaggctggtctgaaaaatcggttttgatcagccctttgtcattcattaaattgtgatagatgaaatattccgccggctggagcgggctggcattcacttctgtcgccgactgattttgggtcttgtttccagcttcagcacaccctgcggaaagtccgatagataagaagaataagatgacagcaattagtacatgcctcacaggcaaatccccctttgtcgcctgaagcaaatcagacgctcacaaatagttatagacgaaaatatgactgccatgttacaaagtacatttactataaaagaaaaaaatgcagattgctagcttttttttccctttttgaacattaagaaaacaggacctaagtccaataaaaaacctgtgcgataggcacaggtttttttattatttatccaaaccgagttttttcagctgttctgccagcgcgttgttaatcggctcatctttattttgttttttcatataagaggatacgtcccgtttggtagcacgcgctttgtctttgtttttcgtttttcaaatacagagagcttttcacggtgaccgcacacacacgcaaaggtttggccctcgccttggccgcgaagctccattcttttatggcaatttgggcagcgtgcgtttgtttttcgggcaatcgtttttctgcttccgcattcacgatcttggcacacgagcatcgtcccgcgtttgccgtttactttcagcatcattttgccgcattccggacatgccgttcccgtaatgttgtcatgtcggaaggtttggctgctgtttttgatttcttttaccgtttggtgagcgtaagccttcatatctttaataaaaacagccgatttcaatttgccggccgcgatcgcagacagcttttgctcccattctgctgttaaggccggtgatttcagatcctccggaacaagctgcaggagctgttttcctttagatgtgataaaaatatcttggccttttttctcgattaaaaagctgttgaacagtttttcaataatgtcggcacgcgttgccaccgtgccgaggccgcctgtttctccaagcgttttgacgaggcctttttcttctccctgcataaacgcgcttgggttttccatcgctgacagcaaggtcccttcattaaagcgggcaggcggcttcgtttggccgcttgtttccgttaacgtgcggacggcaagtgtgtcgcctttttgaagcgcaggaagtgtctgatctctgtcatcctcctgctcatcatcctcttccgccatatcataaacggctttccacccttgcgactgcacggttttgcctttcgccgtaaaggtttctccgccgatttctgcgatgacctttgtttcctcatattcgaatgcaggcattaatacagccaggaaacgtttcgcaatcaggtcatacagctttcgttctttatcactcagactgctgagaacgagcggctcttcggtcgggataatcgcgtggtggtctgacaccttcgcgtcattgacatatcctttatgagatttaatgccgcgttttttaatttggctgacatattgggcatacggttttacttccatgccttccagacggtcttttaacgtcgggacgatgtcactggataaaaatctagagtccgtccgcggatatgtgacgagcttatgctgctcatatagcttctgcaggacagaaagcgtttctttggcagaaaaaccgaagcgcttgtgggcgtcacgctggagctccgttaaatcataaagcgcaggcgcaaagctttttttcgctgtttttttcagctcagctacgaccgcttgctttccttggagattttttagcaaacggcttgttacatcttgattgaacgttctcgtctgctttgatttcttatcctgccacgtcagcgtcatgccgtcgactgcagcacgtatgccgtaatacggaacgggcgtaaacgcctgaatgtctgcctcgcgctttgcaatcatggcaagcgtcggagtctgcacacgcccgcatgagagctgggcattgaattttgtggtaagtgcacgggtggcgttgatccccacaatccaatccgcttccgctctggcgacggcagaatggtacaggttttcatattctttgccgctgcgcagcttttgaaaaccttccttgatcgctttatccgtcacagatgaaatccacagccgcttgattggttttcggacattcgctttctcaatgatccagcgcgcaacaagctcaccttcccggcctgcgtcagtcgcgatgacaatctgattgacgtctttacgggtaagctgggatttgactgcattgaactgctttccggtttttttatcaccacaagcttcaagggttctgggataatcggcagatcctctaggcgccatgattgaaattcttttccgtagccttccggatcagcaagcgtcaccaaatggcctaaagcccaagtcacaatatattgatcgccttcgagataaccgtttccttttttatggcacttcagtacccgggctaaatcccggccgactgaaggtttttcagctaatacaactgtttttgacatgcttgatcacttctctttctttcacgctcatcctgttattataacagacttcgcgcggcactctctaaccgcgcccgtttttcgtgtcaatttctgagaaaatgacgtgagtgacggtttgcgcgtagggcgatgttttgttaatgaaatcttctaccgcttcgaggctttcggcattgattttcagcatatagcaggctgcacccgcaatccggtagcaaaattcaatattcggcaatgtttgaatatagcttttgaaccgctcataatccgcgtttttaacggttgcttccacaatgcaggaaacgggaagccccagttttttctggtcgacctccagcgtgtattgcttgatgatgccaaacgattcaagctgtcttacccgttctgttacagatggaggcgacagcttaatttttctgcctaattccctcatcgacaaacggctgtccttcttcagctcctcaatgatattcagatcaatctggtcaagtttcatttcaacatccttcttttttgattttgtacacattatctcgggtatttttgtaaatgacaagtacagttccctagaaaaggcatgtaaaaatgaatgttttccgaacattttttgaaagctgtcatatgcccccccggattgtttatagtataaaatgaaaacgtgtccacaaggagggcgatttatgctgcacacgccgatcggaagacttcgcacgatgggttttattgaaggaatgtcactcttaatcctgttgttcatcgctatgccgcttaaatattgggcaggccttccgcttgcggtgacaattgtcggttcggttcacggcgggttgttcattttgtatttgcttgtcttggcttatgcaaccttctctgtcaaatggccgctgaaatggtcagctgccggcttcatcgccgctttcgtcccattcggaaattttttgtacgaccgcggattaaggaactataaataaggaagcgcaaaaaggctggatctttatgatccagcctttcttattaaaaccactttgtcagccacgcgatatagtaggccccgggaataaacatgagctgggcgaggagtgtgcccgccacccttgatgtgaccattgtgacagaggtccattttaaatagatatagcttcgttttccttttgccacatcatcagcaagaacggataccttaggatcaacaaaaatagccagcagcatcgttgcaattccgttgatcaaacccgaagccatgacggctgtcgtgctgcgctccggcgccaaaaggcctgcgtataaagccgaaagcacaccaatcgtataaatcgatgtgatcagcatgttgatgacaaacaaacgcttcggaatcaagcgcatatgaaatccttttacatatgaaatggacggcagacgcaaataggaaagggcatttttgaatccttgtttcgagaatccctttcggaatacttgaaaaacggagccgccgccgcccgccaagtgaataatcgcccgtgaaaaaagagcgacaaaagacgggagcaggataatgcccaaaatggtgccgactgtcgatccgaaaattaaaaagcggaactgctcccctacaatcgccagtgcgttttttccagcatcatcaattaaatgcccagtaaagggctgctgcaccatattcgacattctggatacgatgaccatgacattaaacagagaaagcgcggacgcaataaatccaacgcgagctccggaaagccttgtcgcataggctaaggtttctatcgagtgaatcagcaataaaaacaaaaataaaaagtacttgtgttgtaatgacatgcacgttattcttcctccaatttcatcctagagataagactggaaagaagacaaggaggtttcagtacgatgtgttttttgcaataaaaaaaccgtccggcgtacgccgggcggtttgtcttattcttttctatacgcaaataaagattatatcatccgccaagtcaggcgggttagattcataaagcattgttccgaagaatcattctggaaagtaaacaccatggaaatttcttgaacacaagacaacgaaagccctacctctcaatcgtcactgcggctccgaagccgcgccggtgtgaattgtaaaacaaaaaagtcttttttccatctcatcgttaggggcgatttgttatgaaggaaaagaataagggcagctggttatgctgcttgggaagcggtaagcttctctctcaaaacagaaaaaagaagtttactttctttttatttgcttatttttcttactagctattcataataacatatcgcccctgaaaacacaaattttttatagttcgagtgagaccggtgttttctccccggcattcattaatctgatatcctccggttcaatttcaagaatcaccagattcggatcatccttgccgtcaaaccagcgctctaatttggaactccatattttgtccttgagttctgccgaattgttgatctttgcttttccggcaacttcgacatatgcgtcgccaaaaccttcacaatcatagcctaataaaatgtggacattggggttgttctcaatttcttccgctttatgagtttccttgcttgtcggtgtgtaaatcgtcagcccgtcatggaaaaaagtcatgtagcgggaatgcggtttgcccttttgaactgttgcgagcgaacctactttatggtgatctagaacatcaagcactttttgtttaatgtcttgctgattcatctcgaatcactcctttttaacgtctccgctgttacttttccacatccggggaagatttaaacaagaaagtgtgctctttatttttcgccttcccattcacgctttaacagactgtagtagacgaggtcgtgatgcatgccgtttacgtataagccatcccgtgcctttccttcctctagaaacccgatccgctccggaaccgctctgcttttttcgtttccgacagccgcacagatcgccacacgattcagctcaagctcttcaaaagcatacgtaatgagttttcggcaggcagctgtaataatgcctttcccttcaaattctttggcaatccaatatccgatttccgccttacgattcacttgatcaaggttatgcaggctgatcatgccgcataggctgccgtcataaaggagacccgcctcaatgccgttcaggtcggcatactggcgccgccaatctggaatgattgtttctcggtacgtgtcagcgctgcttggattttccgcaaaaaacagccacttgccaagccgctgctgattttggataatgagttcggccagccgctccgcatccttcggctccaataatcggatggtgatgtgctcatttaccttgcaagtgaacattgcctcgccctctttccttttttacccattatagcgatgattctgtttttttcaatacaaaaaggatgggctgttaagcccatccttatattcttggatcggtaaagatatcatgtttatccgtgctcgtcgatgacatttccgtcacgacggcaccttcttccccggcctggaaccaatgctttgtgtttggtggaatcgtgtattgcccgcccggttctagctcaatttcgtgccagaccgtatagtgttctctgtcttcctgaggagggagaacttttggaagcggcgttttttctccttctacgtaaagatacacttttccgtagcggcagcggaaggtctcctgcttgccttcctggccgtcgaccggtggatggcggtgttccgggcaagtctgtcccggaaacagcaccaattcctttgaacaataacggtctgtattgacgtagacgaagagctggagcccgacttttctttcttttcctaagccgtaatccatcagctggatttggtctacttcctcgtccgttaatacaatccctgctttttgatagtagctgttcacttcttctttcgtgatgcccatatgtctcactccctcttatgtcgtcacaaagtttccgccgttgacatgcagggtctgacctgtcatgtaagaggactcatctgatgccagaagcacataacagccgacgtgctcaacaggctgtccaggacggcccatcggcgtatcttgcccaaattgagcaactgtttcttcagggaacgtagctgggattagtggcgtccaaattggacccggcgcgactgcatttacacggatgccgtctttgacaagcgcctgcgccattgttcttgtaaaggcattgatcgccccttttgtcgctgtataatcaatcagtgtcgggttccctacgtacgggttgatggatgtcgtattgatgatggcgctgcccggtttcaggtaatcaattgcttttttagtcaaataaaattgagaataaaaatttgttttgaatgtgcggtgaagctgttcgctcgtaatatctttgatgctttccttcgggtgctgttcacctgcattgttgacaaggatgtcaaggccgcctagttccttgaccgttttttcaaccgcttcattgcagaattcctcttcacctacgtcaccagcaatcagcaggcattttacgccttcttgttcaacacgtttcttcgtctcctcagcgtcttcatgctcatccttatacacaatggcgatgtctgcgccttcctttgcgtaagcgacggaaaccgcgcgtccgatcccgctgtcgccgcctgtaataagagctacttttccttttaatttgtctgctcctttataatcctcgtactcatacaccggacttggattcatttcgctttcaattcccggctggcgactttgagtttgtgccggcagttcttttggataatttgccatgatgattctcctcctttgttttcatgtctatttgttgtgtacctcacacactctttggataaacatggcttggcaccttcgcattgctttatcagaaaaatgtttcacatggaacgctgagaggaaattaactcaaaaagggggttggttgctgaatgattaacatgctttctagaagattcagcaggccaaagggcgtcatcggcatgattgccgggtacatcatggctgctgaaaatcaaacactgaatcagtggacaatcaatcagctgggtatcacgcgcggggacagcattttagaagtcgggtttggcccgggatactgcatgcagcagatgctgaaacgcgagaaggatgttcatcttcatgggattgatgtatcagaggccatgctgaagctggccgcccgcagagtgaaaccaaagggcgtacgcctgatacaaggaagcatcgagacatttcctctccccgcctcgttttatgataaagtgatttccgttaacaactacaccatttggaatgaccaaacaaaaggcataaaacagatttatcgggcattaaagccaggcggcaaagcagccattacgatgcagccgcgggaagcggatgccagtcctgagaaaaccaaatcatttggaagacagatgattgctgactttaaagcagccggcttcgaagacattgatatacaatttaagaacattaagcctgagctttccgtctgtgcaactgcaaagaagcccgccacataaagtggacgggcttcttcttttatgaatgtacagcctgattgcgcaggacgtcttttttcaccttgccaaggttgtttttcggcagttcgttaacaaattcaacttcaggtattttgtaagcggacaggcgttctttacaaaatgcgatgacatcctcttccgtgatgcgctggccgccatttttcacgataaaagctttcggtttttcaccgtaaagcgggtcaggaataccgaccacagccgtttcaaggattcccgggatctgctggataacttcttcaacctgatcaggatagacgttatcgcctccgtaaataatgacatccttgtagcgtcccgtgatgaaaataaagccatcttcatctacatatcctgaatctccggttctaaaccatccattttgcagcactttcgctgttgcttcaggattgtcttcatagcctttaaataagaatggagtatgaacaacgatttcgccgatttctccttgaggaagttcttctccggtcagaggatcttccactttgactttaacacctgccacaggttttcctgcagatgccgctttatccattcccatatcaggcgtccatgtgctgatgccccaagcctcagtacttccatagccatgcgcaagcggaatgccaatatcaagatagcggcttattaggctgctcggcacttttgttccgcctgtcattaaaataacaagcgaagataagtcagtttggtgcttttcccacgcctcaagcaaatacgtgtagaacacaggaagagccatcacggtctgaatcttctcttcttcaatgaccttcagcatgtgaacaggatcttgatcctttgtaaacacaaatgttgtttctgcaaacgttccaagcatgatgcaaatgagcgcactcgtatgataaatcggatggcacgcgagaaaacgaaggcccttcatacgtgctattgagctgttggattttttaacgtatctgtatatgccgccatgtgtaatcatgcatcttttcgggtttcccgttgttccagatgtaaacatcagaagtgctgtatcatcaggtgaaaccatttccgtctctggcaaatgatcaggacctgcaaacagcgcttcaaattcagcagatgtttcgtaagctgttcctgtttccattgttacacacagtgaggacaattcaggaagaacttcatccagtatctctttaaactccgctccgtaaaacatcgcttttggttcacttgcttttaaaatgcctgtcatttcatatggtttcagctgccagctgacaggtacgacaacagcacctatttcaagtgcggcgaacataacagttgaggcgggatggccgtttttgcaaagcaatgcaacacggtcgcccttttgaattcctttttgaagcatggcattcgccagctgattaatccgtttacggtaacctttatatgtcagtgtatggtctccgctttttacagcctctatttcttcgctattcggcatgtcatgcagaatcagatgctgtaatgtttccatatcgtcatctcctatattctcttgaatcttcaataatttgttagattttcttccttacctcacccattttaacccaaaaagataacttgtaaaactatttcattttggaattattccaatactgaatgataaaatagtcccacattttcttattttgttccccatccacagaaaaacacacgccaaatttttgacgtgtgccatgcaggtttacagtatgtttttttctttcatccatgtgaaaaatatgcggtttaaccgctgatacaattcttgtcctccttcttcctgaaaccccgccatgctttctccgctctcgataattgccgagctgatcgcgcttaaaatctccgagccttcagcagataatgagccaggcgccatcatgacgagaatgcgtgtcatcctgagggtatttccgtccatgccatccacttcatagggggtgctgagatcaaacattttgaaaaaaggcaggacgatttcatcatttttgagatgataaagcgccatgtttgttccggggattcccaatcccccttgtttctcccgctcagccaggcaaaccgcggctttttccggatcacggatcaggccatccttcttcagctgttgaaaaagctctagcagaagcatgctatggtccgggtttgttttgagttgagctagcgtaaaatggcgcagaacatcttggataacttccatataccgccctatgctttccgccgcctccagcatgtcaggtacatcagcttgctgcgcctcttccttcgagcttctttttttgttaagaataaggggaatcttccgcttgatatactgcttgacctggtttgcgtcttcctcatttaatagtgggctgaccatgatgtaatcaatgttttcataaggaatcggtacagtggacacaatcatatcataggcttgaacatccttcccctttagctcgatcagagatgacatatcaaacgattcaatttccggcagctcttttttcagtctggaggcaagcattttcgaggagccgatcccgcttgagcagacgacaagcgctttcacttttgcttcttcttttttgatttcaagagccgagccaaagtgaagaacgataaaagcgatttcatcatcagaaaaggacatgcccggaaaatacttttcgacaccttcttcgatcgccatataaagcagaaaataatcgcgcttgatctgttccttcatcggattgtatatctcaatattttcttttatgcggctgacggccggctccaaatgggcaatcaagccttcatataaagagtagtttttcgtcagatccattctgattttgtctgaaataaaagcaatgagccgctttgtttgcagggctgtttccagctcaatttcctgcgctttgtattctgttttgtattttcgattggcgcttcgaagatggattgtaatatagccgacctccgcctctggaatcgtcacgccgaaggcacgttcaagctcgcccgcgatttcaagagcggagctgtattccttcgcattcatcagttcctcaagctcattttgctccatggtgatagtttccccaagcttaattcgttcgatcgcatacgtcagatggacgacgagcgctatataggagctgtcggacaatgaaaaagcgattttttctttgagctgaaataagatgcgctccatttttaacagctcacctttgctgacaaccccgaacattttctctgaagaatcggtttttcctttgatgtttaattcaaccgcttccaaaaacatttggatgtcgagacggttcacaatcaagttgccgacaattttccgtttcgcattctccggccctatgagctggatgccaaaacctcttttgcggatcagtgtcagtccaaagggagaaatccacttctcgagctcatctaagtcatagctgaccgtggcattcgtcacctggagatcatgagcaagcgtgtacagtttgacgggctcctgagactctaataacgaacaaagaatgagcagtttccgttcgtcggcgctgtattcatgctgttcatatgataaatcagtaagcagcttttgtttaccctcgggacttcccactgctttcaaccctttaccgggctgtttatctaacgtaagccccacggtttccatcagcggtttaattgatttgagttccctgtgaatggttctcgtgctgacttgcatcagctcagcaagctcagttacggttatatatctgttttgtaataataagtgctttaacagcttttgttctctggcagtcatatacataaaaaagacctcctagccaatcttgatgtgcggatgaagtcgcaaggagatgcagtagaggatatagagaggtttccttttaatataaaacgctttcaagaaagaatcaatcacttataaatggtaatttggcactaagcggtgtgacaatattgaaaaagcatcagctggtaaactgatgctttttatggaatatcgtaaccctgtacggctgtaaaaatgcggaaccattgatcctggtcaagcttgtatgacaacgcatttatcgcggcggaaatccgctcgcgctttccgcttccgacaatcggcatgatgccggccggatgcgtatacagccatgcgtacatcacctcgtccaatgaagcggcgccgatttccccttggacggattcaagcgccgtacggacacgtcggtctttatccgtgttttcagtgaatactttgccgcctgccagaggcgaccaagccatcggcggaatccgtttttcctggcacaggttcaaagtgccgtcgagcatattttctaattcgtatgcggaaagctcaatctggttggttacgagcttctcaggcaaatatgattccagcatccgatactggtgatctttaaaatttgaaacgccaaagtacctgaccttgccagagcatttcaaggcctgaaacgcctctgctaccccctccggatccatgagcgggtccggtctgtgaatcaaaagcatatcgatataatccgtcctaaggttcataagcgattgctcaacggatgccaaaatatgcgatttgcttgtgttataatgatgcgatctgtgagcgggccgttcaggcgattcaagaacgataccgcattttgtgaccaactctatgttttctcttaatccaggcgaaagggcaagggcgtttccaaacagcttttcgcacgtatagcctccataaatatccgcatgatcaaaggtcgtgatgccgtgatcgatacaccattcaatgaggcttagaagttcagcatctgaatagttccattcattcagccgccaaagcccgtgtatgactcttgaaaattgaagatcctccgccaattgaatacgctgcatgcaaaatccctcttttctttgtataaaccgggttttgccccttactagttcattcggcctcagatcccctttttcctttcgctccttttaaaaagacattttaattcgattgaaattgctttttcgctttctcaacgacatagtggctgccgccgcggtcctgcacattttggatcatcatggcgacaagcaggtctttgttttcgtaatcgtagccgacaaaccagccattttccgtgccgtctttatcatcttttgatgttttcagctcggctgttcctgtttttccagccactgtgattcctttcacgacaggctgatacgctgatccgcgctcatcttccacaacgcctttcagaccttttgtaatgtctgccgctccttccttcgtgaccacttgcttgtgccaaacatcagctgtttgtgaatcttttttgatcagcgtcggtttgacaaggtctccattgtcaacaaatggcgtgtaagcagttgccaagtgaagcggagacatttgcatttgcccttgtccgtagcctgtatccgcaagcaaaatgtctgaatcaagcttgtcatttgcaatagacgatttctggatcgggaattcgtacggaacgtcctctgaaaaaccgaatgtcttcaagccttttgtaaaggtgtccgctcccatatcaagcgcattctgggcaaaataaatattgtctgacgtaataagggcgttttccaaatcgacttgttgaagtctctcagacacacgtgtcactgaatagccgccccagcttgaatctttttgccactccttgcctttgattgttttcttctcatcggctttaagggtgccgtttttgattccaatagcagccgcaatcggtttaatggtagaacctggcgcgtatgtcttattgaatttcgctgaaaacggattgtttttatctttgtttagctttttccattccttatcgctccagccgaaaataaatccgtttggatcgtaggaaggcgcgctgacaagggcgagtgtttcgcctgtcttcggctgcagcgcgactgccgccccgctgtcatccttcagttcatcatacagcttcatttgcgttttgatatcaattgtgaggtgaagatcctcgccgtcctttgctttcttttcagcgatgacttccccggtttgcggcacgtagattttccagccagttgtgcctcttagcttgtcttcatacacattttcaagtccggcgataccgatgttagacgtatcgctgtacgttccttctttctttttcttcagttcttccgctgtaatggcgcggacatagcctgtcaaatgggctgtcttttcgccatacggatagtagcgggagctgacattcgttcttgttacgccttgtaatgacgtcgcttcagaaactaatttctcctggtcaggcttgacctttttgagcggcacaaacgaatcgtcttttacccagccttgatccagctttttcttgatgtcgtcttcagtcaaatcaagttttttggcgagttcttttatgactttctcttttttatcgccaagctctccgggaacaattccaatttccggaacatctgtattgacggctaagccttttccatttttatcgtaaatttggcctcgtttcggttcaatgctcataatttgcacggttttgtcgtcagccagctgcttgaaaataaacgatgggtcccaatctatattccatgactcctcgtcatctgttttttctaatttcagcacagcagtattcttgaagctgactttgccggcatttgtgttcatgctgactttatacgggatatgtttcatcgtcttgttgtcttgatcgtccttatctacttctcccgcagtgactttcaaattttttacgccggcctgctcatagatggctttatacctgttgacgaaatcttttttggagatttcttttttgacatctttagtcaggctttgatacatgtcatcgaattgctgatcgttccactgtttcacgaatgcttccatgcgatcctctggtgaatctgttttggagcatccgattaacccaatcaatccgacgcatagaaatactagtagaatacacttttttaacatgactttcccctgccttccacttgttattttctcttaattgaattggtgcgtgcaagatttttttgaaaatgaaggaaaagttcaccgattttgcagaaatctcctatcgtttgctgtagactatttgaaaagacagaaagaagggatagcatggtcagagaggcagcaatgcttcacattaaagaaggccttgaacaagagtttgaggatgcattccggcaagctgcgccgattatttccggcatgaagggctatatcactcactcgttatcaaaatgcatggaggaaacgcataaatatctgcttcttgtggagtgggaaacacttgaggaccatacggaaggctttcgcggttcttcagagtatcaagagtggaaagccttgcttcatcggttctataccccgttcccgacggtcgagcattttcaggatgtgtaatagatttatataatatgaagtgtaaaaccgataagggagacagaccatacaaaaacggcggtataaatattaaaagcgcctgagccgtcattttcttttttgcgctcttcaagcccctgcataaacatgaccgcaccaagaaagacgagcatgaccgattggattacagaggtgtgttccgtatagttaaaagcaataagcgccagtataataatgataaccgcaaaagacattttaaaaatccgaaacaaaaggaccatccttccttatatacgaaatattgaacgttatggctatatttgcctacgccctccattattctagcgcactttgtttgtctgtagaacagaagacagagaattttaagtttcttttaatatttcgatcacacataaaaaacgcgcctgtcatgaggcgcgttttctatgaaactgataattctttatagcctagcttgtgaacggcttcagccatcgcttgatagcctttgctgttcggatggacaccgtcaaaggacagatattcctgttctttgcctttgaagatgctataggcatccgcgattttgacatggggtgctgatgcaagtgtttctaaatgtgaattaaacgaagtgatccatttgccggcgatatcaatttcgggaaacggattgtataagttgaacacacgaatggcgtacggggaaggattttctcctttaatctcggcgactttggcaatcatcttttcaaaattctcatggcaatgggcggatacacggctgaaaatcgtttcatccttagaggtttggtaggctaagaccgaatcgatgagatcgtttccgcaccctgtgatcgttatcatatcagcatctcgaatacatttttgcacatagggatatgacaggagtcccaaaatctcttctgtattcagacctgatctggcaaatatgtttattgccgttcttgttttcaagtcagcttccatcatgtccccaaaacgctggacgaagccgggtgaaaacagcccggagcctctccctgtcgtcaaggaatcgcccagagctgtatatcgaagcaccatgttctttcctccactcttgaacgtcgatacgttaatgtacgcagcagagaaaagattggctacttatgtatatcctatttttcttgaaatctgtaaagcggcgtccttcaccttttctgttaaatagggcagcctgtcttctgtaaatctcgcttcaaagcctgcaatgctaatgccggctgccacctggcgctcatggttaaagatcggggcgccgatcgccgccgtatagttttcgagctctgaatagctgacagtatagccattttgcacagaggcatcaatctcctgaagcagtttttcgggatcggtaatcgttccggagccaatcgaaatgagctcggtttgtttgatgtatgcttcgatttcttcacggggaagaaaggacagaatgcttctggcgcacgctcccgcgtataggggggaacgcctgccgatcgccgtatacagccgcacagtctgtgtcccttctattttctcaacgtatatcgcttcattgccgtccctcatgatcaactgcacggcctcatccacttcccggcacagctcttccatcaccggtttcgctatttttctgatatccagcctgtcagcgacaagctgtccgaattccaaaaacaccaatcccagcgaataagcgccggacgcatcccgactgaggaaccccatttcctccaaggagctgaccatccggtgaacagaggtcttcggcattcccgtcagcgacaccagttcacttaaggttaggcttggtttatgcaaaaacaaattaagcagcgccatagatttgactacggttttatttttattctgcatcattcatcccctttgctatgtcagccattccatcttcattctcgttttcagttcttttatatgctgttcccgttctaccgcaagcgcttctgcctcctggagggacacaggctcaaactgaacgtgctcgcccggcatgatttgggaaacaatcggaagatcagcggatatgatgtgcgcgatcctcggatagccgccagtcgtctgccggtctgcaagcaggataatcgggttgccgtcaggcggcacctgaactgttccgaatgaaaccgcttccgacaccatctcaagcggggccttcagttcgagcggttctcctttgagcctgtagcccatacggtcggactgcggcgtgacacgaaatgcttcttcataaaaacgcgtttttgattcttctgtgaaaaaggcaaattgctttccttccagcacccgaatgacgggattcttcttcaatggcagaaatctgccgcggctgactgaccacttcggtgctgcaaatccctgttttccaagctgcgaacttaagcgagaaaggatggtttgcgaaagagctgacatctctccaatgttcagttcatcttctttttgaagcgctctgccatgaagtccgccaatgcttcctctgacgtatgtgcttttactttccatgacggcaggcacctcaatgccgccagctgccgccaaataagcacggctgccgagtttgcaggggccaaagctgaccgtgctgttttccttgatgagcacaggcttccataaaggcgcttcctcgtcattaatacgcagcgtgaagtccgcccctgtcacagcaatcagtgtctgttttgaaaaatgaaacgacggaccgggccccatcatcgttatttcgagacctgcttcattttcgccgtttcctatcaacagattggcaatgcgcagtgaaaccgtgtccatagcgccgctggccagaacgccgtatttttggtaacccgttctgcctatatcctgaaccgttgtgagcagtccgggctttaatactttcatgctcaattggactcctccttataggcgtgatagtctttttctgagatgcgaacgaatttcacaatatctcccgcccgcagcaatgtcggcgggttttcctgcggccggaaaagagccagcggcgttttgccgatcagctgccagccgcccggcgttgaaatcggataaacgcctgtctgcaatcccgcaataccgaccgaacctgcgggaatcgacggtcttggcgatgattttctcggagctgcaatgcgttttgacatcccgcctagaaaaggaaaaccgggcgcgaagccaagcatatacaccacatattcaccgtttgtatgaatgtcgattacttcctccggtgacagttgattgatcttcgccacctcttctaaatccggaccgaattcaccgccatagcaaacgggaatttctacaatacggcggttgacctcatagtcttcggctatttctgccagccgctcttcgacatcgcgcttgacactctcaaaaggtgagcttatgccttgaggcaaatgcttgtacacttcatacatatcataaaatacggttagacttgtaaaagccgggatacattcaatgaatcccggaaatggctgttcttctatataagcggccgctgcatggacaatgccgttgacctgttcattgatttcttctccgaatcggatcatcattgcagaatcaccgagctgttcgatttgatatcgtacagtcatctttctcacctcttttaattctcgttcatcaggatgacgagaggctacagcaccgcaagcgactcgtctcgaatatctgtgatgagcatatgccccggcgcatgtgtgatgaccatttcaggctttacattcatagccacggcttgcggggtcactccgcatgcccaaaaaacaggaacctcgccgtcacgaatggaaacggcatctccgaaatccggtttcccgagatcgcgaatcccgattgctcccggattgccaatatggatcggccctccgtgcacagccggaaaacgcgaggtcacttgtgcagcacgtacagccagccgttcaggaaccggcctcatgctgacaaccatctgtccgtgaaacgcccccgccggaacacaatcgatattcgttttatacattgagacgtttgtcccctcatcaatatgccggacagctatcccattattgatcagtgcctgttcaaaggagaaactgcatccgatcagaaagccgacaaaatcgtcctcccagtatggcgtaatatcagatacttcttccgttaggataccgtgcctgtaaatacggtatttcggaaagtccgttctgatatcagcatccggcgcagccagagacggcacaggcgaacctgcttcagtcacatccagcacggggcagggcttttgatttcgctggcaaaacagcagaaaatcaaacgcaaggtcctttttcaaaaccacaagattcgcttgggcgtagccgccggacatgcctgcggtcggcccgtttattttcccctctcgtatcagggcgcgtacatcctttggcgccattttgtttaattgctccacttatatcagctccacaattgaggaagttgtgtacataacgtgtagattcccataactgccattacaatcactacaagcgcgcctgtgcttgtcagccaaagcggatgcttataatcaccgacaatgtttttcttgtaggcggcaacaagcagcgttccgagcgcaatcggcagaattaagccgttcagtgaaccgacaaggacgaggatcttcgcaggctggccgattgtgacaaaagctaacgtagaaaccacaataaatccgataataataccgcgtgaattcttttcaatttttggagaaaaggttttaaaaaatgaaacagatgtataggctgctccaataacagacgtaatcgccgcagaccacatgatcaatccgaaaattttataaccgacatttccagcagccagcttgaagacagaagccgccgggttgctttcatcgatgtgcaggcctttcgatacaacgcctagaaccgcaagaaaaagagcgatacgcatgacagatgtaattaaaatgccgacaaccgagctctttgtcacctgcggaatggattcctttcctttaattccggcatcaagcaaacggtgtcctccggcaaatgtgatataaccgccgacggttccgcccactagggtgacaatggcaaatatgctgatgtgttccgggacgaatgtatttgcgactgcctgtccgaccggaggagctgtcgtcgccgcaacgtagaccgttaaaataatcatcacgaaccccgcgatttgcgtaaaacggtccatcgcttttcctgcttccttgatgacaaaaatcaaaatggcgataacggcactgattaaagcgcctgtttcaggtgtaatgccgaacagcacctgaagtcccagcccggcccctccgatattcccaatattaaaagctagtccgccaagcacgacgagaatggcgatgaaataccccagtccgggaagcaccatattcgcaatttcctgacctcgttttccagaaactgcgatgatgcgccacacattggtttgggcgaaaatatctaaaataatagagattaagatgacaaaaccgaagcttgctgcgagtgtgtttgtgaatgttgcggtttgggtgaggaaacccggtccgattgctgatgtcgccattaaaaaggcggcgcccatcagcaatgaccagctgcccgctttttttcctgctgtctttttctgctgctccatctattgttcctcctttatgttgacctctgttctgaaatagctgtcacttcaattccagccgctttgagctgttttctgattttttgcgcaaatgtcagcgcatgggctccatctccatgaatgcagactgtatctgcttttaatgacacatcatgtccttgctgagatttgaccgccccttctttcaccattttgatgacctgggtgacggcggcatcatcactttcaatgagtgcgtccggctgggagcgcggtgtcagcgtgccgtccgattggtatgttctgtcggcgaacacttcatttgcggtctgaagtccgatccgttctcccgcttttacaagctcgctctcagcaagaccgaaaagaatcaggccgggatcaaccttatagacagctttcgcgatagcatccgacagtttttgatcgactgccgccatattgtataaagcgccatgcggcttgacgtgctgcatgtgaagtccctctgcttttagaaagccagagagcgcgccaatttgataaacgacaagatcatacgcttcctcaggagaaatcgccatattgcggcgcccaaaaccgagtaaatccggcaagcccggatgcgcacccattttcacgcctctttctgctgcaagcgcgacggtttttcgcataacactaggatctcctgcatgaaatccgcatgcgatattcgctgatgtcacatactctaaaatatcttggtcaaggcctatcttgtaggctccgaagctttctcctaaatcacagtttaaatcaatctgaaacacagaatccctcctgccaaagcaaacgatatgctttatgtcatttattgtcccgaaattcggaacgactattccgaatttttgaactttatttcattataagtgaatcatatcagtttgtgaaatacttttgtcagaaaacctaccatggtcccagaataaaacctgccaaactaaaaaagagagtccatcttaggactctctttttttatagtacccaatggcgaatcgctttagcgacaccatcctcaatatttgtatccgtgatataatcagccgtttcttttacgatgtcttgcgcattgcccattgcgacgccaagacccgcttctttgatcatcgcaatgtcattaaggctgtcgcccatcgccatcacattctccattgtaaagccgagtttttccgtaaccttggcaagggctgcagctttgttgatgccaagcgcgttgacttcaatgtttgtcggacttgaatttgtgatttcgagctctttgttttttctcagctcctcaagcacttcgtttcggatatcgtcatcctcgatgtcaaagccgaatttgagccattcatgatccgtaatgttttccggaaactcgcctctccatactttattcaccgtagaagcccagaaattagtgttgtgcttattccgcaaatcccacatcatttgaatatggtccgtatgaagcagcttccgttccaccaaattaaaattcgaatcccaaatttcactgccgtttgccgtgattagaaaggatgacagctttagcgattccgccagctccctgcacgtcatcagcgtccggcccgtgctgatcaccacatacacacctttatcctccgcttcacgaatggctttgcggttttcatccgagatcagctgctcgtcgttcagcagtgtaccatccatatcaattgcgatcagcttgatatctacatcttctctttgaacagacatatatgtacctctctttatctttttgttgtgcttctctctattctaatacattatacccagcgggacaaaaaagcgatttcctatgtttgaggagaatgaataagaggaaaacaaacggtgaggtgatcaaacatgacagaaaaaaacagcaaaacaaaccaaatgaaaaccccgagcacaacgacttaaccgatccgattcctaatgaagagctgaaggaaaatatgaatgatgaaaaacacaaacgccagcaaagagataactctcaaagcgaacgggattacgacacaaaatagaacccctcacaaaatgttgtgaagggtttttttcatttttcaatatagatgccgatttcagcttcagcaacaggctgctctccaactgatgccttggcatgtccgaacacaaacccgcgccgattgcgcgtgacttcaaacgtaagatcaagccggtcaccaggcacagcttctcccagcttttccgctttcttcaccgaagacaataatcccaagctgttctcatctgtaattcctgtaaaagccgcggtttgcgcaagcgcttcaatcacaagtgaaaacggcatttctgtttgcgtatcagtgataaaccagtcgttctcactaatcagcttataagctgccgcatgtttgccgggctcgctatccgtcacgccatcaataaacaaaaatggatagcggtgaggcaaagataatgagttcattttatatctcctttttttgaccattatatctcagcctaaagtgaaacgataggatataatggaaaaaacacaaaaggaggccgttatgttcccaaaaccgcttgtcattctcgcacacgaaatatatggtgtaaacagccatatgaaaaagatgggccggctgatcaaaatggctggatatgatgtgttgacgcccaacctgctcggcgaggatgaagtctacacactgaaagaagaaaaaacggcatacgaacaatttacaaaacacgaaaggctgaaaacgggagaaaccatcatccagaatgtgatcaggcaaaacgccggacggcacatctttgtgattggattcagcgtgggggctactatcgcatggaaatgcagcagtatgcctgaggtgagcggatcggtttgttattacggttcccggatacgcgactctcttcatcacatgccagcctgcccggtcctattgtttttccctaattatgagccgtcgtttgacgtagcgcttcttatcaaaaaactgcgggaaaaacagcatacccatcttgagatttaccaattcgatgcgcttcacggcttcgccaatcctgattctgtttatttcaacagggcccttttcttcaaaacgctttctatcataaaaaacggggcggaaagccggctccgcaccgtttcatcatcatttttttaaacgtgcacggcgctttattatcggtgccgtcatgttccatgttctttttgcattgcattttattttgcctgtctcatctcaccgaatggataaaagacgagagattcagtaccgatgatatcgtcctcagaaggcatgcccattccgtttctgctatccagtgaattgagacggttatctcccatcacaaaatatttaccggaaggaacctcaacttcgaagtcacctgttaaggttacacccgactctttgacctcctgtttatattcctttaagtatggttcttccacctttttatcatttatgtatagctgatcatttttcattttaatgctgtcaccaggcaaaccgattaaacgtttgacaaatgagcggccgctctttttgtcatgaatgactatgatgtctcctctgtgaaacccgccagtccatttgactgctttatcaaccagaattctttctgagtctttaagcgttggggccattgatgatccttcaataagaaaaggcttgtaaaacaccaatctgatcgtaaaaatgagagctgcgatcataatgatactgagtacaacgatcgttttgatttttcttttttctttaacgtgattgtttttgcattcaacttccttcacccgatgctttcctaagaattccaaattattatacagcatttggatctgcttggttagactttcgtggaaattttcgtaaggaaatggacaggccggggcagccatctgccaccggcctgattcatcagagctttcttaagcgcgaacagatttcatcagtgacctcagccgttgtgctttgtcccccaatgtcgcgtgttttgatgccgtcggcagtcacttgctccattacatccagaattttcgcccccaattcttcctctccgaagtggtcgagcatcagcttcgctgtccaaatctggccgatcggattggcaaggccctgtccggcaatgtcaggagctgagccgtgaaccggttcaaacatggacggatatttgccggatggattgatgttcgcagaaggcgcaatgccgatgcttcccatcaggcttgagctgatgtcggttaaaatatcaccgaacaagttgctcgccacaatgacatcaaacgtttccggacgcgtcacaaaaaaagcggccagcgcatcaatatgctgagatgatgtttcgattccgctataatcagcggctgtctgctgaaagacttcatcccaaaacggcatcgcgtgataaatgccgttagactttgtggcgcttgtcacatggctgcgccgttttttcgccaattcgaaggcaaagcgcatgacacgttctgtcgcttttctcgtaaacacggcattctggatggcgatttcatcatcgcctctgtgaatgcgcccgccaacttcactgtattcaccttcactgttctcgcgaatcaccacgaagtcaaaatcatttggatgcagaagcggcgacgtaatgcctgccatttgtttggcgggtctcatattaatggaaagctcaagctccctccggattttcagcagcagcccccataacgatatatgatcgggaaccagcttcggatttccgacagctcccaaaaaaactgcttcaaattgagtaagcgtatgtattccatcttcgggcatcattttgccgtgctccaagtaataatcacagctccatggaaaagctgtgaatgagaatgacaaacctccgtgtacctcagccgctgtatgaagcactttctcagcagccgctacaacctcttttcctactccgtctcccggtattgccgcaatctcaaattgtttcatcgtcattctccttcccctgttatcgtaagcgctttctattatactagattgcgagatagtaaaaaaagcccgtgacattgtgtcacgggtggtcggttattgattaagtttctttaaaatgatggcgtgcaacggttcatgggactgaatgccgcacacctcttgaagtacgccgctgtatcctttttcttcgatcagcgcttgcagttcaaccgcttcagggtcaccggtgaaatcgaagcgcagtgctgcggcaattccttcagccagtgcattcggttcttttattttctttgccgggcctacaagtctatcattttctcccagttttctgagaggtgacctcgctacgcgggtcacatcgtccgaaatgaaaggattttcaaagcgaccgatgatttttttgatatattgttcgtgttcagtttgcttaaagccatacgatttgacgagatagtcaccagtttcaagcagcgccgaatgaacaacacggcggatttccggatgatcaattgcttctttgaccgttttgagtccgcgctgatagccgacatacgctgtgaccgcgtgtccggtattgaccgtaaacagcttccgttcgatgtacggcgttaaatcatcaacaaacagtgcgccgtttatgactggtgttttccctttaaagcctgattcatcaatgacccattcgaaaaatggttcaaccgatactttcagcgggtcttcatgatgctgaatcgggacgatccggtcaacggcagaattcggaaaacctaccgtttcactgacggatttctgctctgcttccgttaaatggctgtatatttctttctttaagaagctgcttccgccaatcatattttcgcaggcaatgatattcagtgtgtttgcagtatttcttcgtcttaaaccttctgcgatagacggggcaatcagcttcagcacattcgggccgacagctgttgtgatgagcgccgcctcattcatcagccggtacagctcctcggtctgactgccgctgttaatagcgctcaccgggccaatgatctccgatgaacgtccctcttccgccagttccactgtgtattctttttttcattgaggaggctgaccatcgtttcgttcacatccgcaaacaccacatcatagccggagtggtgaagcagcgcgccgataaatcctctcccgatatttcccgcaccgaaatgtaaggcgatcatgtcagttcacctcgttgaaaatggcgatcaaatcttcttcgcttttagcggagatcaggcgttcaatgttttcttcttctgaacagataatggcgatgttagacaaaatgtctaaatgctcattatttttacccgcaatgccgaataccacttttgccgtgttgccttctccgtactcaacgccctctggaatctgtatgattgaaattcctgagtgaagcacctcgcttttcgcttcttctgtgccgtgtggaatggcaatgaaattccccataaacgtagaagacgtttcttcacgttcaaacattttgctaatgtaatcctctgtcacgtagccgttgtcaatcagcgtctggcctgccaatttgatagcctcttcttttgatgataccgtttgattgagtttaatgttttcctttgcgagtacttgcatgacaatcactctctttctataagattactttttcagcttttcaatcagctcgtcgtatttcgggctgtttaagaagttatccactgatatgtgcgtcgcgttcggcagctttgctttcgcgcggtctgttaaatctttgtgggtgatgacaatatccgcatcgcttggcagattgttaatggccgtgttggtcacactgatgtcaagctccgcttttttcactttgtttcttaagatggatgcccccatggcacttgatcccattcccgcatcacacgcaaagataattttgttcacgctttcaggagacagctcagacgcttcttctgctttggcttgttccgcctctaaagcagctgctgcttggcttttcttccccttcatggactgcattttttctgttgcggcagccaggtcttcttcactagctttagaggatttcaggatcactgctgaaacgatgaacgatacagctgcagcgaccaatacacccgccaatacgccgaaatagcctcctcttggcgtcattgccatcaatgcgataatgcttcccggtgacgctgccgcgacaagtccggcattaaagatcgtaaatgttaagagtccgcttgctccgccggcaatggctgcgagaatcagggccggtttcatcagaatgtacgggaagtaaatctcgtgaatccctccgaagaaatggatgatcgccgcaccgggagccgttgattttgaagatcctttgccaaagaacatgtaggccagcaaaatgccgagccccggtccagggtttgcttctactaaaaacagaattgattttcctgtttgagatgcttgctcgattccgatcgggcttaagattccatggtttatggcgttgttaaggaacaacactttcgccggttctacaaaaacactggctaccggcagtaaattagcgtgtacaatgacttccacaccagccgccagcaatttatttagcgtcaagacaaccgggccgatggcgtaaaacgcgagaatcgttaaagccgcgccgacaatccctgccgtaaagttgttgatcagcatttcaaagccttgcttgactttatccttgaataatttatcagtctgtttaatgaggtatccgccaagcggacccataatcattgcgcctaaaaacattggaatatccgatcctacaatcaccccaattgccgctgtcgctccgacaactccgccgcggtggtcgtagatcatttttccgcctgtatacgctatcaaaagcggcaataaatacgtaatcatcgggctgaccagcgtgttcagctgttcattcggaaaccatcctgccggaataaacagcgcggtaatgataccccacgcgataaacgcgccgatattcggcatgatcattccgctcaaataactcccaaagcgttgcactttcactttcatgccgccttgctgctgttcttgctgctgcatatataaaccctccctgttttgtttgtcgctgtaagatacaaaaatatgttcagagaatgatgcttccctttgactctatgttaaaacgcttacagtccctatacaattgaaagtaaagaggactttggcacatgactgtgacaattttttaaaaataaaaaggctcctggtttcaggagccttttctctttcctctataaatgatgttgccattttgaatcacgtactttgcaatcatccgctcactcacaataaaaacgggatacgcgcacacaagcgcaaatacagccatcggcacgtgctgtacagctggcagcactgagcctgccgcattgcggaggagcatcaaaagataaataagcagcacgatggccgctaatgataccagcataatcggagctgaaactttatattcataaagccgttcccggcagtggccgcagcgaaattgacaaggcacatttgatgatctgaccatatcgcctgtcaaaggtttgccgcagttcgggcatggtgtttctttcatagggtattcctcactttctattccatctgtctattataccagagtcccttctgtttcgttttgttgctgttcaacacattttcacattttttatcatccacttacttgtctccgtctctaaaatcctctacgcttaaatagatcttaatgaagagggtgtatgaatgcttccgattaatagacagcaacacatactgaagtggctgaaagaagaaggctcgcttagaatttctgacatcagcgcaaggttcggcgtttcggaaatgacggtatatagagatgtcaatcagctggttcagtcaaatcaggtcattaaaacggccggcggcatcacgctccccgtccgaacacctcaaacagatcatatgtgcagctattgcttgaagcccgtcaatcaagctcattcggttcagctgattacggtaaaccaagacattgaacagctatgctgcgcacattgcgcgtttttgcgttacgcggataaaacggaagaggtttcacacttgatttgcagagattttctgttacagacaaccgtcagtgccggttcggcttatttcgtcgtaaatgctgaattaaacctgcactgctgccagccgcaggccattccgtttgcgacacttgaccatgccgaacgatttcaaaaaggattcggcggagccgtctgcactttcgaccaagcgctggaagacatgcttcaagaccgaaagaaacgctgcacctgcaccaagaaataacacaacacatacagcggaaggtggtgtctgagtgatgaagcgaaacagatggtggatcatccttctgctttttcttgttttcctgccgaaaacaagctttgctcacgcctatattgtcaaatcttcacctggggaaaacagcgaattaaaaagcgcccctgcgcaggtggaaatcgaatttaatgaaccggttgaagaagggtttcattacattaaagtctataattcaaacggcgaccgtgtggatacggacaagactgaaatcaaaaaagataatcatcacatcatgacagtgaagctgaagaagaatctgcctaaagatgtgtacagagcggaatggaatgccgtatccgcggatggacatcctgtttccggcgtcattccgttcagtatcgggaaagcggatggcggattcagcagccaaaaagcagccgattcagcgctgaatccgggaacagcagcagatcgcgcgattctgtatacagccttatctctgtttatcggaacggttttcttccatcttttctggtataaagggaaatcagaacagctcgtcaaacggacgagacgtatcctgaccggctcgatcgcagcattggggctggcgcttttgcttcagcttccgattcagacaaaagcgaacgcaggcggcggctggggcagcgcattccagccgggctacatcagagaaacactgtttgagacagcaggcggctccatttggatcatacaggctgcgctgttcgtgctgctcgcactgtctgtcatccctgcgatacggaaaaaccgcttttcatcctttggctattggacagcgccgctcattttctttttcggtctcctgcttgccaaggcgtttaccgggcatgctgctgtcgttgaagaaaaaacggtcggcattttgatggatttccttcatttaacttccgcttccatctgggtcggcggaatagcggcactcgttttgctgctctcaaaagaatggaggcagcctgacaaaacgctcgcgtgggagacggtcagacggttctccccatgggcgctcactgcagtcggcgtcattttgttttcaggcttgctcaatggatttttcatcattcgttcaatggattcactgttccatacagcgtacggacaagctcttttagtgaaaagcgggctgtttgttttcatgctggtcttaggcgcaattcattttctgcttaccagaaagcagcgccgcacaggaatcagccgaacgttgaaagcggagtgggcaatcggcatcgctgtattgatcacagcggccgtgtttacaagcctgccaagcccgcctgagccagcgccggaaccgttctaccaaaccaaagcgatagagaacggacaaagcgtttctctcagcatcagcccaaaccagcctggaaaaaatgtttttgagctgcgggtcaccgaccataacggtgatcccgtgaaaaacatccagcaaatcacgttaaccgtttataaaacaggcctgtcaggcagcgaaaacaaaagcacctttacattaaaagaaaaacaaaaggcgtcttccaagatcaaaacctgtcgattaatgaaaaaggaaactggaagatcaaagtccacggcctgaccggcgactttaacgaaatcaatatcatgtttacaaagaccaattaaggagtgtttacgttgttgaaaaaaatcgcattgacactatgtccggctattgtcggctccctcttattctttacggcccctgccagcgcgcatgtttctgtaaaaccggctgagtctgctgcaggctcttgggaaacgtatacaatgaaggttccttctgagaaaaatctgccgacaacgaaggttgtcctcaaaatgccgaaggatgttgaattccagcaatatgagccaattccgggctggaaggtttccactcaaaaacatgatgacaaatcagtatccgtgacatgggaggcgactgacggaggcattcaggaaggccagttccagcagtttacctttgttgccaaaaaccctgacaaagcggaggaagctgcttgggacgcataccaatattacaaagacggcagcattgttgagtggacaggtgacgaggatgccgatacacctcattccattacaaacatcacgtctgcaaagcaagtgacagatgagcacggcgccacgaaaacagaagacgattccgaaaactcaggttcttcagctctagacattacagcgatggtgctgtctgcggctgccattattttatctgtagcagcacttgtaaagaaaaagcgtgcctaataaagaaagcgatccagatgtcatgtctgggtcgctttttatgtttaaccgcggcctgcctggaatgaaggatattgtgtcataccgccgtccgcgaataacgtgatgcctgtgacgtagctggcttccttcgaagcaagccaggctgctactgcggcgatctcctccggttcgccgatatatcccattggaatcatgctttctacatcagctttctgtttagggtcagcgaatttttcagcattgattggcgtgttgatcgcacctggcccaatattattgacgcgaatgcccttcggcgcgtattccaacgctaatgtttctgtcatcagctttatcccgcctttacttgccgcatagtggacaaataacggccaaggaatcacttcgtgcacactggacatgttaatgacatttcccttgatatcgttttctacgaaatatttaatcgcttcacggcttcctaaaaaggcacccgttaagttcgtgccgatgactttatcccaatccttgagcggcatttcgtgagatggcacaggattttcaagaccggcattattaatcataatatcgagtgtgccgaactccttaattgccgtttgcacgatattttttacatcttcctctttcgtgacatctccttggacgacaacagcttcaccgcccgccttgatgacctcttcttttacctcgttcggatcttgtttattactataatagttgataaccacttttgcctgctccttgccgaagcgaatggccatcgcctttccgagccctgaagcagctcctgtaatagcgacgacttttccttttaaatccggatacatatacatcctcctccatttgttatgaatttgttttggcgattcctaagaatacggcggcggcaataatcaggataatcccgatcgcaattgctattagctggcgtttcgttttcttttcacgcaggatgaaaataccgccgagcgtagaaatgacaattcccatttgtgaaagggaaaagctcgttgcaacgccgactcgcggctgagaaataaacaaaaacatatttccgcctgcccagattaaccctgggagaatatttctgatcgcatacttgttaaagggtttgtgtctataggttaaaactaaccccccgaccaccatgccaattgcctgtggcagcagcgcggaccagccggacacattgaataatctagccacgactacataaaccaaataaccaagagtcgaaacaaggagaatcaaaatgccctttttcaaattgcttggctcgccctcttttttatcattcttatcttccaaggacgtgagaatgattcccacaatgataaagatcaaagcgagaacgccaagcgtaatcgcaatcggtgttgaccattcgcggaacacgatcacaccgaacagcgaggtggaaacgagctgcattcctgtggaaatcggcattgttttcgacacgcccatcaattgaatgcttttcaactggttggcctgtccaagtgaccaaaataagccggatacgattccaacaataaaaatgcgaagggacagaacgggctgaacaaaaaagtaaataacgatagaaacaatgagtgccccgatcgtcgttcccagtgtctggctgtacggcccgccgcctaatttcacattgaagagaacaatgctcccccaaaacaaagccgggagaagagccaataataaatccattgttggggaaccttctttcaaaatgtatttgctgttattttggctggaattgttgtgattattcgccggaacacaaaaagagctgccggaaaatccggcagctctcaggagcgtgcattcttttataaaccgatggacaaatattttgtttcaaggtacggctcgataccttctgaaccgccttcacggccgatgccgctttctttcattccgccgaatggcgcttgaaccgctgacggtccgccgtcattccagccgataatgccatactctagattctcggaaatatagatgccgcggcggtagttttctgtgaagaagtaagcagccaagccatacggtgtatcgttggcaagctgaatcgcttcatcaatatcagaaaacgtgacgatcggggcgaccgggccgaatgtttcctcatgcatgatgttcatggacgtatcgacatcggtgagcactgtcggattcacaaagtagcaccctttgtcatcgtttcggtcatatgtgcccccagcaatcactttcgcgcctttttcaaccgcatcatctatttggctgacgattttttcgaagcctcgtttgttgataatcgggccgacattgacgccttcctcaagtccatttccgactttcagcttagacacttgctcgctcagtttcgcagcaaattcatctttaatggattcatgaacgatcaggcggttggcacatacgcaggtttggccggcgtttcggtatttggacgccatcgcctgttcaacggcaaggtcaatgtccgcatcttcatctacgatcagcggggcgtgtccgccgagctccattgagacgtgctttacggtgtcagcgctgtttttcataaggattttccctacaggtgttgagcctgtgaacgtgattttgcggattttcggactgcttgtgaacacatttccgatttcttctccatcgccgatcacaacctgaagaacatccttcggaatgcccgcttcatatgcgaggcgcgctagttcataagcagacagcggtgtgtccggcgccggcttgatgataaatgtacagccggcggcaagagcaggcgccgctttgcgtgtaatcatcgcattcgggaaattccagggcgtgatagcagcaacggggccgaccggctggcgtgtgacaacaattcgtttaccagttgtcggggccgggaccgttcttccgtacacacgcttcgcttcctctgcgaaccattcgatatagcctgcgccgtaaagtacctcgccgactgcttcctggtatggttttccgttttcctttgtaattaaatctgcaagctcttctttatgttcaacaatcagctcataccattttttcaaaagagacgttctttcgttcgctgatgttttagaccacgttttaaacgcttgatgtgaacgttcaatggcttcttctacctctgtggctgattgctgaggaatcgttttgatctcctcgcccgtagccgggttgtagaccgttaattgatctggcatattgaacattcctttcttttcatgattacttaaaatgatagcagacccggccattttctttccaatgattaagctcgcaggcccgcctccaagatgctgagcccttcatttaataggctgtctgagatgacgagcggtgtcaaaaagcggatgatattaccgttaattcccgctgtcagcaaaagtaatccgttttgattcgcataggccgcgatcgctgctgcttttgtcttatcaggctcacgcgtgtcaggatccttgacgatttcgattgcggccatcgccccgagtctgcggatgtcaccgatgaacgggaattcttgtttccactcatacgccttgtcttcaatgattttgccaatttcttcagatcgctcattcagtccttcttcttcgataatatccaagactgccaaagccgccgcgcagccgagcgggctgccggcatacgtgccgcccagctcccctggcgctgccgcatcaagcatttccgcacgcccgatcacaccgcttaatggcaggcctgccgcaagcgatttagaaaccgtgatcagatcgggcactacatcaaagtgctcaattgcgaaataagtgccagttctggcaaagccggtttggatttcatcagcaacaaaaacaatgccgtgttctttgcagaatgaagcgacgtgctgtacgaaccgtttcgaaggaataataaatccgccttctccctgcactggctccatcacgacacacgccaccgtttcaggcgccactgaagcgataaagaaatcattgaatgcttgaatgaccatatcgtcatagctttcatcactcatgccggccggcttctgataataataagggaacggcgcttgataaacctctggcgcaaaaggcccgaaaccgaatttataaggttttaccttgcttgtcatgctcatcgtcatattcgtgcgcccgtgaaacccgcgtgtaaacgagacaacgccttggcgctttgtatactttctggcgattttcacagcgttttcgaccgcttctgcccctgagttaagaaaaatcgcttttttctcatggctgcccggcgcgatgccgcacagtttttctgctaattcgatataagtcgggtacatcatgacattaaaaccaggatgaatcagctcctccgcctgccgcttcacagcctcaaccaccttcggatgcgagtgtccgacatttaacgtgccgatggcgcctgcaaaatcaataaatctccggccatccagatcgtacagctcggccccttctcctttgaccgccagactgcggttgccgttgctcacaccttttgacacaaattgatcccgtttttgctgccattgtgcagttgtgatgcttgctgttgtttgactcatgtgaatatccccctgtcggtattttcttatcattctgacttctctttggtatgatgaaaagtaccaattataactttttgatggtatcagaaggagaaactacaaaatggatatcacgattacactcgatcgttcagaacaagccgattatatctatcagcaaatttatcaaaagctgaaaaaagaaatcctcagccgcaatctgctgccgcactcgaaggttccctccaagcgggagctggctgaaaatctcaaggtcagcgtaaattcagtgaattcagcctatcagcagctgctggctgaggggtatttgtacgccattgaacgaaagggtttcttcgtggaggaactagacatgttttccgccgaggagcaccctccatttgcactgccggatgacctaaaagagattcacatcgaccagagcgattggatatcgttttcacacatgagttccgatacagaccattttccgatcaaaagctggttccgctgcgagcaaaaagcggcctcccgctcataccgcacgctcggcgatatgtcacatccgcaagggatatatgaagtgagagcggccattacgaggctcatttccctgacgaggggtgtaaaatgcaggccggaacaaatgatcataggggcaggcacacaggtgctcatgcagctgttgactgagcttttacccaaggaagccgtgtatgcgatggaggagcctggctacaggcgcatgtatcagcttttgaagaatgccggaaaacaagtaaagacgatcatgctggatgaaaaaggcatgtcgattgctgaaatcaccagacagcagccagatgtgctggtgaccaccccgtcgcatcagtttccgtccggaacgattatgcctgtatccagaagaattcagctgctgaactgggcagccgaggagccgcgccgatatatcattgaggacgattatgatagtgaattcacatatgatgtagacagtattccggcgctgcaaagcctcgaccgttttcaaaatgtcatctatatgggaaccttttcaaagtcccttctccccggcttacggatcagctatatggtgttgccgcctgagctgttgagggcatacaaacagcggggctatgatctgcagacttgctcatcactcacacagctcaccctgcaggaatttatcgagtctggtgaatatcagaagcatataaaaaaaatgaagcagcattataaagaaaagagagaacgcctgatcaccgctttagaagcagagttcagcggagaggttaccgtaaaaggggcaaatgcggggctgcattttgttaccgaatttgataccaggcgcaccgaacaagacatcctgtcacatgctgccgggctgcagcttgaaatattcggaatgagccgatttaacttgaaggaaaacaagcggcaaacgggcaggcctgctctcattatcggctttgcacggctgaaggaagaagatattcaggagggtgtgcagcggcttttcaaagcggtttacggacataaaaaaatccccgttacaggggattgattcaccagcggtcctggtctacattcagcacggcttcaagcagtcccggaaatgccttttcaaggtcttcagcgcgaagcgaataataccggcgctttccttctatccgaacttgagcgatgcctgattctctcaaaactttaaaatgatgcgacaaagtcgatttggcaacctgcacatctgcacaggtgctgcacgttttttcttttgcttcagctaattgcttgacgagctctaaacgaagcggatcactaagtgcatgaagaacctttgtcagctgcaatgtttctgtttctggatggtttggaatgttcatgacacaaatgtatcatacaacaattagaatgacaattttactatataagggtttttcctttacctcatttagaatacatgttacatttagttcgatgaaattcgaacaataaattcgcataacgacggaggagatttacatgatcgtattacaagcttacatcaaagtaaaaccagaaaaacgcgaggaatttttgagcgaggctcaatcacttgttcagcattcaagagctgaggaaggcaacgcgcaatacgacctattcgaaaaagtaggcgaagaaaatacatttgtcatgcttgaaaaatggaaagatgaagcggcaatgaaattccataacgaaactgcgcatttccaagggtttgtcgcaaaaggaaaagaactgctgagcgctcctcttgatgttgtccgcacagagcttagcgagtaaaggaagggtgtctcatatgaatgaagtgattaaatctttaacagaccaccgctcgattcgcagctacacagatgagcctgtagctcaggagcaattggaccaaatcattgaagcggtgcaatcagccccttcttctatcaacggacagcaagtgactgtgatcacagtccaggataaagagcgcaaaaagaaaatctccgagctggcaggcggccagccatggatcgatcaagctcctgttttcctgctgttctgcgcagattttaaccgggccaaaattgcgcttgaagatctgcatgatttcaaaatggaaatcacaaatggattggaatctgttcttgtcggcgcagtagacgctggtattgccctcggcacagcaacagcagcggctgagtcactcggacttggcacagttccgatcggtgcagttcgcggaaaccctcaagagctgatcgaactgcttgagcttccgaaatacgtgttccctttatccggccttgtcattgggcatcctgccgaccgttcagcgaaaaaaccgcgcttgccgcaggaagctgtcaatcatcaggaaacttatttgaatcaggatgagctgacgtctcacattcaggcatacgacgaacagatgtctgaatacatgaataaacggacaaacggaaaagaaacaagaaactggtcacagagcatcgcttcctactatgagcgcctgtactatccgcacatccgtgaaatgcttgaaaaacaaggatttaaagttgaaaaataagctcttattcggcctgtcggattttccggcaggcctttcatttacccggttaaaatccattgacttctattttgtttatctggtaaaattttttcattgttactcattggttttctgtgaaccaatgggttttctaatgttcaagaaagaaggaagccatgagatgcttgataaaaaaacagatatcttgttagccgcgcgaaagcttttttcggaaaaggattttacgtcggtttccatgcaggcgatcgcagaagaatgtaagatgtcaaaagcttcgatatataagctgttccaatctaaagaagatctgcttttggagctgctgtcatttaaccagaagcaaatggtggccgcggcctcaagacttcaggaaaatacagcacttacaccggaggagcgtttgacgcaaaaggtcaaaatggaactggagggcttcaggcggaatcagcagtttttcaatatgctgacctacggaaaccccaagctgcacaatgaccgggtcaaacagcatatccatcagaccagatcgacgattatctgctggcaccgcgattcgctgatccaggcgtatggagaaaccattctcccgtttgtgtgggatttggttatcattcttcacggcatgatgcgtgagtttttaatgctgatcaaaatcgaggaaaaaccgcttgagcttgacccgatcgcagagtttatcatcagcaccctcaatcagattatcaaaaacagggaaacccgccagtctcttcttccgcccgaagccatcgagctttatattcattcagcatcctcctacaagccaaaggataaatcagtcctattatcggaaagcctgaaggaattacataaaggcatctcttccctgtccgccgcggactatgacgtagatgaactgacatccgcagccgctatgctggaggaagaagcgaagaaggaagaaccccgcgcttttttactcaaatcactgattggctatctggaacaaaccggtgttttaacacagcccgtttccatgttaaaaacactgttaattacttagagaaaagaagggatatgtattgaacacaagtattgaacaaaaaccttttaaccgttctgtcattgtcggcattttgttagccggagcgtttgtggcgattttgaaccagacattgttgattactgcacttccccatatcatgagggatttcaatgtcgatgccaaccaagcacaatggctgacaacatcatttatgttaaccaacgggattttaattccgattaccgcgtttttaattgagaaattcacaagccgggcgctgctcatcacagcaatgagcattttcactgccggaacagtcgtcggagcgttcgcgccgaacttcccggttctgctgacagcgcgtatcattcaagcggctggagccggcattatgatgccgctcatgcagactgtattcctgacaatctttccgattgaaaagcgcggccaggctatgggtatggtcggattggtcatctcattcgcgcctgcgatcggaccgactctttccggatgggctgtcgaagctttctcttggagatcattgttttatattattcttccgtttgctgtgattgatttgattcttgccagcatcctgatgaaaaacgtgacgactttaagaaaaacacagattgatattttatcagtcatcctttcaacatttgggttcggcggccttctgtacggcttctcaagcgtcggctcttatggctggtccagttcaaccgtcttgatttcactgctggtgggtgtcatcgcgctgctcttgtttatcacaagacaaatgaagcttaaaaaaccgatgctggaattccgcgtcttcacgtttggcgttttcagcttaacaacactgctgggaaccctcgtctttgcattattgatcggtacggaaaccatcctgccgctttatacacaaaatgtcagagacgtcacagcttttgatacagggcttatgctcctgccgggagccgttgtgatgggctttatgtcgccgattatcggcagaatttttgaccgtgtcggcggaagagggctggcgattgccggtttctgcatcatcttcctgacatctctgccgtttatgcagctgactgaccatacgtcactcgcttggattgtcgttttatacaccgttcgtctcttaggcaccgccatgatcatgatgccggtgacaacagccggaatcaatgcgctgccgcgccacttgattccgcacggaactgcgatgaacaacacgattcgccaagtcggcggctcgatcggaaccgcactattggtttccgtgatgagcaaccaggcggcacatgcaggcacgacaaatgtgaagcacgccgccctgcacggcatgaacgccgcttttatagtggctgccgtcattgcacttgtcggcttccttctctcattcacattaaagaaacctcagcgccctgccgaacagcagccggcacgctgattaacaaaaaaagagccccgctatttagcggaggctctttttggttttacttttctaaaccgtctttcacttctttaatcatttgcgtcatagactcaagtccgcctcctgataaataccaagtagcagaatcaaggtagatgacatgaccatttttcactgcgtttacgtttttcacataatcgttttccacgacttgttttgtagatgatgtttctccgattgctgtaccgcggtcaataacaaacaagtaatcagggtttgtttttgaaatgtactcgtaagaaacactttgtccgtgcgtagacgctttgatgttttgatcagccggagccacgccgaatacgtcatggatcaggccgtatcttgatttagggccgaacgcgctgatttttccatcgttcgccatgatgacgagaccgtttttgttaagcttttcagcggttttctttacatctgcgattgagtgatcaatgtttgcgagctcatctttcactttgtcttctttatcaaagattttaccgattgtttcagcgtctgatttaaatgattccatgtacttcgctgtatctacaccaaggtaaatcgtcggcgcaattttagagaattctttgtaagactcagattgtcttgctgaaataatgatcagatcaggatctaattctgccactttgtcgaagtctggctcttttaagctgccgacatcagcgtatttgtcatccttgaatttggacagatatttaggaaggacttgtttcggcaggcccgctactatatcatcaagtcctagtttatctaatgtatctaagcttccaaagtcaaatacgacaacttttttagggttcttcggtacttttgtgccgtttttgtcgagctggtgtttcactgtgatttgttctttctttgtatcagaacctttgctgcttgtgctttggtttccgcatgcagaaatgacaacggcagtgaccaaagcgatgaatagtaacgcgaactttttcatgctcctcacctcttctatatattaagaaaaataaacacctattctttgattatcaatcgtctgaatcgggatggtcatatcgtagatttcctcaagcactgatgtttctatcatttcttcaggcggtccttctttaacgattcggccgtttttcaaagcgacgatatagtcagaatagactgaagcaaaattgatatcgtgaatgacgatcacgatcgtttttccaagctcctctaccagccgtttcagcagtttcataatttcaactgagtgtttcatatccagattgttcagcggttcatccagaaagatataatctgtgtcctgggcaatgaccatggcgataaatgccctttggcactgtccgccgctcagctgatccaagtatttgtcttgaatgtcttccagcttcatatagctaagcgcctggttgatatgaacccagtcttcctctgtcagccggccctgtgagtacggaaacctgccaaaactgacgaggtctttgatcgtgagcctgatattgatttggttcgcctgcttcaaaatgctcattttcttggcaagctctttgctgtcacatgctccaatctcttgtccgtctatgtaaatctcgccggaatcctttttgatcaggcggctcatgatagacagcagcgtacttttgccggcgccgttaggaccgataaacgaggtgattttgcccttttgaatcgtgactgacgtctcttcaagaacaactttcccgccatattgtttgcttacatttctgacctctaccatgatttattctcctttaacagcaagtagataaaataaatcccgccggcaaaattaataatgacgctcagcgtcgttgagaaggtaaacactttctcaaccacaaactgccctccgaccagcgcaatgatgctgatgaaaacggagcctgcgattaagtatgaatgcttatatgttttcaggaattctctcgccaggttgacgaccagaaggcctaaaaacataatcggcccgactagcgctgttgaaacagaaaccaaaatcgcaaccacgatcagcatctgcttcaccactttgtcgtagtcaatgcccaaattcacggcgtgctcgcgtccgagcgacagcacatcgaaaaattttgtaaaacgccagacataaacgcctgtcagcaggaagatgatgaacgcgagccataacaaatccgtattgatattgttaaagctggcaaacatcttgtcctgcacaacttggaactcgttcggatcaatcagcatctgcataaaagaagacaggctgctgaacagcgtgccaaacacgattccgataagcagaaggaaaaagatatttctcccctcacccttgaacatgatctgatacaaaacaagagaaaacaggatcatcagcagaacagagatgataaagttgatgtttttattcatgatgaccatattcgcagaaccgaacaaaaagataatgccagtctgaatcagcatgtagagagaatcaaggcccaaaatgctcggcgtcaggatgcggttgttcgtaatcgtttgaaagatcatggtcgaaaacgcaatcgctcccccagtcagcacaatggcagcgacttttttgattcgtctcggcagggtgtaatcccaattgcctaagtcataaaacaaaaacaagccaatacatacaatggctaaaccaacgagcaaagctattttcatctggttacgcataggcttttctccttaacagcataaacaggaaaatgccgctgccgatgattccgaccatcaggccaatcgagatttcataagggaagataatgattctgcccagtatatcgcaaaacagcacaaaaaccgctcccaacagcacagtatgcggcaggctgctcttcagattgtctcctctgtaaatcgatacaatattcgggatgattaaaccgagaaacggcagcataccgacagtcaaaatgacaagagacgtgatcagggacacgataatgagcccgatgttcacaacccgtttatacttgaggccgaggttgacagaaaagctttcacccataccggccaatgtgaatttatccgcatacacataggcaatgatgacgagcggaatactcagataaagaagctcgtatcttcctttcacgactaaagagaagtctccctgcagccatgatgacacattctggatcaagtcatatttatatgcgataaatgtcgcgattgaactgacgatattcccgagcattaaaccgacaagcggaataaagatggtgtcgttaaacttgattctttcaaggattttcataaacagaaaatttcctgcaagggcaaagacaaacgcgaccagcattttgattaaaggactggcggatgtaaacagcagcaaggaaattaaaatgccgagcctcgcccaatccatcgtgcccgccgtcgtcggtgacacgaatttatttctgctgatctgctgcataatcaaaccgcagatgctcatgcttaatcccgcaatgacaatgctgatcaatcgcggcaaacggcttgcaaacagcgttgacgcctcttgtttgcttaaatcgaagagatcaagcggcgacagatcttctacaccgataaatacagatgtgactgctaatatgataagtagaataaataagtaacgtagcttcatgctgcctccttacatccttacagcaaaaagaacgtatctcctactccgcaaggactcaaaacaatatggccatatagtaattgattatcattatcatttacatattaccatttttatagggttagtcaatattctttaaaaatattaacctagtcatttatcaattttactaatcattctaaccattttccatcccaaaacgttaggctgtttaccatatttatctttataacgcaggcatacggtcagcaaacctaacattattcctcgtgaaaaatacaaatgttctcctgagaaagaaattcccccttgatttacagtactgaaagagagataataaatactaaatttgtgtgaaaattttaaacattaggagatgtaaacatgaaggtcgttaaattcggaggcagctcacttgcttcaggcgcccagcttgacaaggtgtttcacatcgttacctcagatccggcacggaaagctgtagtcgtttcagctccgggaaaacgctatgccgaggatacgaaagtgactgatctcttaatcgcatgtgcagaacaatatttggcaacaggcagcgcacctgaactggcggaagctgttgtggaacggtacgctctcatcgccaatgagcttcagctggggcaaagcattatcgaaaaaatcagagatgatctgtttacgcttttagaaggagacaaaagcaatcccgaacaataccttgacgcagtcaaggccagcggagaggataacaatgccaaactgatcgccgcttacttccgttataaaggcgtcaaagcggaatatgtaaacccgaaggatgccggcctctttgtgacaaatgaacccggcaacgcgcaagttcttcctgaatcctatcaaaacctctatcgtcttcgggaacgtgacggactcatcatttttcccggttttttcggattcagcaaggatggcgatgtgatcacattctcacggagcggttctgatattaccggttcgattcttgccaacggactacaagccgatttgtacgaaaactttacagacgtagacgctgtgtattctgtcaatccgtccttcgttgagaatccaaaggaaatcagcgagctgacatatagagagatgcgggagctgtcctacgcgggtttttcagtgtttcatgatgaagcgctcattccggcattcagagcggggattcctgttcagatcaaaaatacgaacaacccctcagccgaaggcacccgcgtcgtcagcaagcgggataacacaaacgggcctgtcgtcggcattgccagcgacaccggtttttgcagcatttatatcagcaagtatctcatgaacagagaaatcggttttggccgcagagcccttcaaatcctggaggagcatggtttgacgtatgagcatgttccatcgggaatcgatgacatgacaatcattttacggcaggggcaaatggatgccgccactgaacgcagcgtcatcaaacggatcgaagaggatttgcatgccgatgaagtcatcgtcgagcatcatctcgccctgattatggttgtaggggaagcgatgcgccacaatgtcggtacaacggcaagagccgccaaagcattatcagaggcacaggtgaatatcgaaatgatcaatcaggggtcttctgaagtgagcatgatgtttggcgtaaaagaagccgaagaaagaaaagccgttcaagcgttataccaggaatttttcgcgggcgtgctgatctcttaatcgtacataaatagcgggcggcagcgcccgctatttttttatatcaccttcatatagccgaattcttcattttttctcttgtccactattatccctgccaaatggatcggttcagcatatcttatagtatccttcatagggaggtgaaaccttatgtcaggatactctaacggcggcggttacggcggcatcagttctttcgctttaatcgttgtattgtttattctattaattatcgtagggactgcgtttgttggcggcttctaagctgctgaccgtctctgcgggaccctgtccgccacagttttgcagcatttgctgaagcaatctcgcaaggaggtgcacaaaatgtcaggttacggaacttctttcgctttgattgttgtgttatttatcctcttgatcattgtgggaactgcatttgtaggaggctactaaataaacgtaatctccatgaaggcggcaccgcaagactatgtcttgcggtgtttttttgaaaagaaaaaccccttctcgctaatgagaaggggcttgttcttacgtcattcctctttctgtcacatgaaagtcgagtgcttccgcattagcagaaacgccagccgctgtaaaaatcgcggctgcggccaaacaaataacaaacaacttagatttcaatttcatacaaaccttcactcctttgtatttgttttcttgcctcttcaacttgtagaaagtaggaagcagacagtttaaaccatttctgttcatagtaatattttgctacttctagggctaaatcctctatatcagcgtacatatttttattttttaagtactggaaacatcgttcgattccttcttcattgggctgatccagatatagggattgcaaaaactcgaattttacggcatagtctgcatcgtctgtttctttagcatattcatagccccgcttgtgatattccgaagctttatcatgttttccctgtttataataaatcagggtgattaaaaaataggcttgcgggagagaattgacgatcctgctgctttcaaatgtggagaccgctttttcaaagtaatcaatggcagggtctagaaggtcttgattgtaatagcataacccgagattgtagtatgctcttccaaccagctgggctttttgttctgcttgggccatgttgagcgccaatttgaaatggcgtgcggcttgttcgaaatttctttcatccatcaggttgaccccgaagacgaaatggcactgaatgattctcacattataggtttcctgctccacgtaaatttcataggcgttttttatattaatcaatgaaaaatacgtttgcttcatataataataagcttccgcgattttaaaatagaattcagcccgttcaatatggtctgcgacaaaggagagctttttctccgcctgtttatagtatgtaatggcagaaataaattcccgcttatcaaattcatacatcccgcgaaaaaaattcacgtaatagtcgagcagccctttgagatctgcctggttgctgtcaatgtttcttgataattcagacaggcttggctggtcttcgatatttaatttctctaacggctcaagataatccagcataagctggtgccggaattccattagtgaataataaagcagcaagttggaatcatgctgcatgtgtttcagttcctgctggatttcagcttttaacacttcggcatccggcacgctgaatgtccggatatatctgtaccactcgttaattttttgaccgaccgctgaagaaggaattaccccactcttcattccttcaccctctcccatcaaaaactgtttatgtcatattttatcatgtttataggccgtcccaacccgaaaaacacgcaatctttgttttcgggagcacgcaataaaccgaagcggtgtgcaaaaaaggcggatgcatcagttgatgcgccgccctgtatgctattgctgttttgccgttaaaggaaggcggatgatgaactttgtgcctttcccttcttcactcttgatttctactgtgccctggtgcatttcaacgagctgcctgacgatcgagagaccgagtccgtattcaccgtatgctgtgttcgttcttgaaatatctgctttatagaatcgctcccaaatatgctcaatatcctcttttggaatgccgatacccgtgtcttcaatttcaataatcgtctctttataaccttccattccgcgcagccaaatgtcaccgttttgcgtaaattggatgctgtttttcgtaatgttgacgagaatttgaatgaaccggtcataatcggcatgtacgatgacgtgatcctctacttggatcatcagcttgttttgtttttcttccgcctgctgctgcaagtgctctttcacgatttcaaacacctcgatcagaggaacgtctagcttgttcaaggtaatttgctgggatctgattttttcataatccagattttcttttacgagccgcagcatgcgcttcgtttcctcactgatcagcgagaagcatttatcctttttatcctcaggaatcgtatggctgttcaacccttcaaccaaaccgttgatcgtcgtcagcggtgtttttaattcatgtgacacgtcagcgataaactgccttctccgcttctcaaggcgctcgatttcatcccttgactgctttagttttttcgccatgatattaaagtcagacgccagtacgccgatttcgtccccgtagctgttttccaaatggatgtcataatcgccggaagccactttatctgtcgcttctctcagcttttgaatccgcttgacatggaatttggacagaagccagctcacaagaatcgtaatcacaagcgtgctgatcacagcgtaaaacatatagaggttgacctgattgaccatctgttcaacaccgctgatcggagaaatcagcagaacggcgcctttaaattcgttctgaacaaatataggctgcgccacaagggacacttcatcatcaaaacggccatctgccctgatcgtgacagtctgcccttttttcagcttattccattctgatttcttcagctgttcccttggtgggtgatgaaagccttcaggaagaaaataaggctgctgctcttcattaaagatgataaattgcgtctttcttgtgcttaaaatgtcctgataaggatagagcctgcgcatgtccacctggccggattggaattcatttgcaatctgcaccgcatatgacgtcaattcctctactttgttctgataggcaaattccttcacaaagtgggaaaacagagaaatgataatgacaaacgctaaaatcaaaatgctgatatggcttagcagcagctgatataaatatttaatcttcatcaaatttataccctactccccacacagtatacaggaaaggcttgtcctcgctggcaagctttttccgcagccgtttgatatgaacgtcaaccgttcgctcatctccataaaattgatagccccatacctgctcaagcagctgttctctggagaacacctgccgcggattttggacaaggtaataaagcagatcgaattccttcggcgtgagattttctacaggctctccgtttaataatacttctctcgtcttcttattaatggtaaagcattccgtttcaatcatatcttcatcaataaccgctttgcctgtcgccttatatcttctgatgacggctttgatgcgggcaaccaatgtcagcgggctgaacggctttgtgacataatcgtccgcccccatctcaaaaccgatgacctgatctgattcagtgtctttggcagtcagcatgataatcggcaccgtgcttgtctctcttatttttctgcagatggtcacgccgtccatagatggaagcatgatatccaaaatgattagatcccaattttcttccgtaaaacgctggtacccttctaacccgtcatgaacgaattcggcttcaaaaccttctttaaaaaagaacatctccgtcatcgtacatacactaacattatcttctatcattaatattttcattatatcctccggttgttttgatgcttttttatataatagcaccattttaaacagaaggttttgcgtttcacaattgttagtttttatttcatcaactagaaatagattgttcatatttttttcatacctttggactactattaatttatcagcaaggggacgcgccccagaggcggtcttatcaataaaaatacctatacggaggaacataaatgaactttatcaaacgggccttttggaatatgaaggctaaaaagggaaaaacgttattgcaattatttgtgtttacagtcatatgtgtctttgttctatcaggcctcgccatccagtcggcagcacaaaagtcaagcgaactggccagacaggaactcggtggaagcgtgacacttcaggttgaccgccaaaagcaaatggaaaaacagcaggacagcggtgaaaagcgcagcttcgaatccacaccgatcaaagtgtctgatgcgaataagcttgcagcgcttgatcatgtgaagagctacaattacaccacatcagcttcagccaacgcgggaaactttgatgcgattgaaagctctagttcaagtgattccagctccagcagttcaagctcaaacgctaaaaacagtcaaggcggaggacaaggcggaccgcaaatggttcaagctgatctttctattgaaggtgtcatcagcacagcgttagtcgatgatttctctgacggagattcaaaaatcacagacggacgcgcgattacaaaatcagatgtcggcaaaaaagtaacagtgatcaacgaaacattagcggaagaaaatgatttaagcgttggcgattcgatcacaattgaatcagcaacggatgaggatacaacagtaaaactgaagatcgtcggtatttataaaacaacatcttcaggtgatgaccaagcccaaaatttctctttcttaaatccttataacaagctttatacgccttacacagcaacagcggcattgaaaggcgacgactataaaaatacgattgactcagctgtttactatatggacgacgcgaaaaatatggatactttcgtaaaagcagcgaagaaaacatcaattgactttgatacgtacacactgaatacaaacgatcagctttaccagcaaatggtcggaccgattgaaaatgtggcttctttctctaaaaacgtggtgtatcttgtatcagtggcaggcgccgtcattcttggcctgattgtcatgatgtcaatcagggagcgcaaatacgaaatgggcgtgttaatggccatcggtgaaaaacgatggaaattgattggacagttcttgactgagattctgattgtggccgttatcgctatcggccttgcatctgtgacgggaaatctcgtcgcgaatcagcttggaaatcagcttttatcccagcaaatcagttcatcaaccgattcaacgcaaaccgcaagcggacaaatgcccggcggcggtggcggcatgggcggcaaaatgttcggccacagttcatccaacgtggacgttatcgattcactgaacgtcgcggtttctatgaacgacatgcttatacttggcgggatcggcatcctaatcgcaatcattgcaacattgctgccgtcaatttcagtactgcggcttcatccgaaaacgatattgacaaaacaggaatagaaagaggcggaacctatgagcttattacaatttcaacaagtcggctactggtataaaaacaaaagccagccattgtttcaggatattaacatcagctttcaaaaaggaaaattctacacaatcgtcggaacatcagggacggggaaaaccactttcctgtctctggcaggcggacttgacgcaccaaaagaaggaaacatcctttacgacggaaaagcggtttctaaaatcggcttaaccaatttcagaaatcaatatgtatcaatcgtctttcaggcgtacaacctgctcccgtatatgacggctttgcagaacgtcacaaccgctatggaaatcacaggttctaaagaaaagaacaaagaatcatatgcgcttgacatgctgcagaaggttggcatcaacgaaaaacaagcccggcaaaaagtgctcacactgagcggcggacagcagcagcgggtatcaattacaagggctttctgctgtgacacggatcttatcgtagccgatgaaccgaccggaaaccttgatgaggacacatcaaaagagatcgtacggctctttcaggatctggcgcacaaggaagataaatgcgtcattatggtgacgcacgatgaacaaattgcaaaagtgtcagacatcaatatcagactttcaagaggaagttttactgtgaaggaaaacgtcgcagtcgtataacaaaacgcgcctctgccagtgcagacaggggcgcaccctatatcccccttttatatagaagtgaacataaaaagagcggcggccgcatccccccgctctttttatcatttttttgcttcctccccttttgacttctctcttcgtttctttttccaaacggccacaataaacagaaagagcggaaacaataattgaaaaggcaaatgaatatacagcggcaccacgttcaggccttcattcaagtgctccgaaaagttagtcgcgatcgttatagaaaggattaagatgcccaatcccatcggataagccaattgagaggggttcttttccttaaagagcgtagatgtcccaaccacagtggcatataagtagaggctgaccttaaagaagccgccgatgatcagcgccagcataaaaaagacatcgagccggtctaaaaattcttcgaccttgattgtctggatcgtgcttaaaagcggaaactgggatctgagtgtaagatcaacatcaagcacgctaatattaatcgccacggtgagcgccacaatcaatccgctaatagccatggcgatcatccccatttttttcacatcttttctgtcattcaggttagggaaaatcatcacaaataaaacaacttcaccaaatggaacgtacatggtctgtgtgaaaacagagtgaaggacaggagaaatgccgtttgccaaaaccggctttaaattgtgcgggtctatagtccctgagacaataatcagcacaaggccgatcgcgcccagtaaatacatggccccgaaaagaagttcggccgcgcgtgcgagtacttcaattccttttcttacggcatatatgcttactaccattaataaagcatttacaataatgataggtgtatcatgataagcaaacgtcagcagcatttctccaaagtcacgcagcacccttgcggcaatataggcaaagtacaagatatagagaaatgaaaacagccagctcagcttggttcccagcatatcatccatatattctttcggagaagaattcggataacattgataaatgccttgatacaaatagaaaagaaacagtccgatcgcacagcctaataaaactgctatccaagcatccctgcccgccattgatcccggtgtaatcaataaggagctgcccagttcaaaaatgataatcatgacaaacaactgccttatgcttattctggctttttccatctgtcacttcccctttcttcagacctaatcatctttaaactggtgtttgatcggattgtttcgcaatcccgtccttctgatatacgtctcggccttcacatcgatgggcagttccggcaaatattctttgtcccaagtgtccttcattttctcccactgctccggatactttctatatatcgtgtcaccaaaaccgataaaatctattttattcttcttaatctttttcacagtatggctgatttccttttcaagctctttgttgagcgctttttcaatagcggccagcaccttgggatcagacaattggaaagggtatttgacagcatctataataccttcaaccgacactttcacatggatgtacgggcgtccgttccgcattttcggtaccagctttgtatcttgatgggtaacctgcaagctgaccgcatccttcgtcttgccccagtcagcattaataaacgtatgctggatcttattcataagccagactgcccccacgctttcatcatcttccagccaatactttaaatatcctgccttatcaaaaaccgccaaaccatctgcctgaagaatggctttcgggtcagtcgcctgcgtgttttccatgctgactccttttttatcgtcaccaatcatcatatatccggggatgaccggtgccatagtgttggcggcaagtgttttcaaaacgtcctgaatattgattttgaccacccgcccgtattgtgcctccgtgaaatcgagtgttttattgactttatttgacggaattttatcaatcggcgtcaagattttcacaatattttctgcttttgttttatgggcaacgacgaatgttgctgttgtcctgaattctgtgtcccggtcaagattatctaatacaaaatccaaaccttcttcttttgccagcttttcattgatcacgactagattggtatgggcaaaataaagccgccgtgataccttcatggaggcttttctgagtgcttccgttatattgttaccttcaatcgaatagacagatacaggcggcctgtctccagcaccgcctccctgaaggccgccggcaacatttcctggattgataatttgaagatgcagcacgtagttgctgtcgtttgtccgatcgatgccaatcgccgagataatcgcaagatccgtcagctcccgcttatcccagcagccgggcagcacaatgacgctcaaaagcatgagaacggctaatagacatttacgtaccattctgatccccttcttccaaatctttgttcaccattcctcgtgaagcggccggctctgggcgttgatctttcccctgccgcaccttatcttccttgctgaccgattccggccttttttcatcggcccaccacggaacccggaaaagcgcgtcctttacgccttgtgaagaaaaaggtgcaagcggcgacatatatggaacgccgaatgaacgaagactgcataagtggacaaacatcataatgatccctaaaatcagcccgtaaaaacccataacagctgaggcaataataaagataaaccgaataagccgggctgaaatcgccattgcaaacgccggtgttgcgaagctcgcaatcgcggtgagtgccacgataatcaccattgccggagagacgataccagcctgtacggcagcctggccgattacgagcgcgcctacgattgacactgccgagccgacaacccggggcagcctgactcccgcttccctcagaatctcaaaagcaacctccatcgtcagcgcctccacaacagccggaaacgggacaatttcccgctgggccgcaatgaccactaacagctgagtcggtatcatttcttgatgaaacgtcgtggctgccacgtatacagctggtgccacaagcgaaatgaaaaagactaaaacacgaagaattcttatgcttgtcgcaatgtcaaaacgcgaataataatcctcaacagactgaaaaaactggacaaataaggctggggcaataagcacaaacggtgttccgtccacaataatcgcgaatcttccttctaacagattacccgctacaacatcagggcgttctgtatgatacatagtcggaaacgtcgtaaaggtttcatcttcaatcagctgctcaatatatccagattccaaaatactgtcaatatctattttttccaggcgctgtttcacttccttcagcaccttttcatcacatattccttgaatgtacatgagagcgatatccgtattcgtaacagaaccttttttcattttttcaacccataaattcggatttttaatgtatcgccggatcatggaaatattggtttgcagagactctgtaaacccttggcgcgggccgcggaatgacacctgggtgctcggctcttggatggagcgctgctctcccccttgagtgctgcaaatcaaagcttcatcatggccatcagcaaaaatgagcgcattgccaagcattaactcggaaaaaagcttgtcccagctcttttccgctttcaccccgcccagcgggagcgttttttcaagaatttgctggatcgcatgagtattctggatagactcatcctgtaccaatgggtcaattaacgactcatggatcgtgttattatcgaccagcccagaaatatagataacagctaggtggacatgatcctgctccccgattttaatctcgcgaatgatgacgtcagagctgcttccgacttcctttttcgtttccgctatattctttgctaaacttggagaaatgagaaccggcctttctttttcttgctgctgttcctgattcctttcgtctgtattctgcttgtcttttgaatcggtattgttctttcgcttagaaaataaaggcatacacaaatacctttccttgtcgttttctcatattcttccttttaaaattgagattatgcattagggttagatgcggtataacttctccgccaaagatagacactaaaagcggaggatgatgaagcatgaagatattgggcgtgaccggattcatattaatttgtttattagctatttctgtgttgatggacatgcttcaagggttcagtttaacaaaagccgtttataacaatatgtccagctttaagatgacaacatttgcggaatgggtcgtgcttttattttttgtgttagtacttgtgagagaaatgtacgtgatctataaatcgaaaaaaaagaacccctaaaggggggcgcttttttcagacaatcatattgccgtctattgtatcactgctgtgtttgttgatggtccctttaaaaatgcggttgccgatgattttggaattggttgacgtgtttgtttgaatagctgtcgcagtgcccgcggagaggttattgatggtgtttccagagatgatagagcctgcagagccattgagataaatcacaatcggattcccggctgttctgttgactgaaatggtattatcaaaaatctcatgcacacctgcgctgatatagatggtgaccaaaagcggggatcgctctaagtggttgccgataattgaggtttttgcacttgtggagcaataaatggggtaatttttgaactctttaaatgtattgtttttgatgatggcgccggcattgtttgtgacggaaacagaatatgattccggcactgcttcaaacgcgtcaggattcagtgtattcccttcaatcaccgcgttcccttgagcaatccaaatgccccggctgaattttctcaggagattatctttaatgatcatatttccgccggaaacgttcacaccgtcaacgacttgaatgagacagttattcagaaatgcgatgtcatctgacagcactgcgcgaagaccgatgctgcgccttgtttcagacagtccgttttgaatttggtttccgtctacctttacgtcggaggactgataaaccaatatccctgtgttttcaaagttgctgattttgttgttcgtcacaagaacgctctttcccctgacatcaattccagttgaaaatccggtaatgaggttgccagcgatcactgcatcactggtctcttttccttgtgatacaccgagtccggttatcccgactcttggcgcagccgccgcgtcttcagggcgtctcagaatattgcccttgatcactgtttgcgtcccatatccgtagctgattgtattgtctgagtgatttccttctattaaaatgccatacccgttaaaattggtcacagaacttgaaacgtttccaacaaagtggttattgcgaattgatacattaatcggttcctcataatcaacgtcaccttcgccatatccttcaatgtcaattccgaatttcggcgctgttccattccccgttccggcatcttcaatcaagcattcctccaccgtgaccatgtcacatccggtaatggaaatgttatttctcctcgaccgccgaacctcacagcggcggatgataatttgctctgacgttcgataatcttgattggtctttaatccccttgggctgactatgatcccatcgccggtaaaatcggaaattttcacatcatcaatgacaacattcgagcatccttcaatacatatgccaaagccccattcatgggttgaccttatccccgccgaggcatacgtatgctcatcccgttcgccgataatttgtcctccggaaatagttatattctcttgcttgcctacataaaatgcggaataaccccacgaactattcggtatcactttcatgatacattcggggtccatcataatctcaaggttgccgggaacaatgatccccgcgtttcgaaacctctgattaagatctccgccaagcgttgcgtctattaaatatgttccctttggaaaccagacagtatgatagcctttcgaaacagctgtactgaggcactgattaatccgttctgtcgaatccgttttaccatctctaggaacaccgaaatccgctgcatttaatatgaattcagccaattgcgagcctccttctctatgattactatcatgttactcacaaaggcccgatctgcttgtacatttctctaaaattttattaaaaaaatataaaggaatagttgtgtaagaaaatctcacgataaaaagtttaaaaattaggaggaaatcactatttttaggtatttataatttttccaatatggaactatttgaaatgagtataaattatattgacacaagtattatataagaatatgatttttataatacactttttttagaaagggtttggctgacatggcttcgattgataacgaaagtatcattaaaagcgtcccgcaaaaagggttctttggtcacccgcgaggactatttacactatttttcaccgaattttgggagcgtttctcttactatggaatgagagcaatcttactttactatttgtatacagagacggtaaacggagggctcggctttgacaagggcactgcggttgccattatgtcgatttacggatcactcgtatacatgtccaccattattggcggatggctcgctgaccgggtattcggtaccgcaaacaccgtgttttacggcggcatattcattatgttcggccacattgcactcgcctatccgggcagttcgatagcattctatatcagtatggtgcttatcattgtcggaacaggcttattaaaaccaaacgtttcaagcgtagttggggatctttacacgaaagaagacccgcgccgcgactcaggtttcagtattttctacatggggattaacctcggtggtttactcgcgccgttaattgtcggaacactcggacagaagtacaactatcatctcggattcggagctgccgcggtcggaatgcttctcggacttatcgtatttgctttgacaagaaagaaaaacctcgggcttgcaggttccaatgtgccgaatccgctgtctaaaaaatctgcaattggcaccggaatcggtgttatcattgtggcgatcgcagtgattatctctgtacaaacaggcgtgctgacgatcaaacgtttcattgaccttgtaagtattctcggtattttgattcctgtgatttatttcatcatcatgtttacaagcaaaaaagcggacaaaacagaaaaatcccgtcttgccgcttacgttcctttgtttatcggtgctgtcatgttctgggccattcaggaacagggagcgaccattcttgcggtatacgctgatgaacgcataagactttcattgggcggattcgaacttcagtcatcatggttccaatcattaaatccattgtttgttgtcatttttgcgccaatattcgcatggctctggatgaagcttggcaaacgtcagccgtctacaccagttaaattctcaatcggaattattttagccggattgtcatttatcattatggtattccctgctatgcaaggaaaagaagcactcgtaagcccgctttggctcgttctcagcttcctgcttgtcgtgcttggagagctgtgcctgtctccagtcggtttatccgtgacaacgaaactggcaccagctgccttctctgcacagacaatgagtatgtggtttctgacgaacgcagcagcccaagcgatcaatgcccaagtagccggattgtttgataaaattcctgaaacaatgtacttcggcaccatcggtttgatttctatcgttcttggcggcattctcctgctgctctcgccggtgatcaaacgcgcgatgaaaggggtcttataatcagaaacagcccgcggatgttgatctgcgggctgttttttattgatcaagccatttcctgaagctttgatcaaaggcttccggttcttccagcatcggctgatggccgctcttttcaaaaataaccttatcaacatggggatataaaccgtcaacagcatcccatagcgaaacgggcgcaaccaaataatcatatctccctaatccgatatacaccggcatacgaacatcagctaaccgctgaagaagatcaatccgggcaaatgtattgccccataattcatcaatgatcggcatattcgtgaatacaccgtcccataaggcagcagcatgcggccgctcttgataaaagcttttcgcttcagcgcgaatacacatgtgcacaaagcgcctttcaggatctttgtcgatgtcctgcggcaaattctcgatgtctttttcaaagcgtttctttctctcaagactggctgtttccatgaaaaatgattcgctttttcgctgtctttcttcactgttatcaggcgcagtattaaagagcgccaccttccgaacttgtttgggatatgtcctggcatactctaaagccataaaagcgtgcccggaatgtcccaggatagtaacatcctcaagctgaagaaatgttctcatcctttcgatatcagccaagacagcatcaagcctcgaatcctccgcacgaagctcccgcttaggcttagcaaatcccctatggtcgacaaagacccattgatatttctgtttgatatctgaggaaaaaaggcgcggatagtaaaccgcactcccgatcacaaggatgggtgcgccctcgccctcaattcgataagctaaatcaaagccgtccgagtgacagatccccgcacgttccatttctcacgcccccttttgttttcattatataaaaaaagcctgacgcatggcgtcaggctatcgatattaccgttttaaatcttccagggtctttttccatctgctcagcacctcttcagggctgtgaagctgtatacggacacctgaagtcaaatcagcgtatttcgcaacgtcctctttcactgaaacgatgcggcaggaaaaacggtctctttcatattcggcatctttcaaaggcggtaaaggcgcgcattcaagctttacataataggccgctcccttccaccacgccgtgaactgtgcttttcctgtgcgaaggatgttggccgaagtcattgtgtttttccacagagcgattcggatatcagttcggctcagcgcgatgatttcacctgcactgatcatagcggcatgcggccagccatcctctgatactgtttgcagaacgaaggcctcatgctgcttctcattcaggcagctcccgtcaagcagctcaaagagacggtctgacatacagttcacgcggatcaagcctttcgttccggcaccgccggaacttcaattgctgtttctgtttcctttggatcaattttaaacgctggattgtatttttcgggatttgtaatgctttccggttcacaggatctccatgtaaaaaagcatgtttggcactgataaacttcccatgcgccttctacaggcgatttgctcatgacttctcccttttttgagtcgcatcgaggacatgtatgcatttcgaacatcctttccttatttattcattaagtccattagtttttgttcccattctttcgttgttagcggagaatcaagcggctgtgaataatggcctcttgtttccggcgcaaccggtgtagtggcgtcgagaatcattttgtgagtgattcctgatggattggatcccggatcaagcggcaggacagataagtccggaatgatgaccgcatcatgtttcggatgcattttggtcgaaagcgcccacatgacctgcggaaggttgaatggatcgacatcctcatcaacgactatgaccattttgcagtagccgagtccgtgcggcgttgtgagtgcgcgcatgccgaccgctttcgcaaatccgccatagcgggtttttgtggaaacaatcgcgattaaaccgtgtgtgtacatggcgttcactgccacaatttcgttcggatacgcttcttttaactgctgataaagcggcacgcatgtgttaatgccgatcatgtaatcgcattctgtccaaggcatgcctaagtataaatgttcaaagatcggattgtttctgtgatagacgcgtttaattttgataatcggcatgctgcgtccgccggaataatggcctgtgaattcaccgaacggcccttcatattcgcgctctccggcaataatctcaccttcaagcaccacttcagcgccccacggaacatcaagatcagacagctttgatttgacgatgcgatatggttcgccttgaatcgcacctgccatttcgtattctgattgatcatagagaagcggagtcgatgccgccgttgtaatgaccggctcacagccgagcgcaatagtgaccggaaggttgatgccgcgttcttcagcttggcgcagatggattgcaatatcgtgctgcgggacaggctgaatgccaaggcggtcttttcctttgacttgcattctgtaaatgccgacattttgtttgccgaagttgtcagggtcctcaagatcacgggaaatgacacatgctttgtctaaatagtagcctccatcaccctggttaattctgaaaagaggcagtatatcgaacaaattgatatcttctgtgatttcattttcatgaaatggcgctgtttcctcacgtttgaccggcatcggaaactggtcataacgctttgcgaattcaaaaaactgttcttttaccggtgtgtctttcggcatgcccagcatcatggcatggtttggccaagagccgatgacattcatcgcaattcgcgcgttatgatagccgtaaatgttgttaaataagagcgcagggcttttatcgccaagattgctggctgcccgtgcggaggcccctaaatccggttccggctttacctcttcattcactgtaagcagctgtccttctttttcaagggcagcgagaaattctctgaaatcttgataagccatgatcaagctcctcctttttgtttttcaatcccattccagcgcttcgcttcaggaagccgaatgccgaattggtccaacgttctaaaaacaatatggtcaaccatttcctctaagcttctcggccgattataaaatgccggcatcggaggaagaatgatggtgcccattttcgtaagcgctagcatattttcgagatgaatttggttcaaaggcgtctctctcgttaagaggacgagtttttttctctccttgagcatgacatccgccgcacgtgtcagcagattatccgccattcctgtgcgaatgcttgcgagagatttcatgctgcacggcgcaacaatcattccatcggtatcaaacgacccgcttgaaatggctgccgcctgatccttatgtgagtaagtgtatgtggccagttgttctacttcttgtaacgtatagcctgtttcgtgtttgatcgtgacgtttgcccaaggagacacaacgagatgggtttccactccggcggccttcagccactgcagcagcctgaccccgaaaatggcccctgttgcccctgtcattccgacaacgagtttcactttgccccctcctttacgcttgaattctgctttcatttcaatcatactcctgatatatccatatgaaaaatatctattaaatctataattaatacctaaaaggtatgataaggaggcgctttcttttggatattcgccagcttcgatacttcattaccattgcccaagaacagaaaattacgtccgcagccaaaaagcttcacatggcgcagccgcctttaagcaggcagctcaaacagctggaggacgaacttggtgttgttctgtttgaccgtaacaagaaaaaacaaatgactcttacatatgaaggagctgtttttctaaaaagagcaaaagagattctgcataggtttgaagatgcagtcattgaggtacaggagctgaaggaggaagtagccggtacacttgccgtgggatcaacgatttattgcgcggctctgatgcttgaaaaagtaacacagatcaaagagagatacccccatctcacctttaatatttgggaaaatgaacccgcgacactgttggaactgctggaaagccggcaaatcgatgcggcggtcacgacaacactgatcaaaagtgacacagtacaattcaagcagcttgatgacattccatgtgtgctcgtgctttcagatgaagccggatatccgtgcggagacaccattaagatggtggacattccttcatttccgctgatcctgctgcggcctgtcaacggaaaaggcgtctataatcaggtcatgaatgaatttcatcgtttgaacctggagccgcgcattgtttgtgaatgccacgactctgcaactttgctcagcctcgtgtcatccggattcggcgcgtctattttgcctgtcacaatgattcccgttcatatgagaaatcacgttcacaccgtccatatcgaaaataatcccttcattatgacaccggctgtcatgtggagaacggacagttatttgcctaaaccggcacagcaatttttggatttattttaaaagattttgtcttatgaaaaccaaatacttgactcatactaaaaaaagttatcctttagatttgtaagctaattttttatttcaataaaatcaaccagaaaagtggggaataagatgaaaaaagcattattggctttattcatggtcgtaagtattgcagctcttgcagcttgcggagcaggaaatgacaatcagtcaaaagataatgccaaagatggcgatctttgggcttcaattaagaaaaaaggtgtgctcacagtcggaacggaaggaacatatgagccgttcacttaccacgacaaagacactgataaactgactggctatgatgtcgaagttatcacagaagtcgcaaaacgcctcgggcttaaagtcgactttaaggaaacacaatgggacagtatgtttgccggcctgaattccaaacggtttgacgttgttgccaaccaagtcggaaaaacagatcgtgaagacaaatatgatttctcagataaatacacaacatcaagagccgttgtcgtaacgaaaaaagacaacaacgatattaagtctgaagcagatgtaaaaggaaaaacgtcagctcaatcactgacaagcaactacaacaaattagctacaaatgccggcgctaaagtagaaggcgttgaaggcatggcgcaggcccttcaaatgatccagcaaggccgcgtcgatatgacatacaacgataagcttgccgtattgaactacttaaaaacatctggcaataaaaacgtgaaaatcgcgtttgaaacaggtgagcctcagtcaacatatttcacgttccgtaaaggaagcggcgaggttgttgatcaagtcaacaaagcattaaaagaaatgaaagaggacgggactctttctaaaatttctaaaaaatggttcggcgaagatgtttctaaataatctgccggcattgacgcttggcacggcgatcccgtgggatctggtgcagcagtcattctggccgatactttcagggggaatctactatacgattccccttacgattctttcctttatattcggaatgatcctggcgctgattacggcgcttgccagaatgtcgaaagtgagacctttgagatgggtgttcagcgtatacgtatccgcaatacgcggcactcctcttctcgttcaattgttcatcattttctatctgttcccggcctttaacgtcacattagatccatttccaagcgcagttatcgccttttcattaaacgtcggcgcctatgcatctgaaatcattcgggcatctattttatccgtgccgaaagggcaatgggaagccggctacacaattggcatgacacatcaaaaaacgctgttccgcgtcattttgccgcaggcgtttcgtgtgtcgatcccgccattatccaatacctttatcagcctgattaaagatacatccctcgcctctcaaattctggtcgctgagctgttcagaaaagcccaggaaatcggcgcgcggaatcttgatcaaattttagtgatctatattgaagcagcctttatttattggattatctgcttcctgctctcactcgtccagcatgtcatcgaacggcgtcttgaccgctacgtggccaaataaggaggttccgagtatgcttaccgttaaaggattaaacaaatcattcggtgaaaatgaaattttaaaaaagatagatatgaagattgaaaaaggaaaagtcatcgccatacttgggccttcaggttcagggaaaacgacgctgctccgctgcctgaacgctctggagatcccgaatcgcggagagcttgcatttgatgatttctccatcgatttctccaaaaaggtgaaacaggcggatatcctaaagcttcgccgaaaatccggaatggtgtttcaggcgtatcacctgttcccgcaccgcacagccctcgaaaacgtgatggagggccctgttcaggtgcaaaaacggaacaaagaggaagtcagaaaagaagcgattcagcttcttgataaagtcggattgaaggacaaaatggatttatatccgttccagctttccggcggccagcagcagcgcgtcggcatcgcccgcgcactggcgatacagcctgagctcatgctgtttgacgaaccgacctcagcgcttgatcccgagcttgtcggagaggtgctgaaggttatcaaggacttggccaatgaaggctggaccatggtcgtcgtgacccacgaaatcaagttcgcgcaggaggttgcggatgaagtcatcttcatcgacggcggcgttatcgtggagcagggaccgccggagcaaattttctccgcaccaaaagaagaacggacacagcggttcttaaaccggattttgaacccgctgtaataagaaaaacagagcgtcagcgccctgtttcagattattgacaaaatcctaaaacgatattcgttttaggattttgtgattttcagcgtgattgaaaacctttgaagtctaggaagggcgagcattggagcacagctaatgttaaattcgtgagcaccgaagcacaggcctgacaacgaatgcaagggtttgccaacacgctgaaacagggcgcctccggcggccctgtttttttgttgagcccctttcgcctattccgcccttctgtcagatgtgctacaatgacaatcgactgatttttacgaaagaagggacctcacgtgaagcaagaacttgttctgcgctggacattttattttgccggtttgatcattttggcttttggtgtatccctgacgatagaaggaaaagcactcggcattagtccgtgggatgcatttcattacagcctgtttcagcacttcgggcttaccgtcggccagtggtccatcattattggagcgctcatcgtcggattcacgtcattgtttacgagagcttggccgaaaattggtgccctcctgaatatggtgctcattggtgtatttatagattttttcaatttcattctgcctgccctctcgacctacacaggctcgatcatcgtcttctctctaggcgtggtgctgattggttacggcgtcggtgtttatgtatcagcaggccttggcgcggggccgcgtgattcactgatgatgctgattacagaaaaaaccggctggaatgtgcaatgggtgcggaacggcatggaattaaccattttgtttgcggcatggggcatgggcggaccgatcggttttggcaccattttgaccgccatcctcaccggacttattttgcgtttttcattgccccagtcaatccagttgctgaattatgctgtggcaaggcggacagccgcagtgaaagcatctccgcctgtacactaaaacaaagccgccttggctttgttttttattttctcctctatatgagtcttgtggaagtatgataggatggttttgacaatcttttgcagacggaggatctagaatgaagatttacggaatttatatggaccgcccgctttcacaggaagaaaatgaacggttcatgtctttcatatcacctgaaaaacgggagaaatgccggagattttatcataaagaagatgctcaccgcaccctgctgggagatgtgctcgttcgctcagtcataagcaggcagtatcagttggacaaatccgatatccgctttagcacgcaggaatacgggaagccgtgcatccctgatcttcccgacgctcatttcaacatttctcactccggacgctgggtcatttgcgcgtttgattcacagccgatcggcatagatatcgaaaaaacgaaaccgatcagccttgagatcgccaagcgcttcttttcaaaaacagagtacagcgaccttttagcaaaagacaaggacgagcagacagactatttttatcatctatggtcaatgaaagaaagctttatcaaacaggaaggcaaaggcttatcgcttccgcttgattccttttcagtgcgcctgcaccaggacggacaagtatccattgagcttccggacagccattccccatgctatatcaaaacgtatgaggtcgatcccggctacaaaatggctgtatgcgccgtacaccctgatttccccgaggatatcacaatggtctcgtacgaagagcttttataaatggctcatcaacagcttgacaccgcgctcaatatcttccgttttcacattggaaatattgatttttaatagattttctttcggataatctgataaataatgacggtctatcgcctcaaggagaaccccttgtttttccagtctatgaatcactcttgaggcgggcagatcctgaggaagcaccagatgggtgtgcatacagggtgcctgcccgctggagaacgtaaagcgtccgcttcccagctgcctgtgagttcgaatggcttgatgtagcctcagcgaccgctctttataagaatctctgattttctccttatgcctgccgtacataccgcttttcaggtaaatctccaatgccgcttgagaaatcatcgaacagtcgatgtcgttcagctttttgtacgcatagaacgtgtcagtcagcgcttcgggcaaaacagccgcccccacgcggaggccggggaacatcattttcgagaagcttttcaaatagatgacatgtgaggacagatcatatgcgtacagcggatctgcctttttattttcctccagatcaccgaggtaatcatcctcaacgagatagacatcatacgcttctgccagtctcacaagctcctgtttatcacgctctgacaatgagcacccaagcgggttatggaagcgcggcatcgtataaaaaaatttaatcgattctgtttgaaataaccgctcaaccttggctatatcaagcccttcttccgttcgtttcaccccgatggcgggaatcccaagtgtctcaagctgttcgaccatcaaatggtagcccggctgttcaatggcgatcttctctttcccatttgggaacggcatggcacaaagcaaggataacgcctgctggacacctgatgtaatgaaaatatgccgttcatccgcaaatacctgttgagtggccaagagctttcggagtacgcggatgagtgatggaagcccctttggcgtcccataaataaacaaatcgtttttgtatgtatcaatcgctttgttgatgcagtgctgaaaatcaagatacggaaacacatcgggatccggcgcagatgtggcaaagtcgatggggccaggctgcccgctttttgatttccctgactttttcacaatataatagccgcttttcggaacagaatagataaggtggcgcttttccagctcctgcagcgcgcggatcactgtgcttttgctgacttggtagcgggcggacagctgacggatagatggaagcctgtctccttcttgatatgaggtgctttgcatcatctcctctatcctcgttaatagactcatatatttctccatgccttctccccctgttttgtaccggtacagttcattgtttttctcattgtaccgttctgaccgcggccatacaataaagggagcgaccggcgctgcaattcaggtaaaggagcccttcccattatggttaaacatcagcaaacccccgcttatatagcggctattttatattcgttcattatcggtttatcctttctattcgtaaaaatcgcactgcaaacagcagagccgtttgatattttggcgcatcggttcaccattgcgtttgctgcggccactgtaccgatcttattcggctgggtaaagctatcaatccgcgtaaaggacgtcattgacattttgccgctcgccctgctgtatcccgcgttatttttcagctttcaggcattcggccttgtgtactcgtcctcctctgaagcgggaattattcaggcagccattccgattttcacgatggtctttgccgcttatgttttaaaggaacgcccaacgtggacgcaaaaggggttcacggttttatccgttgccggcgtcatgtttatttttgtgatgaaaggcgttgacgtggaatcagccagcttaaaagggtctttgctgatcctattgtccgctttgtcttcagcgatgtacaatactgctgccagaaaaatgacgcagcggttcaagctgaccgagctcacctacatcatgtcagccatcggctttgtcgtcttcaacgccatcgcccttgtgcgtcacggagcggcgggaacagtcggcacttattttctgccgttccgggagcccggcttcgttctcgccattgtgtatttgggcgtgctgtcttcacttgtcacttcatttctgtctaactatacgctgtcgcgaattgaggcgtttaaaatgagcgcttttaatcatgtatctaccattgtgacgatgattgcaggatttgtgattctcaacgaaagcctggcctggtatcatcttgccggggctgtttgtattatgattggcgtggtggggagcaatatcaatctggagaaaaaaacaaagcgccctggtatgcctgcaaaaaaatgagaaattatgctagactaaaaggaaaaacatggttagaggtgtaggtttaccgtatgattcaatatgctagtgaaagtatcaatcttccaggagaaatcacttttaaggatgtaagagaaatctttttttatcaaatcgcaaaaatatcatgcttttactttctattgttttgcgccatatttgctgcagttaacttcattaacggatggccccgtatcgtttatggaagtgacgcgcttaacttgtttatgaacagtatgttgattatcgtgatgtccgttctgtttacactgctgctcctccttcttctatatgtgaagttttccagagcatacaagaagaacgaacggatgaaatccaaaagaacatatactctgaaccaagaaggaattcgtatatgttctaaaaaatatgacctcattttcaattgggatgaaattacagctgttttcgaatataaaaatatcttcagggtcaatacatcaagtggccaatatattgcgatccccaaacatttttttcactccgaagaggagatgaacagattcaaggagattatccttaaaaataccgaaacaaaaaaactcaaatttaaaaaggatcagcattgacagtgctgatccttttatattgaatggtgggtttcttttgccttctgtttatctaaaaacggcaccagctctattacagccgataaacccacaaacacgatgcacacagcgacaatcagtaaataaccatgagtcatgtcaaaaaacaaaccgcccgcatacacgctgagagctccggcaacctgatggataaagaaattgatgcctaacagcgatccgatcaatcctgtttgatagctttccgaaattgacgccgcggtcagcgggatcacgcctgtgtaactgagcccgaataacaggataaacccgaagtaccaaaggtcgctgtgatgaattccgagaatgggaatgagcaggcaaatgaggctgagcagccgaatgaaaaataagatggatagcatgacgcttctgctgccgaggagatctgacagccagcccgccaataatccgccaatgatgataaatgccccgaacgcggccatcattccgttgacatgagagacatgcgcatccttcagtatcgggacgaggtgagcatcaataattcccattgtaaatccgcaagtaaacacgccgaagtacaggatatgaatgaggcgggattgcttcatcacgttccaaaaccctcgccaatcataagattttttcacagtttccgcttgcgcatgtggcgggtgcttcatcccaaagacgaggagcggcagcagaacagccgccatgacgattcccaaaatggtataggtgctctgccagccggcatgatacggagccgcagcccaaatgggcgagagaagcagcaggcccgcagagttggcattggtcaaaatagcaagcgccagacctttgtgtgtgtcaaaccaacagctgatgaaatactgggtcgtcacgccgaccgcgcaggaatacccgattccgccaagcacaccgtaaatggcggaaaacacatgaacattcggtgaataaggaagcaccaaaaagcttgcgctgatgcaaacagctcccagcgccataatttttctgacactgaaacggtcgataaaaaaaccgacaaaaaactggacgatgccggttgtgatcataaaaatgctgacagaaaccgaaatcagcgacctgtcggcatggaaggcgtctgccattggcagcataaaaaattgaaaggaatttctgaatgagttcattccgatggcgaaaacaaacgtaaacagcaatacaaaccatttcatcctgggagacgtgcgcatgtttcgacctgcctttatttgagtatttcgactattataccatgcagaaattggcattcaacacaaaaaaagcggaacagccgaagctgtccgcttttgatcacggttgaatgatcggatgctgattcaagatcgcaaaaatccgttctgcgacttcttccgtttgtgacagcaggaacatgtgcccgccgtcaaattgatggaatgtgatgtcttttgcccacttcttccacccttccgcatctcgtatgcattttttatcatcaagcccgttaaagacatgaacaggcgactggatctgggccagatcgtaaagctcaaattgttcaagagcccggtaatctgatcggaaagaaggcaggaaaaaggacatgacctccttattttcaacaagctctgcgggcattccgcctaattggataatatgatcgagaaactgatcatcaggcaggtgggacactttcttccgctgaatatgaggcggctggattgcagaaatgataaccgcctgcggaaagatgccttcacgctcaagcttttgcgccagcctgaaggtgatcattccgcccatactgtgtccgaacagcacaaacggccgatcagggcgaaggttcagttcttgcttgtacaaatccgtcagctcttcgagatcctcaatggctgacgtttgattcgtgccgtgtcccggcggctcggcagcgagcatctcgcactccccctgcaaaaaagcatggagagggcgaaacgacgccgaatagccgccggcaaacggaaaacagatgagctgtgttttttccgacgcatcaaatgatttgaagagttggctcattggctgtctcctcctttcatcacttcatttatgaaaccgttacggtttgtgtattaagaaattcgagcaaaatctccgcattcctatctagcgtttcgccctgcagcatttctgcgtgtgttccgaagcctcttttcacacggtaaacacctgttgtagcttcttcccatgatgcaagccattccggcatgtcaaaatcagcgccggaagtcaacagatcaatatctgctttcacctggcctgtgctgatcaggttgacgtagtatgagtaaaaggcatgtgttttttgcttgaggccgtgtttgacggcttcgctgttgagcgcttcattgtcccgattgacattcatcaacgcttcgacatcactttcaaccgtgcgtccgtccagatcactgacaccttgttttttataggaatccaccatgatgatccgctgaacaatacggccttgttcctcaagctttttcgcagcttcaaacgccaggctgcatcccgctgaatatccaaacaatgttaaaggcccttccggctgcagcttctggatcaaatccgcatagcggtcaagccggtcttcctcctcaataaaatcaaaggcgcatagcttgtatgacggcaagcggctggacagattttggtacataaggccatagcccagaaccggcggaaatgcgaaaatgatctgctcctgatcctgattcattatcgttacatcctgcaagccatcagagcccccgtttttcaaatacgctgaaatgccggcgatcgtcggcgcttcaaacaaaagcttcactggaagatcaatcccgagctctttcttgatgcgggacgcggcggtcatggccttcaaggaatgccctccgagcgcaaagaaatcgtcatgaatgccaatttgctttctgccgagaacctcagaccatatttgtgcgattgtttcttccatctcgttccgcggtccaatccattcttccgccagctgatcctgatcaggttttgggagcagccgtttattgactttcccgttcgtcgttaaaggaagctcatccaagaaggtaaaggtttgcggcaccatgtaagcaggaagctgttttttcaggtgcgccttcacgtcttcagctgaaagctgcgttcggttcacaaggtaggcattgattgatgcatcgccagactcatggcggtccgccacaacgaccgcatctttcacacctgggtattcctgcagctgcttttcgatttcttcaagctcaatccggtgtccgcgtattttgacctggtcgtcaatacggccggcgtattcaatcgttccatccggcagccagcgcgctaaatcccctgtacggtaaagcgtttctcccggcttgaacgggttctcgataaacttttccttcgtgaggtcagcacgatttacatacccttttgacacgcccattccgctgatgcacagttcaccgaccgccccgaatggctggagctggctttgctcattcagaatataaacactggcattgctgatcggctttccgatcggcaatgaggagatggaatccggcagatcatgcacgacgtgagctgtcgcaaacactgttccctcagtcggcccgtagcagttaatcagcttgcccggccccatgatccgcagcgcttttctgacatgaggcactgacgcgcgctctccgccgaataatatacagcgaagccccttcatccaatcctctcccgcatctgtgagaagattaaatagtgcggttgtcgcaaacatgacattgacattctcttgcaggatcagatctgtgagccgttctgtatcaagcagcgtatgttcatctgcgataatgagccgtgccgcattcagcatagaagcatagaaatcaaaggtaaatgcatcaaaggcgtaattcgaaacagacaagaacgtatcctgatcagaaaatgccatgtagtctacatgcttgaccaatccttgaatattggcatgagtggtgatattgccctttggctttccggttgtgccggacgtgtacatgatatatgccggatcattaggatcaatcgcggttgcaggatcgcttgcctgttcttcaaaccgtgtttgatcatcaatgaagagcgttgtgcctgtatacggcagctcagccgcttgttctttcatctcctgatgcgtcagaagacaggctgccgcactgtcagccagcatatacgagattcggtcctctggcagcttcggatcaaccggcagataggctgctcccgcctttaatacaccgagaatgccgatcaccagttcaagtgagcgcttcgtgtacagcgctacaacagagcctttgcccgcaccgtgtttttgcagccggcgtgcaatgcggttcgcttcctcatctaattcgcgataagacagggtctggccggaatacgtaagcgccggtgcatccggattggcgttcactgcttccttgaaccaatacgtcagaggctttgtttcatgagcttgagccggcgggtttaagccggttagcaaaaattctctctccctgtcgtcaacgaggttgatcgtgctgacaggctgatcaggattctggatgagctgctgaattgctgtaagaagctgagatttcaagcgcaggataaacgcctcatcaaacacattctcattataggcaagcttaatcagcatctcatctcccggggaagccatcaggttgagatcataattcgacttctcaaaaacatgaacatccaccatatcaaagccgttttcactgctttcttcatttttcgcatcctgaagcggatagttctcaaaaacaatgatgtggtcaatcagtttcggctgatcggcctggctttggatgtcataaagcggcacatattgatgcggctcggactgcagcgattgctcctgcagccgcttgagcaagccgttaaatgtgataccctcagacagcttcacacgtctcgggacaacgttgataaacagcccgaccatatgttcaacgcctttgatttccgcgggacgccctgaaacaactgtaccgaaggccaaatcgccagactgctgatagcggctgatcaatacgctccagactgcctgcagcgccgtactcaaagtggtatgctgcgattttgcaagctcggtaaaggcctttgtttccgcctccgacagtgaaaagagcagctctttcggctcatagccgtccttttgtttctttctttgctccgcaaacgtcgtttgtccttcaaagccctctaaatattcgcgccagtaacgcagtgatgcttgtttatcctgcttttcaagccacttgatgtagtctttatacggtttgacgggcggcaggctgtacggcttttgttcgcgcagagcattgtataccttaaatagatcctgtacgacgatgccgaagcaccatccgtccaaaataatgtggtggtagctccacacccattcaaagctttcttcagctttcttgaaaatggctgcccgcatcggaatatcccgcgtcaaatcaaaacccctgatcttatcctgttctttgtactcattgattttggctgtttgctcgctgcccgttaagtgtgtcagatcgatttcttctatatggaactgccgttttttcaatacgacttggacaggcctttttactttttcgtgaatgaacacggtacgaaatacatcgtaccggtccatgatcacattcatgctttcttcaagacatttgatattcaagctgccttttactttcatcgtgatttgttcaaggtaaaagctttggccgggattcaggatggcatgaaaaagcatcccttcctgcatcggcgataggtaatacatatcttgaacctgatccttgctaaattgactcatatgtttcgctcccgccttctgtaattcccttgcgttttattttaaattctcctcaagcatgtcaaagatatctcccatctcgtccatttcaaggtcttcggcgctgaagtcgcttggtgtgaattccttgtcttctttttccgtgcaatggcggattagcatcaggaggttttctttaaaccgttccatttgctcctcgactgtagctctttcaaactccttctcattgtaggagcaggaaagcacaaaccggccgtttctgatcatgccgctgaagcttaatgcgtacagcgcctctgattctccgcttacttggcgccccatatcgaaagcggacggttcaaagaaatcggttttgacttcactgtcgaattggcccaaatagttgaagctgatctccggtgtgaagccctttgtttccgctgtttctgtgaaataacgaagaatgccgtagccaacacctttgtccggaatgcggcgcaggttttctttgactgttttgatcacagctgaggcatctgcgtcagatatgtcgagcacaacagggtattgtgccgtaaaccagccgaccgttctggagatattcacattcgggataatgtcctcccggccgtgtccctcaaggttaatgccaattttggccccctttgtccattctttcattgtcaaaccgagcgcgctgagaagaatatcgttgatttcagttccatatggctgatgaacatctgttaaaagatgcttagtgtcttctgccgttaattcacataggacagatgatgtatccttgacgatccgctgctctgtttcacaatccttaggtaaaggagaaacctgttcagcggcaatttgcgaccagtattcagcctgctgtaaaagatgcgctgattggctgaatgccgccagttcttccgcccaatccttgaaggagtttgttttttgcgggaagacaaggctctcttctttctcagcctgcatgtagcctgaagcaaagtcttcaagcaaaatccgccatgacacaccgtcgaccacgagatggtgtacagcaatgagcaggtgatccccagcttctgtgcgatattgctccgcctttaaaagcggcccgtttcgcagatcgagactgctttgcagcttgttcgcgagaagcttaatctggcttctcagcatctcttcatcggagccgtacagatccacgatttcgaagctgaccttgctctcaccgatcggtttatacacctgaacgatgtccccgttttcctcgcggtagaccatgcggagcgcgtcatgatgctcgatcagcgcctgcaatgttttctccacccgttcaggatcaaagcccttcttggcgtgaagcatcacagattggttccagtggtgcttgttcgtgaagttcttttcaaagaaccagcgctggatcggcgtcaggatgacttcgccctccaccgggccttggtctgcctgtttgccttcggcacgctctacgtactgggtgagctcttcgatcgtcgggtgctggaagagatctttcatttccagcttccagccgtgctggttcaagcggctcgccatttgaattcctttgatggaatctccgccaagcgagaagaaattgtcggtgacaccgacttcagacattccaagcacgtcctgccagatgccggcaagcagctcttccatgtcggtcgtcggcgctttgtattctccgcttcccgcttcgatgtccggctcaggcaaggctttgcggtcgactttgccgtttgccgtaaccggaagctcgttcagcgtcacccagaacgccgggatcatgtaatccggcagggtttcctttagtgttgattttagtgcttctatgtcagctgtttccggtgtgacatacgccgcgatcgctgtattgccgcctttatctttgacagctgtcaccgccgcatcctgcacctcagaaagctgggcgagctggacttcaatttctgagagctcgatccggtagccgcggaccttgacctgctggtcgatccggccgatgtattcgatgccgccgttcacccacttcaccaagtcgccggtgcggtacatgcgttcacccggcacaaacggatcagcgacaaaccgcttcgcggtttcgtcttctcgattcagatagcctcgtgccagtccgcgccccgccacgcaaagctctccggctacgccttccggctgcacctgattgccctcgccgagaatgtatactctcgtattggcaatggcccgtccgatggaaagcgagccttcctccggatggatttctgcgcttgtggcaacgaccgtattttctgtcggcccgtagttgttgacgagtgtgtacggctttttcactgcccgcttcagcttgtctcctccggtcaagaggacgcgaagtgatgtgttctcaagctccatgaactgttccgcaagctgtgtcggcaggaacgtgatcgttacgccgttcgtttcaaaataatcgttcaggcggacgatatcgaggcggatcgcttcatcaatgacgtgaagttcagcgccgatcgtccaggtcgggaacatctcccaaatggaagcgtcgaacccgaagcccgcgtacttcgcactgcggtcctccgctgtcatgctgaacgcgtcgtggtgccagaagcacaggttcacaagcgcatggtgctcgaccatgacacccttcggctgtccggtcgttccagacgtgtaaatcatgtacgccaagttctccgcggttacagcggtttctggatttccctcgtcgttttcatcaagcggcaggcttagaatcgtgcggcttccgtcgagaagaatgacatctcccgtatagctgtccggcactgaaatgccttcctgtttcaagagaagcttcgcgccgctgtcctgtaaaatatactcaatccgctgatccgggtagtcaggatcaatcggcacaaacgccgctccggctttcaagacgccgagcaccgcggcggacatttcaagcgacggcttcgtgagaacgccgacgcggtcatccgggctgatgccgcagtccatcagaatccgggcgaggcggtttgccttcgcgttcagctcgccgtacgtccaagattggccgttgtatgtgacagccgggcggtctttgtggcgctggacagtctcttcgaatagctgatgaaccgttttgtctgtcggcacaggcagcgctttgcccttccatgcctcaagaagcgcttgcttttctgtctcggtgaccagtaacagactggaaagcggctggttcgggttatccgcaacagcctttagtagccgcagaacgtattcgctccatttttcagctgtttcttttgcgaacagatctgtcgcatattcgagctgcaagccaatgccattttcatcagtaaatccgcccagtgtcagatcaaacttagaagttccctgatgagcctcataaggtgaaatgctcagattttgcaatgtaagctgttctttatcagggttttctgtcgtcaccatcacattaaacaatgggtttcggctcatatcccgagggagatcaagctgattaaccagatcttcaaacggatactcctgatgctcaagggctgacaggttcgtctgctttgctagctccaaaagctccgcaaatgtttgctgttctttcgcttccattctcagggcaagtgtattgacgaacattcccggcatgtcctgaacatcagcattcgtccggccggcagtaacggagccgatgacgatatcccgctgtccggaaattttgcttaaaaagacgtggaaaacagcatggagcaccatgtgcaaggtcgttccggtttcggcaagcagtttttctaccgcctttgccgtctcacttcccgtacggaaacggatcgtatctcctttaaagctttgcacaggcggacgggcataatcgagcgggagatcaagctctggcagctcgcctgaaagaactgacatccagtacgcctcatgctccttcatccgttctttttgctcagcttcattttgccaaacggcgaaatctttataatgaagcgtcggctccggaagctgctctcctttgtaaagcagcgccaattcttttacaaagatgcctcttgagacgccgtctgcgatgatatgatgcatatctaaaagcagcaaatgttttttcgcttctattcgaagcaaagctgcgcgaatgagcggtgcgtcgtttaagtcgaatggccggataaattccttaatcttttggtccgcttcgtcttctttggcttcaaacacatgaagatcaacctccgccttctcaatgatgcgctgaacaggctcaccattagcttccataaatgacgtccgcaatgattcgtgacggttcacaagctgattgagtgagtcgcgcaggcgcgaaatatcaagctctccttccattagaagaacagatggcatgttgtagcttatcgtctggcggtcaagctgattgagcacgtacattcgtttctgtgcggatgacaatggatacatatcctgcttgtcagccggtttgagtacttgatggccgcctgaaacagcagacgcctccatataagccgccagctggcgaactgtcggctgctcgaacagtgctttaagcggtacgcttttctccaattccgcctgaatgttggcaatcagcatcatcccttttaatgaatggccgcctaaatcgaaaaaattgtcatcaatgccgatggcttctatgccaagcgttttctgccaaatgcggcataaactttcttcaagcgctgtctccggtgcggccaaggccttgcctccggattgtgccgcgttaggcttcggcagagcgtttctgtcggtttttccgtttgccgtcagcggaatcgcgtcaacctgcacaaagaaagcaggaatcatatgagacggcagtgttagggaaagctggtaccggagctctgctttttcaatatcttgatccgacgtataatacgcgcaaagctcttgaagaccgccctcggaaaccgctagtacaaccgcttcttgaattccgctgaggctgagcatgaccgtttcaatttctttcggctcaatgcggtagcctcggattttcacctgatcatcagcccggccgataaatgcaagcgtaccgtcagaaagtcttcgtacgacatctccggttttgtacatgaggcttcccggcgaatatggattttctacaaatctctcggctgtcagctgaggcctgttgagataccctctcgcgagcccctgtcccgtgatatagagctgtccgctcgctccaggcggcacaagcttcaatgcttcatttaagacaagcgcaccggcattcgcaatcgggcgtccgattgtcgggcgtttcgcaaatgcatccggctcatacagatcaacccgcccggcgatggcgccgatcgttgcttctgtcgggccgtagtgattgataaattcggtatgtccatacatcttacggaaggcgataacatcagtcgggatgattttttctcctcccaagacgatcaagcgcaaggattcaaagttcgcatcttttgcaaaactggcggtgttcactattgtatggaacagagacggtgtcagcttgatataagtgatcccatgctccttgatatagtgcgctatttcatccggcgccgtataggtttccttctggacgatatggagctcgcccccgcccagaagtacagggaacatgctcgtatagccaaggtcaaatgcgtaagatgaaagcaatacagtcttatcattttccgtcaggcccgcctcttcactaaaccaagagacatagtttgtcagattacgatgctcaatctgcacgccctttggctttccggtcgtaccggacgtataaatgacgtatgcaagattgcgagacccggaaatggatgatgggcgctccttgctttcatttctccatttaccgtcatcaaggctgacaattatcccttcatattgcccaatagccgtcatgtttctttcattcacgaccgcaaattttgctccgctgtcctctaatgaataacggattcgttcttcaggtgtatcaggatcaatcggaaggaaagctgcccccgccttcatgacaccgagaatggataccatgacttcagctgaccggtccataacaatcgcgacgatgtcttcatttcctgccccttgggcacgaagatgatgcgccagctggttcgcctgttcatcaagctcgcgataggtcaacagatttccgccagccttcaccgcagaatggtcaggtgtttgctgggcctgtttttcaaaaagtgctgcaaaggttgcttcggtaatttgagtcatatgtctttcttctagcaaagcagccgtttctgcagatgaaagcagatctacatcagacagccgaacgttcggattagccgcggccgctttgatgatattgacaaagtggcggctccagcggcggatcgtctcgtccttaaacaaggcagtcgcatagtcaaagcttaggccgatatcctcttcacgctcgaccgcttccaaggaaagatcaaatttcgcaacatgatgaagcatggaatacgaggaaatcttcaaatctcctaatcttaatgaaggaatctccatattctgcatgttgaacatcacgctgaacagcggacttctgcttgtatcccttgtaagcggaagcttttcaatcagctcctcaagcggatagctctggtgctcgaatgcttgaaggctggctgttttgacctcttcaaggaattgcgcgaaggttttatctcccgctggtgccgttctgagtgccaccgtgttgacaaacatacccggcacaccttgcagatcaggatgtgttctgccagctgtcggcgagccgacaatgatatcatcctgtgacgcgtacttggaaaggagtacattgaacgccgccagcaaaaacatgtacattgtcgtatctgtttctgccatgagcgatttgatttgagccgtgatttgcttatcaagcccaaacatcacgcgctctcccgcaaagctccgttcagctggccgctcgaaatccgcgggaagatccagtattggcagttcgcctttaaagacatcgagccagtattcctcatctttttgataattagtttgttctttgtgccaaactgcgtaatctttatagtgaatttgtggcagttccagatctgcgccttgatatattttggcaagatcaccgattagaatgcctgttgaacttccgtcagtaataatatgatgcatatcaatgagcagcaggtggcgtttttcttccagctggacaagcttcgaacggacgagcggcgcgcggtttaattcaaacggctgaacaaatgctttgattatctcttccgcgtcttcttcccgtcccttggcagcctccagctggaacgatatgtttttatgaacggtttgcacaacctctccgtcgatcatgtcaaacgatgtacggaggatttcgtgccggttgattaattgctgaatcgcgttttcaagccggtctttatctacttctccctccagcagaagtacagcggggacgttgtagcttgtgtttgcttgtccaagctgattgaggatatacattctccgctgggccggggatacaggataatgctgctgataagatgcttgcctgatcggttcaaacgtctgctcctccttgctttcgttctcttccaaatacagtgccagttcttgaatagtcggcttttcaaaaagcacttttatcggaacttccttatgaaaatgctcttgaattttcgccgtcatcatcatcgctttcaaagaatggccgccgatcataaagaagttatcggtaacgcctgctttgacgccgagtattccttcccagatctccgctaatttcttttcactctctgtttttggtgctgcgtattccggctgcacggcttctgattgcggtgcaggcagttcctttttgttgattttcccgtttggcgtgagcggcaggctgtccatttgaatcaggtgggcagggaccatatagtcaggcaaagactgagacagtgtttttctcagctcactcacagccacttcacgatccgccgtgaagtacgcgcaaatttcattttcgtctgctttgttcttgcgtatgatcaccgcggcttctgtcacatgctcagccatgttcagttttgtttcaatttcgccaagctcaattcggaagccgcgcaccttcacttggttgtcgattctgcctaaaaattcgatattgccgtccggcagccatcttgccaagtcaccagtgcggtaaattctctcacccggtctgaacgggtcttccagaaattgcttctccgtcagctcagggagattgacatacccacgcgctacaccgattccgcctacgcaaagctcaccaggcgcgccgattggctgcaggcattgctgctcatccataatataggcagtggaatttccgatcggcttcccgattgggatagagccgccatactcgcggtcgatcagaaaactggttgaaaacgtcgtgttttctgtcgggccgtatccgttccacaatgaaagcgacggcgatgcctgttttactttgctgacaatatgcgggacaagggcatctccgccgatgattaaatggcgcagtgtgccgaacatacccgcatcctttgcagcaagctggttgaataaaggtgatgtcagccacatagttgtgatgctttgctcacgcaggaatgcagcaaattgtttcgcatcaagcagtgtctcttttttgaccggataaagtgctgcgccattcagcagtgcgccgaatacctcaaacgttccggcatcaaagctgacagctcccgtttgcgccatgcggtcttcttcagtaacaggaacgtacccggcatttttgacgaggcgcagaatgcttttatgttcgatcatgacgcctttcggtttgcccgttgaaccggatgtgtacatgatgtacgccaaatcagacggggcggatggcaggttgagattgtcagccgcttcactctcttcaaagcctatgtccagtgtaagaaccggcacttgcagctgatgtgcctgccctgtataagaatttccgatcaaaaccattcgaacggagctgtcctctgccatgaaacgaagacgatccccaggaagcgctggatcaagcggcacatatgcggcgcctgcttttaaaacagccagcatgccgacaacggtttctactgagcggtcgttcataatcgctgctgtttcccctttttgaagcccatgttcgacaagctttctcgccagacggttagccgctgcattcagctcgcggtacgtcagcttggttccttcatatacgacggcggtgctcgccggcgtccgtttcgcttgctcttcaaacacttggtgaacagccattccttcagggagttcggctttcgtgctgttaaacacctcgacaatttgccgctgctcttcgtctcccacaagcccgtactcacgcacaaaagcggccggctgatcgacagctgcttccatcatgcgggtaaggtgctccgctgtccgttcgataaaagcggaatcaaaggcggctccgttatatttaattttgacggtccacgttttgcccggatacacaatcaggttgaaatcgaagctcgtttgttcaaatgcgctttctaccttaatcgaaaacccgaggcggtcttccatgctgccgttttcaagctcttgatcaagcggataattttcaaacgcgaccagatggtttaagagattgccatcaagagctgagcgtttttgaatctcatagagcggcacgtaatcgtaacgctctgcctctactgcatgctgctgaacagctgtgaaaatatcagcgaatgcagcatctcgttcaactttcacccgcactggaatggtgttgataaacagccccgccatcgtttcgattccgttgatttcagacggtcgtcccgagacgaccgttccgaagatcacatcatccgtaaagttgtatttgctgagaacaatgccccaaacggcctgaaataggttaggccctgtcacttgatggagatttgcggtttgctgaatacgggcaaccagtgtttcgtcccatgtaaatgaatattctttattgacgtattcgtcttttttcacaggcaggcggcccgggagcacgcttggctgttcaaaacccgccaagcgctcgctccagtagctctccgcttcttcattgtcctgttttccaagccacttgatgtaatcggaataaggcttgccctgaccgtttgccggtgtcctgcctgctctgagcgcttcatagttttggaacaggcttttcatgaggacgcccatgctccagccgtccatcataatatgatgattgctccagacaagatacagctgatctgcagcaaggcggaaaaccgctaccttgaacaatatgtcttttgccaggttaaagccttggcgctgaacgtcttgtttgtaacgctcaatgtgctctttctggcggttttcgtctgcatgactgatatcctcataatgcacttttgttttgcgttccgctaacacgacctgacgcggtttttgcagctgctgatgcacaaataccgtacggagaatatcgtatgaccgaatcagttcattgacgcttttctcaaagatttcaagatcaaaagcgccgtgaatcccaagctctaattgtgtgaagtacgaggaagaatgcggatcaagcatcgcatgatacagcattccctcctgcattggtgtcagtgcgtacaccttttgaatcgattttttgctcatatgccacctctattagaaaatttccattaatttatccagctcatccagcgtcaaatcgtcgtcaccaagatcactcggggtcagttccgtaccatcttgagataggcaatgttcaatgattctgagaagatgcgctttaaagctgtcactgaatgtttgtactgttttttcatgaaattcaagagaatgataggccagtgacatcgtcagttttccgttttcgatatatccgacaacatccagcgcattcggtttttctgtttcagggcttaatgactgtcctgatggcagctctgatctcgtaaacaaacctgcatccgacatttcgtcaaactgacctaaatagttgaagctgacatccggctgaatcgagaacgccacatcttctttatgttccggtgccgtcagatagcgcagaatgccgtatccgactcccttattcggcacatgtctgatatcttctttcatttgcttcagctggtagcccagatcatccgcatgcttcatatcgagcaccattgggtacatacttgtaaaccagccgactgtgcgagaaatggtcaggtcttctatgatttcttcacgtccatgcccctctaaatgaacacttactcgatcttgacccgtccactccttcattgccaatccgaatgccgtcagcaaaatatcattcatttctgtgtgatatgcctcatgcacctttgtggtgagctgttctgtctcttcagcagtcagcgagaattcaattgtctttgtatgtttcattcgctgatcaccagattcgcggtctttcggaagctttgccgcaacagcttgttcttcaagctgtctccaatactctttttctttcaaaaaggctttggagttcgcgaagtcttgcaatctctctgcatactctgcaaatgaatgtgttttctgcgggagaaccggttcattgccttgctcaagctgtgtatataccgcggcgaaatcctccagtaaaatccgccacgacacgccgtcaaccactaagtggtgaatggcaagaagcaagtgatctccgtcttccgcttggaacaagcctgcttttaacaagccgccttcctgcaagtcgatgctgctttgcaaacgctccgcttctctctctattcggtcttcgtaatctgcagcttggccctcaatctggatgacctccaattgagctgaagcagcttcaagacctctgttgtattgaatgacgtcttcctgtccctcacgatagaccatgcggagcgcgtcatgatgctcgatcagcgcctgcaatgttttctccacccgttcaggatcaaagcccttcttggcgtgaagcatcacagattggttccagtggtgcttgttcgtgaagttcttttcaaagaaccagcgctggatcggcgtcaggatgacttcgccctccaccgggccttggtctgcctgtttgccttcggcacgctctacgtactgggtgagctcttcgatcgtcgggtgctggaagagatctttcatttccagcttccagccgtgctggttcaagcggctcgccatttgaattcctttgatggaatctccgccaagcgagaagaaattgtcggtgacaccgacttcagacattccaagcacgtcctgccagatgccggcaagcagctcttccatgtcggtcgtcggcgctttgtattctccgcttcccgcttcgatgtccggctcaggcaaggctttgcggtccactttgccgtttgccgtaaccggaagctcgttcagcgtcacccagaacgccgggatcatgtaatccggcagggtttccttcagtgctgatttcagtgcttctatgtcagctgattccggtgtgacatacgccgcgatcgctgtgttgccgcctttatctttgacagctgtcaccgccgcatcctgcacctcagaaagctgggcgagctggacttcaatttctgagagctcgatccggtagccgcggaccttgacctgctggtcgatccggccgatgtattcgatgccgccgcccgtccatttcaccaaatcgccggtgcggtacatgcgctcacccggcacaaacggatcagcgacaaaccgcttcgcggtttcgtcttctcgattcagatagccgcgtgccagtccgcgccccgccacgcaaagctctccggctacgccttccggctgcacctgattgccctcgccgagaatgtatactctcgtattggcaatggcccttccgatggaaagcgagccttcctccggatggatttctgcgcttgtggcaacgaccgtattctctgtcggcccgtagttattgacgagtgtgtacggctttttcactgcgcgcttcagcttgtctcctccagtaagcaatacgcgaagtgatgtgttctcaagctccatgaactgttccgcaagctgtgtcggcaggaacgtgatcgttacgccgttcgtttcaaaataatcgttcaggcggacgatatcgaggcggatcgcttcctcaatgacgtgaagttcggcaccgatcgtccaggtcgggaacatctcccaaatggaagcgtcgaacccaaagcccgcgtacttcgcactgcggtcctccgctgtcatgctgaacgcgtcgtggtgccagaagcacaggttcacaagcgcatggtgctcgaccatgacacccttcggctgtccggtcgttccagacgtgtaaatcatgtacgccaagttctccgcggttacagcggtttctggattttcctcgtcgttttcatcaagcggcaggcttagaatcgtgcggcttccgtcgagaagaatgacatctcccgtatagctgtccggcactgaaatgccttcctgtttcaagagaagcttcgcgccgctgtcctgtaaaatatactcaatccgctgatccggatagtcaggatcaatcggcacaaacgccgctccggctttcaagacgccgagcaccgcggcggacatttcaagcgacggcttcgtgagaacgccgacgcggtcatccgggctgatgccgcagtccatcagaatccgcgcgagacggtttgccttcgcattcagctcgccgtacgtccaagactggccgttgtatgtgacagccgggcggtctttgtggcgctgggcagtctcttcgaatagctgatgaaccgttttgtctgtcggcacaggcagcgctttgcccttccatgcctcaagaagcgcttgcttttctgtctcggtgaccagtgacaggctggaaagcggctggttcgggttcccagtaactgcatctaaaagctccatccaatattgcttccatcgttcaatcgtttcctgcttaaacagagctgtattgtattcgagtacgaatgtaagccctccgtcggtttcgtcagccgtcagcgtgaggtcaaacttggctgttttccgttcaaacggatgcggctcaagctgaatccctttcattgttaaatcctttatattcgcattttgcattgaaaaaactgcatcgaataacggatttctgcttgtgtcacgctgaacctgaacatttccgatcaaatcctcaagtgggtaatcctgcgcatcaaaagcgctgagtgccgtttctttcacttcgttaagatagtcagcaaacgtcttttcacccttcggatacgtgcgcagcgccaatgtattgacgaacattccgatgacgcggctgacgtccgcttgagatcgtccggccacaggtgaaccgacgatgatatcgtcttgcccgctaatttttgataaaaacgcactgtatgaagccagaagcaccatgtaaagcgtggaatccgtttcttttgcaagcctgcgcagagcatcagctttgcctgcttctaatgaaaatgcaatgcggtctccctcaaatgtttgaacggcaggccgactgtaatcagtcggaagcgtcagcaccggcagctctccgtccagctccttcagccaatgctcttcttgcttcttgtaaagctcagactgaatgaactgctgctgccacacggcataatccttatattgaatacggagcggctcaagggtttctccgtcgtacagctttgaaagctcctcaatcagcacaccgacagatgcaccatcagaaataatatgatgcatatcgaacagcagcacatgctcagtgtctgaatgcttgataagccctattctgaacagtggaagttggtcgattttgaaaggcttaataaactcagaaacgatccgctctgtctcttcttccggggcttcgaaataggctatctcgcactcagcctcttcccagatccgctgcaccgtttctccatcttttatttcaaacgtggttctcaaggcttcatgacgctgcattaactgctgcatgacgctgttaagcctttcaacatcaagctcacctgtcaggcgcagaaccgccggcatgttatagctcgtttgcgcatcctcaagctgctgaagcacgtacatccgtttttgcggtgaagaaacaggatacgtatcttgtttctctgccgggctgatacttgcggctgtccctttttcagcagaggcaatcacctgtgccaagccctcaaccgtcggtgactggaagagatccttgagtgacagctcaacgcccagttcctgatgaaccaaggcaagcatcttcatgcctgctaatgaatgtccgccaatgtcaaagaagtggtcataagcgccgacttgttctgcctgaagtacctgtgcccaaatgtccgcgactttttgttccgttccattgcgtggcgcaacatatgaaacacctcttgaaacgttggcatcaggaatcggcagcgctctccggtcaatttttccgttccctgtcagcggcagctcgtccatttggataaacaccgcaggaaccatatatgccggcaagtccttcgcagcatgctctctcatctcttgtgatgagatgtctccttctccgacatagtaagcacacaacagtttatctcccgctccttgatcaacggcaagcacaacactttcctgaacacgatcatgggtttgcagctgatgttcgatttctccaagctcgatgcgctgtccgcgaatcttcacctgatggtcgattcgcccgataaattcgatgtcgccattcggcagccatctcgcaaggtctcccgttttatacatgcgttcgccggatgtaaacggatggggaacaaatttctcctcagtcagttctggacggttgtaatagcctttcacgagtccttcgccgctgacgcaaagctctccggcaatcccggcaggctgcacgtgtcccgtacggtcaagaatgtatacttccgtattgctgaccggttttccaatcggaacagacagcgtgtgctcctccaattcatcaaccggatgatacgtcgcgaaaaccgtgctttcagacggtccatacatatgaaggagcttgccctttccaaccgtttgcaaagcttttctgacatgctcaaccgaagcccgttccccgccaaacataatcttgcgaagcgttgacaagcatgccggattcaagtccacaagcaagtggaacaaagcggttgtaatcatgagaatgctgatgttctcccgttcaatgacgcgggacaggcgagccatgtccaaaacggtttccttcggtatcagcaccagcttggctccgtttaacaaagagccgaacatatcgaacataaacgcgtcaaacacgtaattggaaagaccgagaatcgtatcctgttctgtaatgctgagataattcgtttccttcaccgtgcggagaatattggcatgtgtcacgatattccccttaggtgttccagtcgttccggaagtatacgtcaggttggccattgctgcagaatcaagaggcagtgcgagatttcgcgcatcggcatgatagctttcttcctcatcggctagcacgataacgcccttaaattccgcttcttccgccaaagcctttaatttcctctgagtgagaagcacctttgctccgctgtcacggaagaaatgctgcatccgctgaatcggatgttccggatcgatcggaacataagccgaacctgattttaatactgccaagatcgacacaatcatatccattgaccgctcgcataagacagccgcagttctgccttcgccagctccaagagaaagaatgccgcgggctaaacgattggcccgttcattcagttcacgataagtgagtgattcgccttcatattgaagcgcagtgtggtctggcgtattcgccgcttgctcctcaaacagctgaacaattgttttatctttcggataaggtgttctgcccgggttaaactgctgaatttgcgaagcagcctcctcttcagaaagaagcttatactcagaaatcggcttctctggatcagccgcagcatcttcaagcaaacgcgcaaaatgcgtaagcagcctgtctgccgtgctttgtttaaacagctttgtgctgtaatccacatcaatctcaatgccttcatcggtttctctcgcctgcaccgtcaaatcaaatttggcaatcttgaaattggtctcttgaacagacaaggaaagatcgccgacagccggaatgccctctgtcgcgttttgaaggctgaacatcgtgtcaaacagcggatgcctgctaacatcacgcgggatgttcaaatcttcaacaagccactcaaacggatagtcctgatgagaaaaggcatccagcacccgtttgcggacacgcgagatcaattgggtaaacgtctcattctgcttcacctcactgcgaatcgcaagcgtattgacgaacatcccgataatgccctctgtatcggagtgatttctgcccgctgacggtgtcccgacaatgatgtcatcctgccccgtatactttgacaaaagcgtatagtaagcggaaagcatcaccatatataaagtggcgccgttttgttcagccaaacgattgaggcgatcctttacccccgcatccagcttgattgacacccgatccccttcaaagctttgaacaggtggtcttgggtaatcggacagaagctgaagcaccgggagctcgcctgcaaagacttccttccaataagcctggtccttcttgtacccttcagcagcctgtctgctttgccatacagcgtagtccttatactggagacgaagatcaggaagctgttcgcctttataaatgcgtgctaactcctccagcataatgccaatggatacaccgtcagaaatcaaatggtgcatgtcaaacagcagcatatgacggttctcttcaagccccagcaaaccgattctgaacagcggagctttcgccaaatcaaatgtccgaacgaatgaagccataattgcctcatctgagcggccgcctctttcaatcatttcgatgttgaaatcaacgctatcgtgaattttctgtctcggcgtgctgttttcaagaacaaatgatgttctcaatgactcgtggcgtcggattaatccctgaaatgcgcgctccagcttttgaatatctaaaggcccttccagaattgctgctgctggcatgttatagccgactcccgcatcctcgaactggctgacgatatatgttcgctgctgtgccaatgaaagcgggtaatgctcctgtttttcagcaggttcaatcaccgcaaaagctttgctttctctgtgatcagcttcctctgcaagagccgtaatcgtcggatgctcaaacaaaaattgaagcggaatctcaatgcctgtttccttatgaatctttgttaaaagggtcatggcttttaatgaatgtccgccagtttcaaagaaattgtcaaagatccccgccttctcaacgttcagcacgtcctgccaaatggctgcgattgctttttcagtctcatttcgcggcgctgtataggcagtgccgctgacagccttcacctctagtgcaaacagcttgcggcggtcgactttgccgcttggtgtaagcggaatttctgtcacttctgtaaagtaagccggcaccatatagtcaggaagctgtctggccgcatgctccctcaaaccggctggcgcaaattcgcttccaggcttctgcacaacatatgcgcaaacctcaagatttccctgttcgtcagggcgtgccaaaacaacggcttttgcaacgtctggcgcctgctgaatcacggcttcaatttccccaagctcaatccggtatccgcggactttgacctggtcatcctctctgcctaaatattcgattgttccatctggaagccagcgcaccacgtccccggtccggtacatgcgatcgcccggcacgaatggatcttgtaaaaacttctcttccgttaattcaggcaaatgtaaatagcctcggcccacaccgtctcccgcgatataaagctcacccgccacgccttcaggctgcagccggcctttttgatccaaaatatataagcggttattccccagcgctttcccgatcggcacatacgctgattgaactgcattctcagggataaccggatgaacagacgcgtcaacgcacgtttcagtcggcccgtacacattagtcaaacgcggcgctgtgccggcttctttaaacagcttcagcagcttgtccgcaacaacagatgacaggccttctcctccgatcagcatgtgcttcagttttaggccttcaaaatcgcctgctgctgccagcatttgcaaatgagccggtgttccgtccgtcgcctcaatgctgttcttccgataatatgcagtaagggcggccccgttcgtcactgttttcttcggtacgatataaagggtttggcccaaaagaagcgacgcgaagatctgcttcactgacgcatcaaagtggaacggcgcaagcaatgccatccgcagggtttggctgccgctttgataaatcgtctgctgcagagattcaaccaaatgatgaacctggcgatgctcgatcataacgcctttcgggcgtccggttgttcccgatgtgtaaataatgtaggcaaggttccgagcgttcacatctgcattcaggctttcttctgcaccttcctcaatcgcctgatctaagtcaatcagctcagcatcggcttcaggcgccgcaaccttcgattcagtcaggatgaaatccgccccgcagtcctccaaaatatattgaatgcgctcagcaggaaaacccggatcaatcggcacataggctccgccggcttttaaaattcccatgatagctgtaatcatccgttcagagcgttcaatcaaaaccgcgacaggactgtccgggccaacccctttctgtttcagcacattggcgatgcgtgcagattgctcatgtaacgttcgataggacaatgtgcgatcttcaaatacaaccgctggatgatcagaaagcagttcagccttttcttggaacagctctggtatcgtcatgtccttacggtagctcacagatttaccgccggccctcgcaagcagcttctctttctccgcatcagaaatcagtgttaattcatcaattgtatgttctggatgcgttaacgcgttctccagcatggtaatcatgcgctcacaaatcatgttgatttcttcacgtgaaaataaatcagtgcggtaatcaaaatctatggtgagtttcccagtatcccatcgatcctttacatgaattgagacatcatttaatccgctgccgctgaaaatcggctcagtcaaaaaggcaagatcctcttctttctgccactgcatcacttgatattcaagagaaaccgtgaacagcttggtcagagagctctttgtttcacgcaaatcgttgattaggagattatacggatacttttggtggcgaagtgtcttcatcagatccttcatccggtctttgacaaattctgaaaacgcctgcccgccgtcaatgtttgtccgaagcggaaccgtagaaacaaacatgccaagcatctgcttctctttcgcatttgtccggttgcccataaatgttcccgtcacaacatcattctggccgctgaccctgtacaaataggcggcgagcagcgattgaaataccgaaagaacactgactttattcgcctcacaaaacgacagaatctgctgatgaagcgcttcaggcacatctttagagaacctctcagcatctaaacttccccctgcggatgcattccgtttcaaggaaacaagttcaggcaccgattcaaattgtttgttccaaaacgccttgtccttttcaaaccgcttcgattgagcatattcctgttcagataaaacatgatcgataaatgaatgcgagattccttcttttgtctctgagccgctggctaattctaaataaatgtgcatgatcgcattcccgagaatattcatggagataccatcagaaatcacgtgatgaacatttgcgtaaaaccacacttcattttcctttatggtgaacaaggaaaaacggaacaaatcacaatcgtatagcggcaaaggtttcttcgtttcctcccggctccattgtgaaataaactctatcgcattcggatcttcagtagtgtcagtatgttttatatcaacaggccgatactcgctaatatattgaacaggctccccgttttcatctagccgcaaccgaaggcgcatggcgtcatttctgcgaataaactcttgaatcgcctgctcaacaagcacataatcaatcgcatcagctgaaaccagcttaccaatccccgcaagatttgaaatgctcgtgtgaggataaaatttttctgtgtaccaaattcgtttttgtgcatccgttaaagggtaaaaagttatttccatattgtcatacctcccctaatctttataagcagtgaacatgtgcaacgcattttctctttcttatccatatcagcttttaattcttatgaactaacagccgaaatagcccaaagtactacacttaaaaagcagtgcttccaatcaaaaaacagatggccgctattaaagcaggctgccgtcagtcagcattgcggcgtttaacataagcggataaagaccgcaagaccccaccctaataagaaaccaattttggctatttattcattgttttcaatattttttatctttctaccgttcagtttaaatgaaaaaaatgtttttatcaccgaaaaatgggtgaaaagtttcatgcgggatgccgaaagattccagtttatttacagcaatattttttgcgggatgccgcaatcatttccactaaacattatttacagaaaaataaaaatttttaaaccaaactgctgcgttcaatctttttttattgctgaatgcaatttacaatctttacatgactatgtgtaccgcgcaaaaaccgaaaaaaaggcaaaaaaagacacccttgcgaagagcgtcttacaacgattctttcatgacatttttgtcgatatcaatcaattccatatagcctttcccccactcatacatggcttcaagaataggcatgaggctttctccgtgcggggtcagagaatattcaaccttcggcgggacaactggatacacttccctgtgaacaatcatatcctgctcaagctctctcagctgattcacgaggatcttctgcgtaatatcaggaatcaatgtttttaattcattgaaccgttttgtgccttcttttcctaaatgccataaaatgagcattttccatttaccgccaatcactgcaagcgttaattccttctcacaattaaaccttttgtcgtccatccggctcaatagaatcccccccttagtaacctttttgtatgttagatacgtatcatcacttacttacttttttgcagactcttttttcattatactcactcataaaatcaagcgaaagaaatctgattgtctctcctcacagtatcctccaagtaacttgttgacttcaaagtgcctacttctcaacaaaagaaggaacctatagaatgaacaataattcgaaaaagggagtggatcaacaatggaattacagcttgcattagacctcgtcaacatcccggaagccattgagcttgtcaaagaggtagaacaatacatcgacgtagttgaaatcggaacaccggtcgtcatcaatgaaggcctaagagccgttaaagaaataaaagaagcatttcctcaattgaaggttcttgcagacctgaaaatcatggatgccggaggctacgaaattatgaaagcgtcggaagcaggcgctgacatcatcaccgttttaggggctacagacgatgcaacgattaaaggcgcagtagaagaagccaaaaaacaaaagaagaaaatcttagtggacatgattaacgtgaaagatatcgaatcccgtgcgaaagaaattgacgcactcggtgttgactacatctgcgtccacactggctatgatcttcaagcagagggcaaaaactctttcgaagaattaacgacaatcaaaaataccgtaaaaaacgcaaaaaccgcaatcgcgggcggcatcaaacttgatacactgccagaagtgatccagcaaaagcctgaccttgtcattgtcgggggcggaattacaagcgcagctgataaggcggaaacagcttcaaaaatgaagcagctgattgtccaaggataactccgatgaaaacgactgaatacgtagcggaaattctcaatgagttacacaattcagcagcttatatttctaatgaagaagctgaccagcttgccgatcacattctttcatcccaccaaattttcaccgcgggtgcggggcggtctggcctgatggcaaaatccttcgcgatgagactgatgcacatgggcttcaacgcccatatagtaggtgagattctcactccgccgctcgccgaaggagatctagttattatcggctcaggatcaggcgagacaaagagcttgattcataccgcagcaaaagcaaaaagcttacacggaattgttgccgctttaaccatcaatccggaatcaagcatcggaaaacaagcggacctcatcatcagaatgcctggttcccctaaagaccagtctaacggaagctataaaaccattcagccaatgggatcattatttgaacaaactttgctgctcttctatgatgcagtgattttaaaactcatggagaaaaaaggtctcgattctgaaactatgttcactcaccacgcaaaccttgaatagcatcacacaaccggcctgaagatcaggccggttttattttttctaaaataaaactttaaacccaaaaacccgataagtaatatgacctgcaaatcgtaaagggaggaattatgttgataaaacgatttaagatgaagctaggaactaaaattctttgcctcgttttcgtggtgattcttttgttttcggcatcagttggcactgtgatgcttaaggaaattacagaaagcatgaaacaaatggcaactgaaaaagcgaaaggtgatctcgctttaagcagcacttatattgatgatgtcatgtcaggcgactggcaggtgaaaaacaataagctctataaagggcaaacacaaatcaatggaaatgaagatattgttgatctgcttggtgaaaagacaggtgataccattaccattttccaaggcgatactcgtgttgcaaccaatgtcatgaaaaatggcgaaagagccgtcggcacccaggcttcttctgaagttattgccgctgttttaaagaaaggaaagcgtttttacggacaagcagatgtagcaggttcttcttatcagactgcatacatgccgttaaaagatcaaaatgggaacatcatcggcatgctgtataccggagctaatcaaagtattttagcatcacttacacaatcacttttcactcaattcgctatcgttcttgttatcgtcattatggtatcagtcatccttgtcttggttttcaccagaaaaatcaacaagcggctgaacgctttaaaaagcgcctttgaaagtgccggaaacggagatatgacaatagaggtgtcagacaaaaccggtgacgagctttcagaactaagcgtctattataataagatgagaatgaagctgaacgataccatacaaaccgtacaacaatcagcccttcagcttgcgtcagcctctcagcagctctcagccggagcagaggaaacaaatcaagcttcagaaaaaatcacagaagctgtacagcagattgcaaatggagcccaagatcagatcacccgaattgaaaatagtgaaagctcattaaaacaagcttcagcagacatccgggatatttctgcaaatactgccgctatcgctgacaaagggcagctcgctcaatcaaaagcagacattggacaaaaggaaattgcaaatgtacaggcgcaaatggatgcgattcaccagtcaattcagaaaagcggagaaatcatacaccagttagacggccgctctaaacaaattgagcaaattttatcggtcatcacccaaattgctgatcagacaaacctgcttgcgctgaatgcagcgattgaagctgccagagccggtgaacaaggaaaaggctttgctgttgttgctgatgaagtacggaaattagcagaagagtctcaacagtctgcggggcagatttcaaaactgatcatagaaatacaaaaggatatgaaccggtctgcaagatctgttgagcatgtgaaaacagaagctgcagaaggagtcaccatgatccagcgcaccagagatgcatttaaggaaattgcagctgcaacaggtgaaatcagcgccgagattagtgatttatcagcatctgtaacaaacatttcagccagtgcacatcaaataaatgattcctttgcagccaatacggccgacattaaagaatctactaaaaatacccggcaagcggctgcattaacagaggagcaatttgctgcaatggaggagattaccgcagcttctgaaacactttctcaattagctgaggagcttaccggtatcataagccaatttaaaatgattaatcaagccgaaaacggctgatgacttactatcattattgtaaattggcaatcgtattttgctgaaaacaaatatttcgatctgctaaaattacgatttctgcaataaactgatcgtaaaacataaaatttaaacctttacaccaaatgctttctggattactcttgtgtcagttttaaaagcgggaggtgaacatcacgacggacatcataaaaacgatacttctcgtcatcgtcatcatagcagctgcagctgtcggcctgataaaaggagactttttctcagctgatcaaaaaacgtctcaaacgaaagaatatgatgaaacaatggccttcccatctgaccggtatcccgaaactgccaagcatattaaggatgcgataaatgaggggcactcagaggtgtgcactattgacagagacggagctgaagaacgccgcgagcaatcattaaaggacgtaccttccaaaaaggggtatgacagagatgaatggccaatggccatgtgcaaagaaggcggtgagggagcttctgtagaatacatttctcccgctgacaaccgcggagcaggctcttgggtcgggcatcggcttaccgattacccagacggcacaaaggttttattcacaattcagtaaacagtacatagaggaggaacagcacattgatcaaatcatggaagccgcaagaactttcgatttcatatcatcaatttactgtatttcaaaaggattctacacctcctgtaatggattggactgacgaagcgattgaaaaaggatatgctgcggcagacggagccatttcctttgaggcacagcgaaatacaaaggcctttattctttttcgcctgaacagttcagaaacagtaaactcctacgaaaaaaaagtgactgttccttttcatgtcacagaaaacggaattcatattgaaagcatcatgtctaaaagactgtcctttgatctgcctaaaggagactatcaattgacatgctggactgtgccggctgaaatgtcagatttgcacgccgacacttatattattgatgctgtttctgtgtaatgaaaaacccctgagagaataactctcagggactctttataaactttctccgtttgtcttgatgacatcttgataccaataaaagctttttttcttcaagcgttttaaatcggatgtgctttcttcatcacgattgacatatacaaatccgtatcttttttggtagccgttcagccagcttaacagatcagtaaacgaccagctgcaatagccgattaaatcgacaccgtcactgatggcttgtctgcattgctcaagatgcgaacgcaaataatcaattcgataatcatcctgtacagtgccgtcctcaactttatcaaattcacccaaaccgttctctgttataaacactggaagctgatagcggcttgtaattcggcgaagaccgatacgcagcccaattgggtcaattgtccaatcccagttgctcgttgtcagatgcggatttttttcgttttgaacactccgggtatccccgtctcctgattggttcccttttggcctgtcgtattcattttcccttctgacacaccatcaagcggatttcgttcataggtgatcgtctgataataattgacacctacaaaatcaggcttccctttggcgagcaggtccatatctcctgcttcaattgtcggcgcccatccctgtttttccaagcagcggaatggaatttgcgggtaggttccccagcaatacatgtcaagccaccaattgttcgtaaattcttcggcgttttcaaatgccagtatatcctctggatgacttgataaagggtaagccggagaataagcaaagctaggacctattttgccttcaggcacatattctctaaatgattcgatggcttttgcattagccagaaacgcaatatggtttgcttcgtaaaatcgttttctgtctttcactccaggcggatgcatggctgtaataaatccgtgattaaaattgtagttctgttcgtttaacgtaacccaatatttcaccctgtctccaaaacgtttataaagagtaatacagtagtgattaaaatcctctatgatgtttctggattcaaacccgccgtattcgtccataagcgcttgaggcaaatcccagtgatataaagtcagaaccggctcgatgtgatgagaaagcaattcatcaatcagactatcgtaaaacgctagacctgcttcattgatctctccttttccttttggaaaaacccgtggccagctgacggaaaatcgatatgcttttaaccccatctcagccatcagagcgacatcttctttaaatcggtgataatggtcaaccgcaatctcgccattggttcctttaaacgttttgcccggtattttcgtaaacacatcccaaacagaagggcctttgccatcttcattccaagcgccttcaatctggtacgctgcagaagcagagccccacaaaaaaatgtttcggaaaagattctggatgctggtggatcatagtgtttatcactcctgaattatttgataaacctatcataggctatgaaacgcgtttcatatcaactcgatgttagtcgcggaacagctcagctaatattgcctacctgtaaataacgcaaaagcacccaattcccattggatgcttaaaatcttaatgtcttttttcaaatttatgcggatgaggatggtgctttggaacaaagccgttttgtttcatcatttcaaagtgtttgtccaagtgatttttgatgtgttctcctctttctttaggcaggataccgtattgtacatactttgagatcacgtctttgcgctttttaagaatctctgcttccagttgttcaatctctttcttttgctgatctgtcagtgtaacatttgcgggagactgctgctgtttttcagcggcctcagctgtaccggtcagagaaatgacagccgctgcaatgaacattgtgataatgttgatggttattcgtttcatccattttattcctccaatcctatttttcatatgttttgctgccttgtattttttatgcataaaaataaaaagagcgaaccattattcgctctttctaatctcttcgtcagcattaagttcctcttcacctggtgtcgcataagtgacatatgttcccgcgattaaatcatgcagggtccgtttgtcttctcgtacggcaatcagaatcaggctggcgatcaagccgagtccgaaggttatacagtaaaccaggccggctacaataacccgtaaaaacattgttaacagactgacctgtgatccgtctttttttacgattctgattccgcagatcctttttccgataagataaccgcgccaaaacatcggcagcaaaatagaatacagcagaacaaccaaactgatgaacatgctgtcgtttgggtcttttcctgtaatcagccaatagatcagcaaaagcggcacggagactataatgtagtctaacaatgcagctccaagtctgatccaaaatccggctggtttgtaaatattcatttgactccccattatggtttaaatgtttccattttctttctcatcgaatatatcatatgccttaggggcatcagcaagacttaaatttattctgaagatcggtttcatgcctcttgaccatttcttccggtattggcatagatgagtgacgggtctgctgcatccttcactttcacatgcgtttccttggtacgtctggcattcatccttggacaattccttttttcatcacctcttcccttcatagacgcttttaaacacccacccatgctttttgtatacacaattcgaactttttgaaaacgcgatcaacatattgcaaccccttatgttcaatgctatctttttagttgattaacagattgggggaactataggtgaaatcattcatgcattccaaagccgttatattcagtttcacaatggctttctttcttatattggcagcctgttccggcaaaaatgaagccgattccaaggatacaggctgggagcagattaaggataaagggaaaatcgtagtcgctacatcaggtacgctctatcccacttcttatcacgatactgactctggctctgataagctgacgggctacgaggttgaagttgttcgtgaagcggcaaaacgcttggggctgaaggttgagttcaaggagatgggcattgacgggatgctgacagcggtgaacagcggacaggttgacgcagccgcgaatgacatcgatgtgacgaaggaccgtgaggagaagttcgcattttccactccatataaatattcatacggcacggcaattgtccgaaaagacgatttatcagggattaaaacgctcaaggatttaaaagggaagaaagcggctggcgcggctacaaccgtctacatggaggtcgcgagaaaatacggcgccaaagaagtgatttatgataatgcgacgaatgagcaatatttaaaagatgttgccaacggacgcactgacgtcattttaaacgactattacctgcagacacttgcgctcgcggcattcccggatctcaacattacaattcatcctgacatcaagtacatgccgaacaaacaggcccttgtcatgaaaaaaagcaatgcggcacttcagaaaaagatgaacgaagcattgaaagagatgagcaaggatggctctttgactaaactgtcgaaacaattcttcaataaagcagatgtatcaaaaaaaattgatgccgacgttcaggacgttgatttgtaatcggacgccatgatcaatagcattcagtgggaatatattttcaacacgaagctggccattgaatcgttcccttatgtcataaaaggcattggttatacactgctcatctcttttgtaagcatgtttgcgggaactgtgatcggcctgttcatatcactcgccagaatgtctaaacttgctttgttaagatggccggcgaagctctatatctcatttatgcgaggcgttccgattttggtgattttgtttatcctttatttcgggtttccttatatcggcattgaattttccgctgtcacggctgctttaatcggctttagcctaaacagcgccgcctacattgcggaaattaaccgttcagccatttcatccgtcgaaaaaggacagtgggaagccgcatcctcgctgggtctttcctattggcagacgatgaggggcatcattttgccgcaatcgatacgtattgcgctgcctccgcttgccaatgtattgctcgacttgatcaaggcgtcctctctcgctgcgatgattacagtgccggaattgctccagcatgcgaaaatcatcgggggcagagagtttgattatatgaccatgtatattctgaccgctctcatttattgggccatctgctccattgccgcggtctttcagaatatccttgagaaaaaatacgctcattatgtttaaacaaacgtttcattaaaaaaagccgttccccatggacgctttttttctattgattcagcttccatttaaacgggtcctcaaacagcgaccagtcggaatcaaattcatactcagtcaacaggcattgatcaagctctttcgtgatcgtttcttcatccaggtcagttccgataaaaactagctgcgttaggcggtcgccgaactccgggtcccactcctccaggatttccggctcctgctgtttgacttgctcctgctcaagcttcggcaacgccgccacccaataagatacaggctcaatcgtaaccgacggacctgcttgcgacatcagcaaagcgaggttgttatgagatgcgcaccagacgattcctttggcacgtaccacgttctttggcatttgatccaaccaacggtaaaatcgtgtagaatgaaacggcaaacgtctcttatatacaaatgaagagataccgtattcttctgtttccggggtgtgttccgcatggcctgccgtcagctcttgaatccagccggccgatccgctcgcttcctcgaagttaaataaccctgtatgcaaaatctcctgcggttttacatttcctttgacggaacgaatgaacctggctcttggctgcagtttacgaagaacgttttcaagctgttcgagctcttgctcgctgaccaaatcacatttatttaagatcagtacatcgcaaaactcaatttgatcgatcaagaggtcggcgatttctctttcatccttttcccccaatgcttctttgcggtccagaaggctttcgcctgactgataatcatgccaaaaacggttggcatcaacaaccgtcaccatcgtatccagctgacagaattttgtaagatcgattcccatctcttcatcgatataagagaaagtctgggccaccgggatcggttcgctgattcctgtcgattcgatgacgatataatcaaaccgtccgtcttttgccagcttctcaacttcaattaataagtcttcgcgaagcgtgcagcaaatgcagccatttgacatttccacaagcttttcatctgttctggaaaggccaccttcctgcttaaccaagcccgcgtcaatgttcacctcgctcatatcgtttacgataaccgctattttcaagccttcgcgattttgcaaaatgctgttcagcaatgttgtttttcccgcaccgagataaccgctcagtacggtaaccggaatttttttcataatagtgcctccattaaaatagaatgattacgatttaaattgaatacttcgccgtatgtacaatggtgtagagcagcttttcgcgctcatttctcgctgccgcccgatttctaaatcagtaaagactccaaccgcgtttaatccttttccccatcgcaaatccttgcctttgccgacagcaagatccttaatcgatgcctttccgcttttcacagatgcacagacaatgataagccatttatcataaaacgtaattgttacgatttaaattgtatggtcttttttcctttttgtcaacggttttcaattcagctgatcaccacttttgtatgttcagggatattttcatatacccatttcgcatctggaatggtcagcctgatacatccgtgagatgctttcgttcctagtttttctgcttccgttttgatgactttttgatccttagtcattggcacactatgaaataaaaattcaccgtgatttttccatgatacccagtattctgcgccttcctggtatccttcggagaaaaaccattctccccgttcaggctctacataaaaggtgccctttggcgtagcatcatcttttgtttgatcaagaccagaagaaatcatcattgtatagatggtgttgcttccttccttgatgtaagccttctgctccttcacattcacatcaatccagacatgcttctgtttaatatccgggtattctccgcccgaaggctttgtccaatcaatgcttgtttttgctgtttttcgaacgtccgttatgttttcgaccgttttctttgtattgatacttgcgtgttcttctgcatgatcggagcaggctgacagcaggatgactggcataagaactgcaataatgaataatgagagtttcatattttatccacttccttcgaaaaacacagcttcgcataggcatcgtgaagatggatcgattcttcatttcggcattcaatctcaaaggctgacacccattcaagctcaaacaaatctgcagcaatcagccgggcgagatcctcaacaaatctcgggttttcataggccgtttctgtcacggctttttcatcaggccgcttcaataccggatgcagtctcgcagaagcatttgattctgcggcgtgaagcaaatcagctttaacatcacttggcagcgatgcggccgggtgaatatccgcccaaatgctgaccgttcccctctgattatgggcactgtattcgctgatttccttggagcaagggcacagagtcgttacttttgctgagatgccggcacgctgtttaaacggctgatctttgcgataggtgacagacatgaatatatcagcatgcatcaaacccgctttctcaagcttcgggcttttccgttcgaaaaaccacggaaacctcacttcaactgtggcagatgatgtgtccatgttttctgcaagctctttcgtaaattgctgaagagaggaaaatgagagaatccagccattttgatgatagacttgcagcagctctgttaaccggctcatgttaatccccttctgatttctcggcaaattacaagtcattgtaaagttcgcagccgttgtttgctcggcaggcatcatggcagaagtgattgtgactggatgggacacattagctacacctacatgctgaatgtcaaaaaaataatccttcctgatattttgcaggtccttcattttctctttttccactggtttctcgcctttgatcggactgaccgatccaaagtattgaagacgctccgtttttttcgggagcagcgtatgttgattcattcagaaaactcctctcactaacaaatcgtaataattactatttattttgatcggttcactgttgaaaatcaagagaaaataaaaaagacacgcacaaacgcgtgtccgtcaaaatcctaaacatccgccgggctgctttccgcgctccagcttttccgccagtaatagcctgcggcaagcacaagtgcaaacgccagcagcgcgatacaggaaaacgtgataaaaccgatagcatatgtgcctgtcatctgtttgagagatcctaagatgttcggcaagaaaaaccctccgattcctccggccgcaccgacgattcccgtcaccatgccgatttctttgcggaagcgctgcggcacgagctggaatactgcgccgtttcccattccgagccccatcattccgacaaacaatagaacaataaccattgagagagatggcaggctactgactccggccatacacagtgccacgatgacaaacaatacagaaagaactttcgtgccgccgacacgatctgaaatcaagcccccgacaggccggaaaaagctccccgccgccacacataatgtaacgaagtcccctgcgtgaatttttgacagctggtattgatcaacaaagaaaatagataaaaagcttgagagcccgacaaatccgccaaatgtgacgctgtacagcaggcagaaaaaccatgtttccttttgcccaaacacatgcagatagcttttgagcggctggggagacggctgtgcaggggaatcctttgccatggatacaaaaagaataaagacgatcaataatggaattagcgcaattcccatgacaatgtgccagccgaactgctctgccagacgagggccaaacagggttgcaaacaacgtgccgctgttccccgctccggcaatccccatcgcaagtccctgcaaatgaggcggataccagcggctggccataggcagcgctacagcaaagcttgctcccgccacgccaagcagaatcccgatggcatacagctcagtcagggaacggccgccgaatgtcccccaaagcagcggaatcatcgtcaccagcatcccgatcactgccgtttttttcggtccgattctgtccgttaaaataccaagaatgatacgaaacacagatccagataaaatcggcacagctacgacaagccctttctcaaaaggagacaggccaaaatcctgagaaatataaacacccagcgccccaagcataacccatatcataaaactgacatcaaagtataaaaaggaacagagcaaagtgagtggatgaccgctagttttcagttccgacagcttcataagattcccctttctagaccctcattattttacattttctgaatcaaggatataggaccattattttctggaaaagacatgtgtaagtttttgtgacacgtttaatgcgttaacaatgcattgtgacataatttttaataggagaaaacttacgagcttcgccaaaggaggtctgatacatgaagaaacaaagattagtgttagcgggaaacggcatggccggaatccgctgtattgaagaagtattaaagctgaatcgccacatgtttgagattgtcattttcggaagcgagccgcatcccaattacaatcgcattctcttatcctctgtattgcagggtgaagcgtcactcgatgatattacactgaacagcaaggattggtacgacaagcacgggatcacgctttacacaggcgaaacggttattcagattgatacagatcagcagcaggtcatcacagatcggaaacgcactctgtcgtatgacaaattaatagtggcaacaggctcctcccctcatattctccctatccccggggcagacaaaaaaggtgtctatggatttcggacaatagaagactgccaagcgctgatgaacatggcccagcactttcaaaaggctgcggtaatcggagccggcttattaggactggaagctgcagtaggtttacagcatctcggtatggatgtcagcgtcattcaccactccgccggcattatgcaaaaacagctcgatcaaacagcggcgcggctgctgcaaacagagctggaacaaaaaggcctaacctttcttttggagaaagacaccgtctccatttccggcgccacgaaggcagaccgaatccattttaaagatggctcttcattaaaagcagacttgattgtgatggcggccggcgtcaaaccgaatattgaattggctgtatccgctggaatcaaagtgaaccgcgggatcatcgtgaatgacttcatgcagacaagcgaaccgaatatctacgccgttggtgaatgcgctgagcataacggaacggtgtacggattggtggctccgctttatgagcagggaaaagcgctcgccagtcatatttgcggcgttccatgtgaggaatatcaaggctcagcaccatctgcggcgttaaaaatagctggaatcgatgtgtggtcagcaggaaagatccaagaggatgaacgcacgacgagcatcaaaatctacgacgaacaagcaggcgtttataaaaaagcgctttttgtagatgacaaactggccggcgttattttattcggagacacccgtgacaagcagcggcttctcgacagcctgcttaaacaacgagacatctccattgccaaaaaacagatcatcgaaccggagacaagcggccctttatttgaatccatgccttccagtgaaacgatttgccaatgcaacacagtgacgaaaggcgcgattgaagacgcggtgcacacgaatagcttaacaactgttgaggaagtcaagcactgcaccaaagccactgggtcctgcggaggatgcaaaccgctcgttgaagaccttttgagatacatgaccaacagcgaatatacgaagcccgccagcacaccttcgttttgcagctgtactgattttacagaagacgacatcatcgctgagcttcagcgcaggccattcactaatccggcagaagtgatgaaccagcttgactggaaaacaaaaacggatgcagtacttgtgttcctgcgattcaatactatctggaaatgctgtaccctgggtttgtccagcctgagccagccactgaagagacatgcatcctgattccgcaaatgtacggcgggcggacaaacgcggagcagctaagaaccatcgccaacatcattgaggcatacagcattcccgacgtatccatcactcacggccaaaggctgaagctttccgggatcaagcctgcggatctcccgaacatgaaaaaagacctgaaaatgcccgtttacactaatgaacaccgacacgcgctgcaaagcatcaaagcatgtacatgcgggcaaaatcgatcgattcagcagctggcagcccaaatcgaaagacaacttgagatgcttcccttacccgctcccatttctatcagcttatcatgtgaaacagactgcaccgaggccgccctgcaagatgtcggcgcaattcggacacaagctggctgggacattcacatcggcggcgtccggggaactcatgcccgttcaggagctttgttttgcgtgactgagaacgaagacagcactgccggcatgatcaaaggactgatccagtattatcgggaaacggctcattacttagaaggtgttcatcagtggatagaccgtctcgggatcgttcatatcagagaagtgctattcgaagaagacctaagggcacagctgctggaaagcctccaaacagatctgtcactgattcaaaacccgactgtagagacgggcgcatataagaaaggatgaggcattttgactgaacgactgcttagatatttccgtgataaacagcaagacgtccaatcagaaaaaacatatgacactcaatgcccgttttgcagcatgcagtgcaaaatgcagctcgtggaacaaaccatcgtcacgcgcaaaaagtacactgcgatcgggattgataatcctacgacacagggtcggctatgcatcaagggcatgaatgctcaccagcatgccttgaactcctcccgcatcacccggccgctgctgaagaaaaacggcgagtttatgcctgtttcctgggaagaagcactgaatcatatcaaagaccaagtgacaatgatccaaactgaacacggacatgacgccatggcggtatacggaagcgcctcgattacaaatgaagaggcgtatttgttagggaagttcgcacgagtaggcttacagacaaaatacatcgactacaacgggagactttgtatgtccgcagcagccaccgcagccaaccaaacattcggcgcggacagaggcttaacgaatcctttatcagacatcccccacacccgtgtgatcattctggccggcaccaatattgcggaatgccagcctacgattatgccgtattttgaaaaagcgaaagaaaacggagcttacttcattgccattgatcctcgtgaaacagcgacaacgaaaatcgccgatcttcatctgaaaatcaaacccggcacagacgccgcccttgccaacggtctcgtcaaaatcatcattgacgaacagcttataaacgaggatttcattcaatcacgaacaaatggattcgaagagctgaagcagcatactgactcgttggacctgaatgacatcgccgaacagacgagtgtctcgctggtggatataagaaaagctgctgtgaagtttgccaaggaaacgtccggcatgctgtttacagcccgcgggattgaacagcaaaccgatggaacagcggctgtgaaaggcttcttaaacatggtgctgatcacaggaaaaatcggcaaaccttactcgggctacggggcgatcaccggacaaggcaacgggcaaggcgccagagagcatggccaaaaagccgatcagcttccaggctaccgttctatcgaaaacgaagaacaccgggcgcatattgcgaaagtgtggggaatccatcaggatgaactcccgcgaaaaggtgtctcagcctatgaaatgatggaaaaaatcaatgacggcgacatcaaaggactgttcctcatgtgctccaaccctgctgtttccagtccaaatgcaaatctcgtgaaaaaggctttaagaagactgacattctttgtcgcaatcgatttgtttatttctgagactgcgaaatacgcagatgtgattttacctgcctcctcttacttagaagatgaaggcaccatgacaaatgtagaaggacgcgtgacattaagagaagcaagccggccatgccccggcgaagcaaagcatgattggcagatcatttgtgatctcgcatccgctctcggcaagggccgctacttttcttatacgtcagcggaggatattttcaatgaattgagagaagcgagccgaggcgggattgccgattattcaggcatctcatacggcaggctcagacgtgaaggcggcattcattggccgtgtccggaatctgatcatcccggaactgggcgcttgtttacagaatcatttgctcatccggatcaaaaagcggcattaagtgtgattccaaacgaaccacctgttccaaaagagaagccgacagccgattatccgctttatttaacgacaggcagagtcatgtctcactacttaacaggcgtccaaacaagaaaaagcgccgcccttgccgcgagacattttgaatcgtttatggagatccatccgcaaacagcagcgacctacaatatcgaggaccgtgtactggtaaaaatagaatcgccgcggggaagcatcaccgtccgcagcaaattatcagaacaaatcagaaaagataccgtttttgttcccatccattgggcagacgctcaaaatgtgaatgatttaatcggggaagccttagatccagcctgtaaaatgcccggttttaaggtatgcgccgtccgaatcatacctatttaaatttttcataaaatttttagaacttttcgtatattttgttacattttataacatgtatcttaaatattcctttttgctgtgctacgctggaaaaaacatttgataaggagcggatcatctgatgggaaaaaaacagctagttcttgttggtaatggaatggccggggtaagggccattgaagagatactgagtgttgctaaagacgagtttcagatcacaattttcggtgccgaaccgcatcccaattacaaccgaatccttttgtcaaaagtgcttcaaggcgatacagatattaaagatattacgttaaacgattgggactggtacgaagaaaacaacattcaattgtatacaaatgaaacagtcatcaaagtggacacggaaaacaaaacagtcatcacagatgcagacagaatccagccttacgatgaattgatcctggcgacaggatcggtcccttttatccttccgattccgggcgcagacaaaaaaggcgtcacagctttccgggacataaaagatacagacacaatgctcgccgcgtcaaaacaatataaaaaagctgccgtcatcggcggaggactacttggtttggaagcagctcgcggactgctgaatctcggcatggacgtgtccgtcatccaccttgccccattcctgatggagcgccagcttgatgcaacggcaggacgcctgctgcaaaacgagttagaaaaacaaggtatgacctttttacttgaaaagcaaacagaagaaattgtcggtgacgaccgtgtcgaaggcctccgattcaaggatggcacaagcattgaagctgatttagtcgtcatggctgtcggcatccgcccaaatacaacgctcggggccgagagcggcattccggttaaccgcggcatcatcgtcaacgattatatgcagactgaaatcccgcacatttacgcggtcggcgaatgtgccgagcaccgaggaatcgcctacgggcttgtggcgccgctgtatgaacaggcaaaagtgctggcaaagcatatgtgcggcatcgaaacaaaaccgtatgagggctccgttctctccacacagttaaaggtatcaggcgtcgaggtcttctctgccggtgactttaacgaatcagaggagaaaaaagcgattaaagtcttcgatgagcaggacggcatctataaaaaaattgtcctgagaggcaatcaaattgtcggtgctgttttattcggcgacagcagcgaaggcaatcgcctgttttctatgattcaaaaagaagccgatatctctgaaacctctaaaatatcaatcttacagcccctcagccaggaagcaggcacaagcataaccgcagcgatgagcgacgatgaaatcatctgcggctgtaacggcgtgtcaaaaggtgcgattattcaagccatacaggaaaagggctgctcgtcaacggacgaaatcaaagcatgcaccggcgcatcccgctcatgcggaggctgtaagccgctcgtagaagaaatcctccagcatacgctcggatcagactttgatgcgtcagcgcaaaaagaagccatttgcggctgcaccacattgtcgagagatgaagtcgtagaagaaatcaaagccaaagggctgtcacatacaagagaagtcatgaatgtgctcggctggaaaacgccagaaggctgttctaaatgccgacccgctctgaactactacttaggcatgatcaatccaaccaaatacgaggatgaccggacatcccgctttgttaatgaacgaatgcacgccaatattcaaaaagacggaacatactcagtcgttcctcggatgtacggcggcgtgaccaactccacagatttgcgcaagatcgccgatgtcgttgacaaatatgagatcccgctcgtgaaaatgacaggcggccagcgaattgatcttatcggcgtgaaaaaagaagaccttccgaaggtatgggaagatcttgatatgccatcgggctacgcgtacggaaaaacgctccgcacagtgaaaacatgtgtaggcgagcaattctgccgcttcggcacacaagactccatggcactgggcattgcgcttgagaaaaaattcgaagggctgaacacgcctcacaaagtcaaaatggccgtgtctgcctgcccgcgaaactgtgcggaatccggcattaaggaccttggcgttgtcggcatcgacggaggctgggagctttatgtcggcggaaacggcggaacccatttgcgtgccggcgatttgctgatgaaggtgaaaacaaatgaagaagtcttagaatacgcgggcgcttacctgcaatattacagggaaaccgcaaactatctggagcgtacgtccgcatggcttgagcgcgtcggtttatcccatgtccaatccgtgttaaacgatccggaaaagcggcaggagctgaacggccgaatgaatgaaacactctctgtccacaaggatccgtggaaagactttttagaggataaacaaacctctaaagaattatttgaaaatgtcgtgaccacatcataatgacaaaaactatcattgaggaggaatggacatggtaaacaaagacgtaacaaaagtatgtatcggaaaaattgaagaattgcctgaacaattaggcaaaacagtgtatattgaagataaggagctcgcggttttcaagctttcagacggaagcatccgcgccattgaaaaccgctgtccgcataagggcggcgtcctggcagaaggcatcgtcagcggtcaatatgttttctgcccgatgcacgactggaaaatttccttagaagacggaatcgtccaagaacctgaccacggatgcgtcaaaacatatgaaacgctgatcgaaggagaacatgtttatctcgtatattgatcaaaagaccggatcacttttctagtggtccttcattttttacagtgacggaaggatgacatgatcatgaagaacggaatcgtatatttcgtgggagccggacccggcgacccaggcctgctcaccatcaaaggaaaacaggcgctcaaggaagcagatgtgattttatatgaccggctcgccaacccgaagctgctcgaatttgcatcaccggactgccagtttatttattgcggaaaactgccaaaccgccattttatgaaacaaaaagaaattaacgccctgctggttgaaaaagcattaaatgggttaaccgtcgttcgcttgaagggcggagatccgagcgtattcggcagagtcggcgaggaagcagatgctcttcatgagcacggcattcgctatgaaatggtgccgggaatcacctctggaattgcagcgccgctatatgcgggcatccccgtcacgcatcgggattttgcatcgtcttttgccatgattacagcgcatgataaatcattaaaaggcacgccgaaccttgactgggaagggctggcccgaagcgttcaaacccttgttttttacatgggtgtcaagaacttgtcttatatttgccagcagcttatttcatacgggaaatcgccttctgtccctgtcattgtcatccaatggggaacgtggggccgccagcggagtgtgaaaggaacacttgagaacattcagcaaaaagtgcaggaacaccagattacaaaccctgcgattatcgtcatcggagacatcgtcaactttcaaacacacagctggtttgaaagcaaaccgctcatcggacggcatttgatggttgtgactcatggcgaagatgaagacccgcttgcagacaagctgcgcgattccggcgccgatctcatcgagtggccgaaatggcggaccgaaaacatgcctgtcaatgaagaaattcttcgaaagattggcacctttgaagacgtttttttcacatcgcgccgggcggtttgtgaatttttcagagcactggcttctcagaaaatcgacatccgccagctgacagccaaactgagtgcagcatctgagcaagcaaagacagagcttgagaaacggggctttcttgtcaccgccattcagcctgattcagagaaacgtcttgttgtcgggagccgccatgcagtggaaaacatgcaaaagcatgaatcctgttcgttttatatcactcatgaaaacgtcatagatgaccggttcacccacatgattcagcgtaccatcagtgaatccccgctgcacatggtcatttgcccaaacaagctgtccgttcagcaattgatcaatggtggcgaacaaattggcattttgccggaaccgtcagcaagccgccctcctatcgtctgcataggcgatgactcagctgccggcatttatggattcacagccgtacaagaacaggatgaattgctagctttcatccacaatcaacatgcagagaaaaaactccttcacacctgatggcaagcagcccttttcctcaagggctgttttatttatgcaccaattttttatgatgggtggaatacatcgccatattctcggccttagggtccagataagccttggcactgttgaccgctgtcgggccttccgtaaatccgccggcaatcaatctcagcttgctttcataaaaagccgcgtcgcccgccacaaacacgcccggaagattcgttcgcatatgtctgtcagctttcacccttccttcttcaatctccagcccccactccatcatcggcccgagatcaattttgaacccatgattaatgatcagctcatcaatttctatgtctttcctctggccagactcagtatgacaaacggtcacgcttttgatgccctcttcatctccgttcaactgctccagccgataaggcgtaagcacccgcaccgatgattgcttcattttcgtcacgctgctttccattccgccgaattcctcacgccgatgaacgacagtcacagacgccgcaatcggttcaagctcattagcccaatcgaccgcagtatctccgccgcctgatatcaccacgcgtttccctttaaacgcatcgagcttctccactccataatgaagatttttgcccgcatatcgggccgcatcctcgctgtcaaactcattgacctcaagtgtacccatgccgcaagccaaaatcacagttcttgtatagtgctttttcccttcagaacccgtcagaacaatggtgccgtcatctaggcgttcaaacccggtcacacgctgattcaatacgatatcaggatcaaacgttgccgcctgctccttcagctgctcgatcagctgctttcccgcaatccccggtatgccgccgatatcgcgaatgattttctcaggaaagaataaagacaccttccctccgagcttcggcaaaaattcgattacctttgttttcagctcccgcatcccgcagtaaaaagcagtaaacagcccgatcggccccccgcctataatcgtaacgtcatatacctcttgattctcagccatccgtcctgcctcccgttcacatctatatcaaagttttaattgagaatgaatatcaatacaaagtatatcatatttcaagggcctttgtttattcatttcttctaccttgtggtcaattgctgaaaactctataataggcaaaaaccaattgggtgaaacagatgaaaagacgagttgaaacgatcaccttcgatggcggtacactagaatattctgtgacaggcaagggaactccgatccttgtcatgcatggcgggcattcaaattgttacgaggaattcggatacacagcgttgattgaacaagggtattccatcattacgccttcaaggcctggctatggacggacgtcaaaagaaattggaaaaagtcttgccaatgcctgccgtttctatgtgaaattattagatcatctacaaatcgagagtgtccatgtgatcgccatctcagcaggagggccgagcggcatatgctttgcctcacattatccggaaagagtaaatacattgaccctgcaatccgcagtcaccaaagagtggctcaccccaaaagacactgaatataaattgggggaaattctcttccgcccgccggtggaaaagtggatatggaagctgatttcttccttgaataacgctttcccgcgtttgatgtttcgagctatgagcccccaattcagcacgcttccgtttcagcgaatcaagtccttgatgaatgaaaaagacatagaagcatttcggaaaatgaacagccggcagcgctcgggtgaaggatttctgattgacttgtcacaaaccgccgctgtctctttaaaagacctgcaagccatcatatgtcccgtgctgattatgcaaagtgtttatgacggattggttgacttgtcacatgcacatcatgcaaaagagcacattcgtggcgctgttctctgtttgcttcactcatggggacacctgatttggctcggaaaagaagctgcagaaacaggcagtatcctactcggctttttggaatcctaaccaaagtgaaacgatcctttcccctcctccgtcaaacaagcagtgcctttttttctggtatcataagaaaggcagcttaacatgagcggaggttttattgtgacagcacaatcatcttttcttcagctgaattctatttttatcagcattttaatagaagccattccgtttattctgattggcgtcatactttccggaatcattcaaatgtttgtttctgaagaaatgattgcaagaatcatgccgaaaaaccgttttctcgccgttttattcggtgcgctggccggcgttttatttcccgcctgcgaatgcggcatcatcccgattacgaggcggcttctgttaaagggagttcctctgcatgcgggcgttgctttcatgctgaccgcgcctatcattaatcctatcgttttattttctacttatattgcgttcgggaatagatggagcgtggtcttttacagaggcggactggctctcgccgtttcgctgatcatcggggtcatcttatcctatcaatttaaggataaccagcttttaaagcctgatgaacccgggcaccaccatcatcatcacggcaccttgctccaaaaactgggcgggaccttgcggcatgccattgatgaatttttctccgtggggaaatatttaatcatcggcgcctttatcgcagccgctatgcagacgtatgtcaaaacatccactctgcttgcgatcgggcagaatgatgtatcctcttccctcgtgatgatgggtctggcgtttgtcctgtcgctttgttcagaagttgatgcgttcatcgcgtcttccttcagcagcacgttttcattaggatcgttaatcgcctttctcgtctttggtgcaatggtggatattaagaatctattgatgatgcttgcggccttcaaaaaacgatttgttttcctgctgattacatacattgtcgtgattgttttagcgggatcactactggtaaaggggtgattggatgtttcgtttattggtgctgatgggatttacgttttcttttatcatctgcatgcctcaggaaatctaacaaaatatatcaatatgaaatatgcctatctttcctttattgcgatcttcctgctggccattctgaccgccgtccaagcatatctatttatcaagtcgcctgaaaaaagcggacatcaccatgaccatgattgcgggtgcggccatgatcacgagcatgaccatgaacaaaacaagccattttatcagcgttatttgatttatgttgtttttctttttcctttggtgtcaggcatcttcttcccgattgcaacgcttgactcatccatagtcaaaacaaaagggttctcgtttaaggcgatggagagcggagatcactactcccaaacacagtatttgcggcctgatgccagcctttattacgcgcaagacagctatgacaaacaaatgaaacagctgtttaataagtattccagcaaaaaagagatttctctgaccgatgacgatttcctaaaaggaatggaaaccatctataactatccgggtgaatttctcggacggacgatagaatttcatggatttgcttacaaaggaaacgcaattaacaaaaatcagctgttcgtattaaggtttggcatcattcactgtatcgctgattccggcgtgtacgggatgcttgtggaatttccgaaggacatggacatcaaggatgatgaatggattcacattaagggcactctggcctcagaatattaccagccattcaagtcaactctccctgtcgtcaaagtaactgactggaataccattaaaaaacctgatgatccgtatgtttacagaggattttaagtgaagacgaaaccagtacaagtactggtttcttttttatttctttttcatcagcatcaaatcgagatagagctggcaccgcgttctgaaatcgcttaaatcgatcgacgtcatctcagtaatctgtttgatgcggtaattcaatgtattttggtgaataaacagctgttctgccgctggttttgttttgcagttgttgaggagatagatttccaaggttttgagcagctcagtgctgctttcttcgtcttttgcttttaataaagctaaatctttattctcgtattctaaaaattcatttttctgttcgatgctttctaaatagcggtaaatgccgagtttggcatattcatatggaatgttttcctgattgccggtgatttctgcggctttgatgacttcaagtgcttctgtgtagctcttgccaagttttaataggtgattatattcgtttccgataccgatataaataggggtaggtattttttgaaagtgaaaatgtgttaacagcttgttaataaactcagaagctgctgaggagacggagcttttttgggaaaaactcgctacgacgatgacaatgtttgattcgatcgttaagacatgactgaccttatcccgtaaattcaggtacgacctgatattttcctttaaatcctcaaccgcttccccatccccatttgcggcgtgcaggataacaactgaaaacatggaaggcagcacggtgttgatcctttcagcttcccgtctgagttccttctcagaggtaaattgctgatagatcgcccgtttgatgagatcctctgctttttcttccttttcctgtttcaatttattcgttttataaatgattttcccgacatggaaggaggtctcgtacaaaaagtcgagctcttcatccgtcagattttggtccagctcctgaatccagatgtagcccatgacttcccctttgtgctttgcactcacgaccaccctctggtttaacccaatgctttcaattttattgacgcgaaaaggctcaggctctgttttcaatttttcaataattccgtccttcagaaacctctcaaaaatctggaccggacactttttcgaaaaaatagtctgctggttggcagaatcaaaatggttaatatagtaagaattataggctaacaaaaagaaatccgcgctttccagtatcactggcttttgcagttcatagctaataaaatcaattagcttatcaacatctgaaaatgaaaaaactctctctaaaagctcttccatacctttttctcctatactttttttactttaatcatatccatacggggtctttttgtatagaaaaaaatacgtttgtttccaaaagaaaaaaatggccgcttaaaaggagaaaagaggaaaaagggacagccccttcctcctcctttcgatctttattgcgacattgtatcttggtagtcgttgaactggtctgtgacagcttgtgacggagcctgcgtcaatatgctgacaaaaaagacagataatagactcgcagcaaaaccaggtatcatttcatacagaaagtccgaaagaccggcattcgcccaaatgattacagtcgctgctcccacaatcatgccggcgagtgccccccatttggtcattcgtttccaaaacagactgagcagtacaactggcccgaatgatgcaccgaagcccgcccacgcgtagctgaccaatccaaggatggtgttatttttctcccaagccagaaccaacgcgacaattgaaacagccagaacagccagtcggcctaaaaacaccagttctttatctgaagctgagcgtctgaacatcgacttatacaaatcttctaccagagagcttgatgtcacaagcagctgggaagaaattgtactcataatcgcggccaaaatcgctgaaatcagaaaacccgtgataatcggatggaacaagatattccctaattgaataaaaatcgtctctgggtccttcagtgtcatgccgcgctgatggtaataagcgattccgcccaaaccggtcagcactgcgcctactgcagacaaaatcatccagcccatcccaattctgcgcgctcttttgatctctttgacagacgttatcgccataaaacgcacaataatatgcggctggccaaagtatcccagcccccaggcaaacaaagaaataatgccaaggacgctcgttcctttgaaaatattaaacatatcaggatctacagagcggatttcagcaactgtatcacctgctcctcccgtgtggaaaaacgtaacgatcggcacaagaatgagtgcggcaaacataataatcccctgaacaaaatctgtccagctgactgccaaaaagccgccaaacagggtatatgccacaacaacacccgtcacaatccacaggccggtgtgataatccatccccaagatgctgttgaataagacgccgccggacaccattccggacgatacataaaacgtgaaaaagactaaaatgacaattcccgaaaacagtctgagaagctttgtttgatctccgaagcgattttccaggaatccgggaattgtaatagaattccccgctttttcagtataggttctcagccgtggtgcgacgtaaagccagttcgcccacgctccaaggcaaagtccgatgacgatccaagcgccgctcagaccagtagaaaacatggcgcccggaagccccattagcagccagccgctcatatcggcagcgccggcactgagagcggttactgccggacccaaagagcgtcctcccagcatataatccgtcagattcgacgtacgcttgtaagcaaagtagccgattagcagcattcccgccatataaatacaaatcgaaataatcagctgtgtgttttctatggcacttcctcctcttttttatagtatatggatgaaatggacacccccgcagggaggatgcccatttagtcccgcttagaacatttcactgattgtttttgcttgcatatgcagagccaagtaatccggcccgcctgcttttgaatccgttcccgacattttgaagccgccaaacggatggtagccgacgatagcacctgtacagttgcggttgaagtataggtttccgacatggaattcctgtttcgcacgctcgatgtgcttgcggttgtttgtgataaccgcgcctgtcaaaccatattcagtattgtttgccacttctaaagcttcatcaaagtctgacactttacaaaatgcaacgacaggtccgaaaatttcttcctgcatgagtcttgctttcggatcaaggtcagcgaagatcgtcggtttgatgaagtatcctttcgaatcatcaccagtaccgccgcttactaaacgcccttcctgttttccgatctcaatatagctcataattttatcataagaaccttggtcaatgacaggtcccatataaacatctgcactgtcaggtttagctgttacttttgattccgtaatttcaatgacacgctctaatacttgatcatacactttttcatgaactactgcacgtgaacctgcagagcatttttgtcccgcaaagccgaatgctgaagtaaagatcgattgagccgctaattcaatgtccgcatcctcatcaacaacaaccgtatctttaccgcccatttcagcgatgacacgctttaaatgctgctggcccggctgaaccttcgccgcgcgttcgaaaattctcgtaccaacttctcttgatcccgtaaatgtgataaggcttgttttcggatggtcaacaagatagtcgcctacttccgctccgcttcccggaacaaagttgactacgccttttggcaatccggactcttcaagcacctcaacaaattttgctgcaataacaggtgtagcactcgcaggtttcagaaccactgtgtttccagtaacgatcggcgccactgttgtgcctgccatgatcgcaaacaagaagttccaaggcgggataacgactgtcactccagtcggcgtgtatacatattggtttttctcgccttcacggctgttgaccggtttgccttttgccagttcgatcatttggcgtgcataatactccatgaagtcaatcgcttcagccgtatcggcatccgcctcgttccaaggctttcctgcttctttcacaagcaaagctgagaattcatgttttcttctgcggactttggcagcagcgcggaacaggacagccgctctctcttcaggagacgtgtatctccactcttcaaatgcttttgcagccgcttgaatcgcttgctcagcgtgctcttgagacgcttttgacactcggccgacgacttcttctttatcagctgggttgattgaaacgattttcgcttccgtttccactctctcgccgttaatgacaagcggatagtcttttcctaaatattcgcttactgtcgcaagcgcttttttaaacgcttccacgttgttttgatcttggaaatttgtgaatggctcgtgtttgtaaggtgttgtcatgataatctctccttttttacttctttgtcattcctttgaaagcaaatgcaatgtttgacggacgttctgcaaggcgtctcataaagtagccgtaccaatcctcgccgtatggcaggtagactctcatgttataaccttcttttacgaggctgagctgggtttgcgaccgcatgccgtacagcatctgaaattcaaacttgtcattggcaatgccatgttccttggcaagctgctttgtaaagtcgatcattttgtcgtcatgtgtggcaatcgctgtatagtgaccgtttaagagctgctttcggatgatttttttgtaattttcatcgacatcgcttttctccgggaaagctactttttctgattctttataagctccttttacaaggcgaaggaacgggtttaaagaatccaaatcgtcaatgtctttttccgtccggtacagataggcttgcagcactgtgctcacatgctcgtatttctttctgaaatctttgaaaatatcaagcgttttctggcatctgacttcgtcctccatgtcaatggtgaccatgattttatgtttctcggccgtctgaaggatttttgtcatattttcatacaccaaatccatatctatatccaaacctaaagacgtcatttttaaagaaacgtgtgagttcagctcctgatccgcgatggtcgcaatggtttgaatgcactcttccgtacgctcccgtgcgacctcggcgctgttcacaaactcgcctaaatgatcgacagtaactgacaagccttggctgttaagctgtcgaatggtcgggattgaactgttaaagtcattcccgccgataattttacccgctgctacccgacttccccagttcctcgccattttattgagaaagccgcttttggataaaaataagaaaaaatctcttgtgatcacttccaacctcaacaccccgcaatctaagaagtatttgtatgagtttattgtaaatggacaaaaccagcgttcacaatattctcaaaatacaaagattctgattatttttgtgggtttgccacaatcagatagttagaaagtcggggggggattctgtcgaataaaggagaaaaggaagcgacaaaaaacatcagcttcctccatccttccacacttcttcaaccgtattcaaaagcaaacggttcaattcagatgtcatatcttttttctctgccttcagttcttttgccgcttccatgattctttcgatttccgtttcaatgaattggtgaataacatcgattcttgcttcgaggtcaagctcttcccctcttcttttccgttcaagcaaggtttccatttcagccttcagctcgggttcagcaacaagttcattcatcaaaacagtaaagtccattggcggtatggttccgtgcttttcaatccattggcaggccaaaataggccgaagaacgtagaagtactttttaattttgacctcttgtccttgtagataatccttgacgttccttctcgccatattgatatagtgatacacgcttgcttcaggcttaaatgcctccgtgcggagttttcttaactgctctgcggtcgtaaatgcttcataatacacaatgtctgaggacagccattcgagtagcggagggtttgactttttgaaaagccgaagcgtttttctcagctcccagccgctgatatccagcaaatcgtgaatcggttcctcaatgacatcacgctcctgctcaattgaaaagtaccactcctttttcggaacataaataaagcggacgtcgtaatcactatcctgcgagggaaatccccatgcgcggcttcctgactcgacggcatacacgattttgactccgtatgactgctcgatccgttttaattcatcaatgattctttgtttcatatctattcgtctccagtctgttctcattccggcagtttgcagaaaaaaaccgcctgatgatatgcggcggcttttcacatttatcagcctttaagatgctgcttaaagaaagcaagtttttcagtttgaaaagcagggatatactcatgtccgaagtagcggtacaccttcagctctttctttgtttccaaatgattgtaggcggcaaacacggtggacggcggcgtgaccttgtcaatcaggccgattgacatcaggacaggcaccttcactcggtcagcgagattcataatatcgaaatatgaaagtgtcttcatcgcctgcacttctgtttccgggctgccatttcttctgaagaaggaattgatttcaaggtacggctgttcaagcgccacatcaatggcccgttcgaagttgcttaaataaggataatcggcaaccgcggcttttggaatgtctgacagcgctgctgcggcaatggttaaacctccgccttggcttcctcctgtcacaccgatccttgtttcgtcaacctcgtcgaagctgctgatgacctcaagcgcgcggacggcgtccaaataaacaccgcggtaatagtatgtatctttatcaagaattcctttcgtcatccagcccaaagcgtgaccgtgcggtgaaatactcgtatcctcgctgctctgctggccgcggacaagcatgccgaatgtggcgtagccatggagtgcccagtttaccatttcatgaatctcaccatcatagcttgcattgtagccatgatatttcacgatcgccggatgcgggccttccttgtcaggcaccgcgtaccatccggtaatgcgggcgtttccgaagcttttatatgtgagacggtacacttttactccgtcagcaggatagtcaaccggctgtaaatcaggttctgcttggacttttgcaagttcctccaaagacaatttccaaaactcagaaaaatctttcggtgctgttttttcaggcttatatgtttgcaattggtcgagcggcagatcgaatagttgcatttccgattattcccctttgttttataagatttagtttgtattcctatactaccacgtttcgtctttgttttctaaatattttcatctttgtttcccagacagccttcatcaaacgtttgtttaagactttcccggcttagttccataaaggcctgggccgtcagactgacatagcggttctttaaaaagacaaagacgagggttcgtgatggcgcggattgaatcgataaatagatcacacccggatctttatcccttctgaccatattcggtgccattgtcacacctaatccgttagccacaagagattgggcggtttcaatatggctcgtcttaaaggcagcattcggcttaaagccgctttccgcacagagatcgagaactgtcctgcgaaagccgaagccttcttttaacagaataaagggcacgttccttaccatgtcaatcggcacacacggctggcgtccctcatcttcttccagcgctttctcaatcagcgcgaccaattccggcggcatccacctttgtttttccttcggcaccgcgagaacaaccggttccgtgagcaagggtgtaatggagagccgttcatcctcgatgggcaaggataaaacagaaaggtcaacttctccctttgccgtcatcttctctaatgaaaccggatctttttcaacaagctgaacctccacatgaggatagcgcgccaaaaactgcttcagcagcggaggaaagagatatctccctgttacagcaggaatcccgatggataatttatgaccgattccctgtgatcgctcctgcatttcccgaagcaaatcatctctggaacgaatgatgtcctcggctttttcaatgaaacgcctgccgtgaggtgtcagtgtaacagagccatgggatctgtgaaaaagggtaagccccagctcagcctcaagctttttgatttgctggctgagagacggctgtgcgatatgaagatgttccgccgcctttgtaaagctttggcgccgggcaatttccgctgcatattccatcactttaatatccatttcagcctccataggttgaacctatcattttcatcatttttatatcttggacgaatcataacagaaattgctaacataatccatatcatcatttacgaaaagaaggagctggttcaaatgacaaatgaaacaccgttttctaaaaacgccgagatgtatcgggatgaaaaggtatttgccgagggggaagatttggggttgatgatcaaaacagcggaatgccgggcagagcatcgagtgctggatataggagcgggcgccggccatacggcgctggcattttctccttatgtacaggagtgcatcggtgttgatgcaacgaaagagatggttgaggttgcgtcctccttcgcgcaagaaaaaggagttgaaaacgtacgctttcagcaaggaacggcagagtcactccccttccccgacgattcatttgacatcatcacctgccgatacgcagcccaccatttttcagatgtccgcaaagctgtcagagaggttgcacgcgtactaaaacaggacggacgttttctcttagttgatcattacgcgcctgaagatcccgttcttgatgagtttgtcaatcatttgaaccggcttcgagacccttcccatgttcgtgaaagctcattatcagaatggcaggcgatgttcagcgccaatcaactggcctatcaagacatccaaaagtggaacttgccgattcaatacgatagctggatcaaacgaggcggaacccccgctgaccgagaaaaacaaatcattacccacttgaatcacgcatcagacgaagcacgcgacacgttctgtattacattgaaccaaaacggacagcccatctccttttgtttaaaagcgattttgatacaagggataaaacgataaaaaaagccgtgcgctgcgcacggctttttacatcggctgataaagatcccagccaatttttaatgtctcaacaatgtaatcggcaacctcttccggggaaaggttgtctgttgccacttttgaattgtgcttgtcataaatgacttttctttcgttaaacagctgttccatttcatccattgaacggttatgcagtacagggcggctttcgatcaataaatccgcgcgctgcttccagttctcccatgacaggtccagatgaagcacgagacagttttccagacagcaatttctgatttcttcttgtttaaaagatcccccgcccagagatacgattttgaatcgtttatgatggcagatgtctaaaatatattccttctccgttttccggaaaaagtcttctccctttttctcaaatatctcaggaattgacatattgaaatccttttcgatctgctggtcaatatcaataaaatctctatataattttttagcgaccaattggccgattgttgtttttcctacacccatgaatccgatcaggacgatatttctttctcttactgggatggctcgtttagcgttcatcttcggcgaaatcctcctaaggaatgaaattatatattcattatatgcttatttagcgaatatttatatagataccggctttaccggtcaagcttatagtgcgctttgttgtagccatttttgcctgaatgacattcattgtacaacatttctgcaggtattttaatacttcgacgcaaaaaagcgttaaaaccttccgcctttattgtttttccagctgactcttcgatggaagggtctttttctgtatgataaataggaagggagaaatggcgatgatcatttggataaacggggcattcggttcgggaaaaacacaaacagccttcgaactgcacagaaggctgaacccatcttacgtgtatgatcccgagaaaatgggttttgcgctgcgctccatggtgccgcaggagatcgcaaaggacgattttcaaagctatcctttatggcgggcgttcaattacagtttgctagcttctctgacagatacataccgcggcatccttattgtgcctatgacgattgtacaccctgaatacttcaatgagatcatcggcaggctcagacaggaaggcaggatcgttcaccactttacactaatggcttcaaaggaaaccttgttaaaaaggctgcgcaccagagcagaaggaaaaaactcatgggccgccaaacaaattgaccgctgtgttgaaggattatcatcacccatttttgaggaccacattcaaacagacaacctgtcgattcaggatgtggcagagaacattgccgcgagagccgaactcccattagatcctgatacaagaggcagcctccgaaggttcgccgacagattaatggtaaagctgaatcatatccgcatcaaataaagcttctgtacacgacaaaagcccgctccgagagcgggctttcttcaacttatttccaccagtcatcaaacatagacgccggaacctggcgtttatgttcagtcatgctgtagcgtttttccagcgcttctgatactttcgctgatacttcttttccttcgagataatcgtcaatctcgtcgtaggaaatgccaagctctgtttcatccgactgctgcggtttttcgtcgagcagatcggcagtcggttcttttaagtataagcgttccggtgcacccagctctttcagcaaggttcttccctggcgcttcgtcaagcctgtcagcggcaggaggtctgctccgccgtcaccgtacttcgtaaagaaaccagtcactgcttcagcagcatggtctgttcctaacacaagaagaccttcctggccgccgatcgcgtattgcgcgatcattcttgttcttgcttttacgtttcctttattaaagtccgtcagctgatcgcctgtttcctgctgatactgatcagaaaaagcgctgactgtcgatttaatatcaaacttccatgatttatccggcttaataaacttcaaagcaagctgggcatcgtcttcatcctgctgtgtgccatgcggaagacggaccgcgataaattgagcgtctccgccctcctcgcgaatgctctccaccgcaagctgagcgagtcttcccgcaagtgttgaatcctggcccccgctgattcccaatacaaagcctttagcaccggttttctttacatattgttttaaaaaattgactcggtcctcaatttcttgctttggatcaattgagggcttcacatgtaactcacgcataatcttttcctgcatgctcatcccaatcattcctcctgtacattttcccttattactgatcatttccctaaatcaatgaaaatgaatcatgactgttatgtatccctattaaatatagcacaggtcttcattcactgtgaacaagagagatcagctgacttcaacccgtatggatgtcacactgtcgccattgcatttccctttttcaatcgggcaggaagaaaacgcgacaattaaatccatctccgccctgagccttacataatctccggcattcgaaagcggcgtttccacagacagattccctttctcatcaaggacagtattcataaaaatcgcaaatgggtaatgcatgtggggcttcggtacgccaaactgctcaagcgcacggttcatattgtcatagcacgtatcctgaaactcatccttttgcttcccatataagagcctgttcatatcaggacggcaggcgggcaacagcagatcatgcttgccgaccgtatcttcaatcagggttaacatcggcttatacaggttggagtagagatggtcgttgaccttcacatgaatggagtgattggcgtctatcgtcgctccctgatcaaggtgttcataaaaatccttggcatggtatgcgacaaaatcagccacctgctgcccttctacatcaaccacctttaaaatctgcccctttttcagcttcagcccaagcccttttttcggctccacaatatattgctgtgtcattggtttgctccttttttcattagtatgagcgtctgcttccttctccatgtaaaaagaggcaaaaatccgatgtatataagctttggacagatcacaatctaaccttagataaaaggggttgaataaataatgagccaaacaaaaaaagaccagccaaaagggaatctggcttggtggcagctgtcactgatcggagtcggctgcacgattggaacaggcttctttctcggttccagcatcgcaattgtaaaaagcggtttttccgttctcctttcatttctgatcgcagggatcggtacgtattttgtctttgaacagctcgccaagctatcggcgaagcagccggaaaagggctcgttttgtgcgtatgcccgaaaagcattcggcaaatgggcaggcttcagcaacggctgggtgtactggacatcagaaatgctgattaccggaagccagctgacagccatttcgctctttacgaagcattggtttcctcaagtgccgctatgggtgtttgcctcaatctacgcagtacttgggctccttattattttcaccggcctgtccgtctttgaaaaaacagaaaacgtgctggcagtcattaaaacagctgctatttttatgtttattgtcattgccatcctggctttatgcggtatcctgtccggcggaaatcatggcatacatgttccaaataagacgagtgagtttttcccatacggcgccatggggctgtggacaggtttaatctacgcgttttacgcttttggcggaattgaggtcatggggctgatggcggttcacttaaaaaaacctgaggaagcgtctaaatcagggaaactgatgctggcgacgctggcgattatttatatcatttcaatcgggcttgctctgcttttggttccgttacacacgtttactgaacaggacagtccgttcattacgtcattaaaaggatataaccttgagatcatccttgatatatttaacgggattttcatcatcgcagggttctcgacccttgtcgcttcgctatttgcggttacgacattgctttgtacaatggctgatgacggcgacgcgccgaaatgctttactctaaaggaaggcaaaaaaatatgctggccggcacttgggctgacgtttgcggggcttgtcctctccattattttgtcgttagtgctgcctaaaaacatttatgagcatatgacaacagctgcggggcttatgcttttatacacttggctgtttatcctgttctccagcaaaaagctgactgatcccgagggcatgggaaaaacgcaaatttatttagcgatggttctgattgctgcagctgtgtccggtacattgtttgaaaaatcaagccggcccggttttttcgtcagcataggttttctcgtgattatcgccatcgttaccatgatctatcaaaaaaagcagggtcataaagatcgccctgccagtccttgatttatttcattttgttgaacatgttctttaaataagaaaacgggcacttcgatacctgtttttcgtcatcacggaggaaatactgcttccattcacgattatcttttcctccgtaccagcctaattgcgggtgaatcggagcctgatcataggcctctaaacgagatcggatcagcctgctcatgttacggccaaatgcagttgatccatttaggtcatcaaacacccaccttggctgaaacgtgaccataaaaaaaggaaagctccggcttcttcttgcctcgtgccccggtgtagcgcacagaatgaaatacggctcgccgtcaaaacaaaactcccatttataatgctcaggatcggccggaatgtcttccggccattctttttcgtcttgatgactcagtctatttaaaaagcgccaaaacagctcttcatacgcttcaatcgaataatgctccgccaaatcttccggtgtatcaaacaacacaacgagggatgcgtattttcccgtgtcccgcgatatcttgccgtactccgcaagcaacggagccagttcctccgctgtgcggttttcccgcggatctccggcaaaagcaatccgaagctgatcagtcagaaacgcctggcgtccgggaatgcacggaaatgtatccgcgtcgtcccccagagtttctgccagcagctcaaaagcgattctttgccattcaggaagctcttcctgaatacgttccagaaaacttttggtgtaaatcccattcaccattgatccacctccagtatcatctggatactatattaaaactggaagcggcaggtgactgtccttcatgaatcagcccaataactgtttgatgccctgataaccaaagtaaaagccaaacacaaggagggatacaccggcgattccggtcaatcctctcaatagcttttcatgaagcaggtttctgaacgtactggctgtgatagccatgcagaaatcccagattaaaatgccgatcatgatgccggagctatagattagaagctgattcatattgtaggcctctgctgttttcgcaagaatgcttccgtaaattccaagccaaaaaaggatgctcaatgggtttgacaatgaaatgagaaaacccgatgcgaatgttttcctgtatgacggtttcccccgcgagcttcgcacatccatcggttctctgacgtttttcagcgtttcaattccggtataggtcaggacaaaaaagccgaacagccacaaaaacgttttcacaaatggagcggtcaagaactgcgacagcccgaaatagataaaaagcatgtacagcccatccgctgtcatggcgcctaaaccgaaaatccatgcatgccaaaaaccgtttttaattcctttgtctatttgcgccgcattcactggccccacaggcgcagacaaggacagtcccagcacaatatagctcaaaaaaatgttcaccggcccgtactcccttctcttatgtaacttgtacaatttattcgggaacgggccaagctatgcacaaattcacttactgtttcagacgttcaagctcttcctccataatatcggcagctttgcctacaaaactgaaaatgagttccagctcctcttccgtatattcgcggcacaaatccatcgttgactcagacagaggacggaacaaatcctttatatgttttttcgaagcagtcaaagggacgattacgactctcctgcgatcgttcgggtccttttcacgagccacataccccgctttttccagccggtcaacaagcgccgtgacggaacccgtgctgaggccggtttttttccccagctctccggccgtcatcggccctgcttcatttaaaatgtcagctgatttcaaatcggtgggaaacagaccgagagcttgagcggctgcctgatgaaacagaaccgttcttgtgcccagttttcgaaaaagctgaacagcagtcttttccaactcacttctggaatttcttgttgacaactgacagtcctccctataaaatcgagtttatcttgataatcgagatattcaacaatcaaactattatcatgatatcagaacttacatagaaaagtaagaggaggtagaacaaatggacacaacaacagcaaaacaggcttccaccaaatttgtggtcctcggtctcctgctgggcatcttgatgtctgcaatggacaatacgattgttgccaccgcgatgggcaatatcgtagccgatcttggaagcttcgataaatttgcctgggtgacggcatcctatatggtggcggttatggctggcatgccgatttacggcaagctttccgatatgtacggccgaaaacgttttttcctgtttggacttattttttcttaatcggttctgctttatgcgggattgcccagacgatgaatcagctgatcatcttccgggccattcaagggatcggaggcggcgcgctcctgccgattgcctttaccattatctttgatttgtttccgccggaaaaacgcggaaaaatgtccggcatgttcggtgctgtatttggattatccagtgttcttggtccgctcttaggcgcgatcattacagattcgatcagctggcactgggtgttttacatcaatgtgccgatcggcgcattgtcattgtttttcattattcgctactacaaagaatctctggagcacagaaagcagaaaatagactggggcggcgcgattaccttagtcgtatccattgtatgcctgatgttcgcccttgagcttggcggcaaaacatacgattggaactccattcagatcatcgggctgtttattgtattcgccgttttcttcattgccttttttattgtggagagaaaagcagaagagccgattatttctttctggatgtttaagaaccgcttgtttgccacagcacagattctcgctttcctgtatggcggaacatttattattttagcggtatttattccgattttcgttcaggcggtctacggcagctcggcgacaagcgcgggcttcattctgacgccgatgatgattggatcagtcatcggaagcatgatcggcgggatcttccaaacgaaggcaagcttccgcaatttgatgctgatatctgttatagctttctttatcggcatgctgcttctttccaatatgacgcctgacacagcacgggtatggctgacagtctttatgatgatttcaggctttggtgtaggctttaacttctccctgctgccggcggcatcgatgaatgatcttgaacctcgctttcggggaacggcaaactctacaaattcatttttgcgatcatttggcatgaccttaggtgtcaccattttcggaacggtgcaaacaaacgtattcacaaacaagctgaatgacgccttcagcggtatgaaaggctcagcgggatcaggcgctgcgcaaaatattggcgacccgcaggagatattccaagcgggaacacgttcccagattcctgatgcgatcctgaatcgcattattgacgcgatgtcatcaagtatcacgtatgtctttttgctcgctttgattccaattgtcctcgcggcggttaccattttatttatgggaaaagccagagtgaaaacaacagccgaaatgacaaagaaagcaaattaacataaaaaaagcagtacatgctgggcatgtactgcttttttctattacactcctaatcttgcaagaataaacgtccatatacaaatgatcaataacagaatcaggctgtacgccactgtccttttaaacagtttagattccttgcctgtttggccgaccgctgcggcagcgatggcgatagattgaggagaaacaagtttcgccatgacaccgcccgccgtatttgcggctaacagcaaatctgaacccgcaccgatctgcgctcccgtgacaacctgcaaatggccgaacaaagcattattgctgacaacagaaccggtgatgaacacgccaatccagccgagaacaggactgacaaacgggaacaggtctcctgttttcgccaatgctaacccaattgaagagctgagccctgcgaagttggccagattggcaaaccccatcacgaagcagatcgtcataatcggcacccacagctcttttcccgtctccttcaaggaagcaaaggcatcccgagaggagaactttttgctgaacagccctgtcacgatgaccgccgctaaaatcgctgtaccagtcgctgacagcagatcaactttaaagactgcatctaacggcatggcagatggcgcaatcggcggcattttcataatttgctgatgcagaaaaggcattttgaacaggagcgttgattgatataacagcccgccttcttggaaaagcgctttgaaggcaggaaggctccagatggtgatcgccgcagttaaaatgtagaaaggagaccacgctttcgcaatgtcagcggcacggtatgcctttttctcaccagcatcgccggccccttcctcgcggtaaatctctttcggctgccatttgcggaggaagagggcaagcccgcccatgctgaataaggccgccaaaatgtttgctaattccggcccgagcaccgccattgtcagtgtctgaaccgctgtatacccaccgctcacaaccagaagagcgggccatgtctgtttgattcctttcattcggtctaataagaatacaagcaggaatggtattaaaaatgagatcatcggcagtgtccacattaatgtccgagacagctcaagagcagacaaatcaccaatctgcgcccctgtgatgacaggaatcccaatcgccccaaaggctccggaggcagcgtttgcaatcaagcagagcgccgccgcttttaacggtttaaaaccaagttcgacgagcagcgccgcactaatcgcaatcggaacaccaaaaccggccgcgccttctaaaaacgcgttaaaacaaaaaccaattaataatagctgtaatcgttggtcaggcgaaatgccggcaatgctggaccgaataatggtaaatttcccggttttcacggcgattttatacagccacaccgccatcaggacgatgtagccaatgggccacagcccgctcccgattcctaacaaaacagaagaaatcgctttttcaaccggcatatgaaatgcccaaacggagacgaagaaactgacggctagggtaagaaatgccgcaagaatgcctttcattttcaaaacagttaaagccaaaagaaaaaagagaatcggagtgagcgccacaagtgcgctcacatactcgtttccaaacggatcatacaactgctcccacattgacaatcagccctttactctaaagttgcggttagttgactttttgttctgcaaaatgaggttttaaaatgtttttaaggacgccggcgctgtgaaggaactgttctttttctttctcatttaagttcagctcagtgatacctgcgatccctccgcgattcacgacagccggcacaccgatgtacacgtcatctgcaccgtattgcccgtccaaatatgtgctgacagttaatatgctgttttcattatgaagaatggcttttgtaatgcgagcaagactcatcgcaaccccataataagtcgcgccttttttctcaatgatatggtaagctgcgtttttcacatcatctacaatttggtccagctcctcttgtttgtacgcatcgtttttctcaacgagttcactgaccggcacaccgccgacattcgcgtggctccaaacaggaagctctgtgtcgccgtgctctccgataatatgcgcgtgtacgttttgaggcgctgcgccaaagtattcgctcagcatgaaacggaatctcgcagaatcaagtgttgtgccgcttccaatcacccgctcttttggcaggccgctgaatttccatgttgcgtaagtcaggatatcaaccggatttgtcgcgactaagaaaatgccgtcaaatccgctcgccatgacttcactaacgatgcctttgaaaatcttcaagttcttttctactaattcaaggcgtgtctcaccaggtttttggtttgctccggcgcaaatgcagacaatatcagcatccttgcagtcttcatatgttccgtaagatgttttgaccggttgtggcgcaaacgcctttccgtggtttaaatccatcacatcgcccattgctttttctttatttacatcaatgaccacaagctcatctgtgattccttggttaattaacgcaaatgcataactgcttccaacaaaacccgctccgattaaagctactttatttacatgtttgttcatcattaatcatccttccagggtatgtttctctttgatgtctttttgtttgtgaagtatttcacatttatattgtgcaacacttcacaaacttttgcaagagaaaagttttgtctgatttatgaacaaaaaagaaaccatcattgatggtttctttcggtaagtcccgtctagccttgccctcaatggggaagagaaccgcttaagcccgagtcattatataaaccatttagcacgtaatcaaagccaggctgattctgaccgggcacttgggcgctgccattattaaaaatcacttttgcgttggttgtatccgtgtccgcaggcagcgtcagcgtgtaaattccgtctgcatttttagtcattggttttccaggccaagatccggtcaattcaattactcggctcccatcatgtttatagatataagcatttacctggctccaatgattcggattttgatagccgatggttttggccgacgctggatctcttttaacaaaactgtatttctcggtcctcgttacaccatcactgttcgttccttttaacatgatggtgtatgttttgccaaatggatctccttttccgattgtgaattgatctccatccttaaacgccgtctctggtccattattgatttgataaacggcttttgttgtattcgcatctgcacgcaaggtaatcgtcagttgatcattgaaagaatgtgttacacctgttttgtaattctcaaggaaaacatgaggcgcttttgcaatatcatcaggataaagcacagctacagacctggcattgatcgtgcctgtcagtttaccatcgttcacttgaaatgaacccgctccagctttattgtcatacctgccatcaggcaattttgttgccgtattgatagagacagaggatgaacctgcatttgccagcacaacgccatgtgagccgcgctgattcataaatatctggttgtttccattcgggttcgagagttcctcaggctgtccagccatcacattgtgaaatctattgaccgcagtgatagcctgatcttcaaataaagcactcccgcgatcgcctatttggcttttccccgggaacctcacaccatttccgcctccctcaggtctggaaaagaaaagaggcgtactgcctgaacgagaagctatcaccgcccagcctaaacggatatcatcatcgctcatccatgtcgactcttcatcatcattggcatacgtatcatgcgactctacccatgtcactagcttgtccgcagacacatcagatgcatagtgggagatattcgacacgcccagattacgattctttaaagcggaccttatggaatgcccatagttagacgctgtcacatccatataattcgcatatgcagcatctctggaggcactatcctgcaggatttctccgtattggaactctgcagatgtatttgtgatattcggccaaaattgactgccgtaactgccatcatctggaagctctatatgtttggcggcatcaaatcgaaaaccgtctgccccgtcattcaatgccctgtctaagaaccgtttcagataggactgtacttgtgtattttgtgtattccagtcatacagcccgagcaatgaattctgcgtgacatcccatcgatcagaccagtttttaatttgtgtgtttccatgtgtccagtttggaatactcttaacctcattggaaatcgcggcataatcactggtggtatgattgatgaccgcgtcaacaatgacctttatgccatattcttcagcggctgcacacatttctttaaattcttgttcagtacctaagtaacggttgccaatttgatacgatgtcggctgatacagccagtaccagttcgacatgcttttatctccttgattcccttcctttacttggttaatcggagatgtctgaatggctgtatatcctgcatcatgaatatccttcatattgtgttttaacgtattgaacgaccaattccatgcatgaagaatggttccgcttttgatcgacggtgctgtaagctcattcgatttgttcgccgtttcagcactcgcagccgccggtcctgccagaaccaaatgaaacagcaataaaaatccagcgaataacggcagtaaagaggttttgaatcgttttgcaaacattcttgacactccttatttgattttttgaagacttacttcggagtcaaaaatccctcttacttcattcttccgcttcctcctttcaaaccgatgtgaagactggagaattttgttaacgcttacatttaaaattatcacaatcactctatcaaaacaacttggcagagtgaatacaaatcaatgttcctataaaaaaagctgcccgaaactgtgaacgcttccctcgctttccaaacaaaaaagatgatttcttttttatttcttcttttaccgctcttctgtaagccagcttcacaatcacataccgaagcagaaacagaacgccgccgcagacgataaaaagaagaatcattttcagccaagcgaagaatgtatggggaatccccctgtcgtacatcgtaagcaccactaccgcaaaggcgaccgcaattgattctattcgctgctgcttcacccgtttttgcagttcttctttggtgtctattctcggcatgagcattccggatgccgcagccctgatgcagtaatataagataatgatgaacaaaaacacaaggcttgcagcccattctttaaacggaaattcaaacataatgccgcggatgatcacatcaagcagcgcaaatgctcccgctatcatcccaatctccgaccagattttttgttctttttcttttactctcttatttttcccattcacgcctgaaagtctattacgcagattattcatgaccttcctcccgcacttttacgaatggcttatggcttacatgttacaataacagcctgcgcttctgcaatgaataactcaaaagcccgccgtacaagccggcgggcagcaatcgttaaaacggcccccaattgatcatgactccgatcacgataaagacaagcccgatcaagaaccaaatcagagcaagcggcaccataaaccgcagccacttgacatacggaataccgctggcggcaagcaccgccatgagaacgccggatgtcgggttcacacagttgacgaccccttctccaagcataaccgcttcaaccgcaacctgtctcgtgattcccatcaaatcagcgagcggcgccaggattggaataaatacaacggcttcgccagaacctgaagagatgagaaaatgaagcagcgcactggcgatatacatgccgattgccccagcaatcgggctgaatccatccaaaagtgaagccaaagcattgacgacagtatcgagaagctttccattttcaaggataacggaaatgcttcgtgccatcccgacaatcagcgccccgtatacaagactttggcagcccgtaatgaaggttttggcaatatcgttcgccgcaagcccgcctattaaaccggcaaggacagaaataaaaataaatgtcgcagccatttgggaatctgaccagccaagcttcaaagcgccgtataaaaatccgacaagtgagagtcccgccacagccaaaatcagcttatggcgaacggtaaacggcactgactgatcttcttctttaccggcttcgcccattcctgccgcagggaaccaatctgttcctaacacactggcatcttttgatttttttaattttctcgtatacaaatagatataaataatagaagacagcaaaaagcatatgtatatcacaactcgcaggccgattcctgagaaaagagggagctccgcgattgattgtgataaaccgagcggtgacggtgataatatggtggagttaaatccagcgtagcagccgatgtatataacagcggctcccgcgactgcgtcccattttaaggatcgtgccacaatgaggccgatggggataaaaccgataactgaattcacgacaatcccggttgttccgagaatggagaacaatgcgccgacaatacaaataaataataattgctttgtgcggaatttgctgatgacattgtaaatcaggccattgatggcacccgttttttctagaatagcaatggtgccgcctgtgaataaaatcagaaagatgatgggtgctgatccaaccattccatcctgtagagaagtaaaaaagctgatcaagctgaccggagactgttcaattgaatgatagcttcccggaacagcggtcgtgacatccccctttgtcacgcggtcaaattcacctgccggcacaatatatgaagcgattgcgcaaatgaaagcaatcataaataagaggacataggcgtcaggcattttaaatgtcatacgttttttcttaggctgtgtttcggctgctggcatactcatatttcgatccatcccctctgtttgaaaatattaattattctgaatagtagcaatatgtgctatattatatacagcctatcttcctgtttcaatataaataaagtaaagaaggtaaaaattcattctgatagaaggaggtatttcttaccatgcaaaagctttcagaagaaatgaaacaaaccattatggacatcttcgagcatctgcacgcgaaccctgaagtcagctggaaggaatatgagacaacttcatttttgaaacaaaagcttgaggatttagggtgccggacgcgcacgttttcagactgcaccggggttgtcggcgaaatcggctcaggctcacctgttgtagcggtacgcgctgatattgacgcgctgtggcaggaggttaacggcacatttcgcgccaaccattcctgcggacacgattcacatatgacaatggcattgggcacgttaatgctgctaaaaaaacaacctgagcttccgaagggcacaatccgttttatctttcagccggcagaagaaaaaggcggcggcgccttgaaaatgatagaagaaggcgtgcttgatgatatcgactatttgtatggcgttcacgtccgtccgatccaggaaacacagaacggccgctgcgctccttctattctgcacggatcaagccagcacattgagggaacgatcatcggggaagaggctcatggcgcccgtccgcacctcgggaaaaacagcattgaaattgcggcatttcttgtacacaagctcggactcattcatattgacccgcaaatcccgcataccgtcaaaatgacaaaactgcaagccggcggtgaaagctctaacatcattccaggaaaagcatcgttcagccttgatttgcgcgcacagaccaatgaagccatggaggcattaatcgccgaaacagaaagagcctgtgaagcggccgccgctgcatttggcgcaaagatcgagctgcacaaagaacacagccttcctgcggcaacacaaaataaagaagctgaagcgatcatggcagaagccattacggaaatcatcggggctgagcggcttgatgacccgcttgtcaccaccggcggcgaggatttccatttttacgccgtgaaggtgccgaatctgaaaacaacgatgctcggactaggctgcgggctccagccggggctccatcatccgcacatgacctttgacagaaatgcgatgtttaccggcattcatattttggcgaacgccgtgctcaaaacatttcagaaggcggaatcacttgctgccgctaacgcttcttaacgcaaaaaaagcagcctgacacaggctgcttttttgattacttcttcaaatcttcaattgagttgacatttttcatatattgaggaacaacaagccccatcttcacaccagtcatactggtgccaatatcatcatatttgcctttatatttagcggcgtatgctttatgggtattcggcagccatgcggaaagggatgcatccgcacttcccgtcgcaattgcagtccacatcggcccagcctctacctgagtaagtgttacctcatagcccaagtcttctaagactttgcctatgacgtttgtacttgcaatctcactgtcccacgccacataggcaaggttgattttgtctcccttcaccttttgaacgccttttgtccattcggcaatctgatccttgtgtttattgacgtactcagcagcaactttggcaggtttctcgccttcttccaccttgatcatgatttcgcccatttcgtcctgcgtccatttaaactggctcagaagctttgcggcattcggctgctctttgctgaagcctttgcgtgtgatcgtatggatttcctctgcgctgccataagattgtttcggatcatcgagatatttcagcttatatctggagaacatccagtgcggtgtccatcctgtaatgataatcggtttcttacggtcgtatgactttttaagcgtagcggtcatcgcagcacttgacgctgaaatcaatgtccagtcattcaggtcataatccttcatcgctttgtcagtcagggacataatccctgaaccggggtcaatcccgatgatggtcttattcacttgttctgctgcggatgcattttcatcgttttctgaaccgcaagccgcaagtgagagcgccagcatggcggaaacgccgatgcctatgatttttttaagcatcaggcattccccctgcttttcttcttcactttaatattttgagtaatacggtccagggtaatggcaacgataacgatggcgataccggcctctactccgaccccggttttcagctgtgtaacggcactgtatacttcagaaccaagtcccggtgcaccgaccattgcggcgataacaaccattgataacgcaagcatgatgctctggttgatcccggccaaaatcgtttttgtcgcaagcgggagctgaactttaaacaaacgctgagctgttgtagaaccgaatgcctcagtcgcttcaatcaaatccgccggcacttgtttaataccgagaacagtcatgcggattgtcggcggcatcgcgaagataacagatgcaacaacacccggcacaacaccgatgttaaagaagaaaatcgccggcaatagatatacgaaagcaggcattgtctgcattaaatcaagaattggcgttacaatacggcgaaccgtttctttctgagacgcccaaattccgatcggaaccccgaccacaatcgaaataatcacagatgtcaaaacaagcgccaatgtttgcagcattgggtcccaatatcctaaataatcgatcaggaggaatccaatcaacgtaaataacgcaattccccttgtactgatccaccacgcaagtgcggcgaaaataatcgttaacaaaatagatggaataaatccaagaccggtgacaattccatttacaaaagcggccaatccgttagcgattccgtcgaagaatccgccaaacgtcatcgtaatccagtcaacaaaacggtcaataatatctgctaaaggtattctaggcagtctatccatcttatttcacctcctgtgcagaaggatcttgtgtttgttcgttagtgccttcagcattgatatactcgttattgccggcaagtgcgccaatcagcgcgcctcttacgacaattcctttcattctttgcttctcatccacaaccgcaattggaatattcgcatcggacacaacgtcaaaaatctcagtcagatacgtattctctggtacagtcgtaaattctgtattcaagatgtcttgaagtgacaaatcagactcagccgcttttttcgcatcagacgcatagataacacctaataatttcttttgtttatccactgcataaattgaagaaattccaaggtttttcatcagtgtcaatgctacgcgaggccctttatcaatccgcactgtttcagcgcgtttcataatgtggcctgctgtgaggactttagacaaatcaacatcttcgacgaatttctcaacatattcgttagatggattcatcaggatttcttcaggcgtgccgatttgaacgatgttgccgtccttcattaggacaattctgtcgccgatccgcaacgcttcgtccaagtcatgcgtaataaagataattgtttttccgacattatcgtgaagatcaagaagctcatcctgcatatctttacgaatcagtggatcgagcgcactgaacgcttcgtccatcagaaggatgtccgggtcattcgtcaacgcgcgggcaaggccgacacgctgctgcatcccgccggaaagctggtcgggatattggtgttcaaatccttccagtccaacgagcttaagagactcaagcgctttttgctgccgctcttgtttgtctacaccttgaagctccagtccgtattctgtgttttcaagtatcgttctgtgcggaaacagagcgaacttttggaagaccatgctgatttttttccggcggacttcccggagctggtcttttgacatatttgttatcatgtcaccatcaatgtaaatatttccggcagtcggttcaataagccggtttaacatccgtactaaagttgatttaccgctccctgatagacccatgatgacaaatatctcaccatcatatacttcaaaatctgcctgattaaccccaacggttgatccggttgctttcaggatctctttttttgtctttccgttggcaagcatttgaactgccttctttgtttgtttcccaaaaatcttagagactttctcgacttttatcttaattggtttctcatctacactcatattttccctccatattaagcaatctttattaccgtaacatttatgtaacttcccacacaaacagcatattctcttttattctgtaccatttctttataaacatccatgtgaccacatgatcttatttatgcttctaaatgctctgtaatcctcctatatgattgtattttacgggtgatttttctcctacctttagttgaaaacgcttttattggaattgaattcctccttcctcttatgacttcctgctcctttactggaaaaataagttgctttttcaacacccattatgtattatagtttcatgactatgaaacaatcagatgatcaaatcagagcgcaaatttttaaagcactgtctgatgaatcaaggcttgccattattcgtacgctttatgtcagcggaaaagaactcagctgcggtgaagtaggtgaaaagtgcaatattgtcaaaaccacggcatcttatcattttaaaacgctgcgtgaagcgggattgacggcaacccggaaagattcgcggacaaaatacgtcagtctgcgtgaagacacatttcaaacatacctgcctggctttttggaaaccctctaacaaagggttttctctatacatatctgtttcatagttttaaagttataaaacaataggagtgataaaatttgaatcgcatttggcttttcttcagtgtcatgtttgtcattggcacggatacctttttgctttcgccgcttctcccccttttacaggatcagtttcatgtctctactgatttgtcaggctggatggtcagtgcttatgcactcggttatgcactcttcgctttcattgcaggcccaatctcagaccggctgaacaggaaaacagtcatgctgtggggacttgcaggctttatcgtatccacatttttatgcggcatcgctccctcttttgccgccatgtgcctgttccgttttgccgcaggcgttagcgctgcgtttgtgacgcctcaaatttgggcgtccatcccagtcattgtccagccttctcagatcataaaaggcatggggattgcgacagcaggtttggccgcttcacaaatgctcggacttcctattggagggtttctcgcttcctttacatggcatacgccatttttcgttttgtcagcgtgctcgcttattcttctattgatcctggcggcggtcatgcctggcatccggccttctgaaccattggcgcgcccatcaattgtcaacccctatcgggagcttttttcattgccgaaaacatcggtcattctgcttgcctattttctgtttcaaaccggaaacttcgcatcgttcagctttctgggtacttggctttccgcggattatcatttaaccgtgtcacaaattggcgcagctatgcttgtactcggactgggaaatatgctcgggagccttatcggcagccgggtttcagaaaagctgggcatgtttaaaacactgatcagcgggatgctgctaatgggcgctctctatttcgctcttccgttctttccaaacttgtttttagtagaagccggcttttttctcacgttctttacagctggcatcatctttccgttaatgatgggtgtctttcaatccattgcaccaaatgcgcgaggaaccatcgcttccctttccaatgccgctatgtatgccggaaccactgtcggtacaagtattgcaggttttttatatcaaagcacacagcatttcggagctgtcacaggatttactgccattctgttcatactttctatgacgctctaccagacaatcagtaaaaccgggaaacgccaatccacagcccgggcgcaattgtaaaaaagcacctcattcaagaggtgcctcagattgttgacaaaatcttttcagcgtgattgaaaacccttgaagtctaggaaggacgagcataggagcggacattcacaggatgtgatgacgacggcgtttaggcaggacgcctgagaatttagccgttgatccacttcgcattgagcaccgaagcgcagtcctgacaacgaatgcgagggtttgtcgacacgctgaaagcacctcttttaagaggtgcttttcctattctagctcagtttgtttcgtttctttccccataatcaaaatacaagcaaccgcaagtaagattgcaatgcaaaagattgaaaagatgaccgaaaacgaaatatgacgggctgccagggttccgacgagcaaaggcccgaagatgccgccgattcttccaaacgctgctgtcgttcctgaacctgttgctcgaatcgcagtcgggtattgctccggggtataagcatacagcacgccccacgcaccgagattgaaaaacgataacagcactccagccgtaagcagaagacttaaggaatccgccgttccgaagaaataggcgcttcctgctgtgccaatcaagtaaacgacgagtatccacttccggcccgctttttcaatcagccatgcggcagagaaatagccaggtagctgagcaagcgtcatcagcaggacatattcaaagctttgaatcatgctgaagcctttcagcagcatgacactcgggagccataggaacatgccgtaataagaaaacaccacacagaaccaaacgatcgacagcatcaccgtcggccgtatatactgtcttgcccagacgctttttacattctcccacatcgacctctttttggcagaaagcgattcatatttcggcgaatcaggtagactcgtccgcaggtacagcgcataaaaagcagtcagcgcagttaacagaagggcagcctgccagccgaagcttggtatcacaaagtaagaaatcaaggccgctgcgagccagcccacggcccaaaagctttccaaaagcacaatcactctgccccgcttttcaggcacaaccgcttccgaaacgagtgttgaagcgactggaagctcgccgccaagtcccataccaatcacgaaacgaaggattagaaatgccgataagctcgtcacaaaagcggaaatgccgcttccgatggaaaagcataaaagggtgatgatgaacacttttttgcggccgattcgatcagcaagcaaaccaaacaaaaacgcacccgcagccatgccgatggaattgacgcttccgatccatttcatttcttcgggcgacagattccactctacatggagcgcggcgataataaacgataatattccgacatccattgcatcaaacagccaccccaaaccggcgacgcccagcagtttacgctgggatataggctgttgttttcccattgccaacacctctgatatgcaaaatgattaccgtttaagtttacacctgtctttacacattgtcattaactaaatgatgtaattgaaataccccgcttatgttccacaagcggggtttttattattgctgcaatgctgcttttttaatattatcctgaagctgggcaattcgtctcgcgccgtcttcgcggaggcgcttgttttcttcttcgatttgttttgtttcctgcatgccgctgacaatcgtgttccaagacgattcaatcgtttcaatatctatgctcggtctgccggccattctcgcaatttcaacactttggctcgagatgttttcagcatttcgtttcagcatctcgtttgtccggcggtcaagctcgctcatggaatcagccacaagcttttgccgctttaccgtaacagcctgaataatgccgtttttgaaaatcggaatggtaatgataaacgcggagttgattttcccgatcagctttgcatttcctcgctgcaggagacggatttgaggtgcggtttgaagcgccaccatccgtgccatgtcaagatcatacacccgttcctcaagcgcctgaatgccgttgcgcaacgtatcgagctgcatttgcgccagctggttcccgcttgccgctttttcctcatatgaaggaaggatcgactgcatctcttccagtttcatctgcccggcaacgacgtatttttcaagctccatatagtatttgatattgttttcatacatttcatcgagcgtgtagttcgtcttcgtcatctcatctttgtattttgaaatctcaacgtggattttttcaatctctccgccaagcgtctgatactttttaaagattttttcaatcatgctgccgccgcgtttgaaaattttcgccattaatccctttggctcatcaaaatcatttttgtcgaagcggtccatgattttcccaagctgagtcagcattgtgccggagtctgtcacgcttgttgttttcatcatccccaagatgcggtcagagaacttggatatttcaacggccggctccttgccgtactcaagcagctccatttggtttttgacgtcaatttgttgagcaagccgcttcacttctggttcctgacggagctgaagacggatatcgtcagctttttgctgggaaatctcttcatttttatcgagaacaagcggattttgattttctgttgtcatgcttttcttctctccttatttttgggtaatggttctgaagagccttttcacaagcgaaggctctttgtagtcctgctgaaacaccatgtcatccagccagtggatatcatactgatcctcttcaataaactgctcaatatcttggtgtccgggcggattataaatgatgatatcgattccgatttcattcaggaacagcagggcggcagcatccgaacgcgtgagtccgccgctcatttccgtatgatataaaacgagtttcggaacggtttgcgcatagtcgaacatttgaatcaatttcagcagattagcaggcaggtttgttgtttgtttaaacaaatagatttgaacatccttgacttgttcctgatgcaaggctttaagccgcgggtacctgcacattctcgaaatcgttttggcaatggcagtctgaacgcccgccggcagctgtttgtactgccacacattgcttgccatcagcttgtccggatcaatgttcccttcttgatcaagtgcgtggctgtagtgaaattgatagttcgactttatttcttctgtaaatggaaagcttctgaccatttctgtttcctgataatccgctagagtatgaagcctgttccaatattccttattgtctttcgacacgcccataattttggcgaatacattcggaatctcaatggaatgtttatcagctttgaaattcggccgaataaaggcgcgttctttcgtgattaaaaacaattcatcataggtcgttttcagcgtaacggacaccggtgtgtgatctctgaactgccacggcttatatagcatggattcctcgtgattcagcacatgttcaatttcctttgttgagcggtaagccactgttgatttccggtctggtttttctttcggaaacggctgaagctccgaaacatccgggagcttttccgtaaaaccgagctcctgcttcgggtcgacaagcgccagctgatccgttcccgccggatggaacagcagtacatcacagccgaccagcatcagataatataagaaatagagctggcttttcgtcgcatctccataccaaacaaccttcggcatctcccgctctatatcggttttttccagccaagggttcagatggtttaaggaaaacttcgagacatcaagcagcactctgcgaaaatcaggatgattcagccccttttcatgactgtccgcaaaggtatgtaaaagcgtcatcaacgcttttcttaaatggcggtgcatcaagggatttgagtgcttcgcaatcagcttttccccgtccagaaaggcaacaaagcggctgactgacagccctttttctttctgattgatggaatgaatatgctgaagcttttgaaatgtttccggttcgattgttttatcaagcgtttcactcaaaatcgttatgcggtcgtttacagacagctcatacagctcgttatagtagtccgtctcatcaataggcgtgcccaatatctgaccggcaagacgagaaaaagaaaggccttgtgcagtttcatagtgatcccgctccggcaatggctgaaacagcaggcttttccaatcgccatcagccggaagtgctttatgaatggttagttcttcttgtctcatcatatcctcctttccggtttgtcattgaaacgatatttcggtaacaaaaaaggaaggacattgaacctccctccttgttttgttttattcttcttttgaagcggctgtttgttcgcgcacctgcttttgtttattgatgtagtgaatgatcaatgttaccgcaaatgcagcgataatgataatgaagaatacagagtgcggcatttcgtaatggaaagcgctccccgccattttcagcgcgataatgccgattaagacgaatgctgtgttttccagctcaggaattttatcaatcagcacaaggaacacttttgccactgtacgcatcattaaaataccaagcataccgccaatcagaagcacccatactttttcagatactgcaaacgcggccaggatgctgtccacagagaaggcaagatccattaattctactgaaatgacagtcgcccagaagatcccgaacgtgcggaccatccaagagtttttcttcatgccgtccgcttcctcttctttttcgcctatccagaagtgcttaatgacgagccaagccaggtaaagcgcgccaagcaccttgatccaccagaatttaatgagaagcataccgagcccgatgaaaataaacctgaaaatataagctccaaacaaaccatacgttaacgcttttttccgctgtttttccggcaggtgtttaaccatgaccgcaagaacaagcgcgttatcggccgataaaaggccttccagaacaacaagggaaccgatcaaaccccaggaaacaggatcagtcagaacttccccccacattttccaatcgaaaaatgaagcatacgtagacaaaatatgatgtaaaaagtccaagttttttcctcctataatttgaaacggtgacttctctatttgtcactcgcttacacttgcaaaccgtaattccggcacaatgcagccagcccgccggaaaatccgctgccgattgcattgaatttccactcgccgccgtgtctgtaaagctcacaaacgacaacagctgtttcaatggagaagtcttctcccaaatcgaagcgaagaagctcattctgcgtttcttcatccacaacgcggacaaatgcattggaaacttgtccaaagttttggctgcgtgcttcagcgtcgtgaatggtcactgtgatgccgattttctcaatgtgagcagggatttttgagaaatcaacgataatctgctcatcatctccgtcgccctcacccgtgcggttgtcacccgtatggatgacaccgccgctcggatgttcaaggttattatagaagacgaaatcgagatcatttacgcagttatcatgcgcatcaactaaaaaggccgaagcatccaggtcaaaatcgtgtccgccggagtacttgtttgtatcccagcctaagccgatcaccgctttagtcagtcccggatttgtttttgttaaatcaatgcgctgtccttttgataattgaatggccatactgcctctctcctttctgctcttcgtatttgtcttaaccgacttgcaaaccgtagtctgttgcaatgcgggcaaggccgccttggtagcctgagccgattgctgagaatttccactcgccgttatgtctgtaaagctcccctgcaatgattgccgtttcaatagagaaatcttctgcaagatcgtaacggatgagctcttcatttgtttcttcatttacgatgcggacaaacgcgtttgatacttgtccaaagttttggctgcgcgcttctgcatcgtgaatggtaataacaaatgagattttatcaatgtttgccggtacagcgctgagatttacttttacattctcatcgtcgccttcgccagcaccagtcaggttgtcgcctgaatgaacgactgaaccgttgccgccttcaagctggttgtagaaaataaagtcgtttggtgacgcgcatttgcccgcggcgtctaacagaaacacacttgagtcaagatcaaagtcgtgcccgccgtcatacttgttcgtatcccagcctaaaccgacaacaacctttgaaagacccggatttgtttttgttaaatctactttttgtccttttgccaatgaaattgtcatgtttcatccactccttttcttttatacgtatcgactgataatatcttctaatctcgtatcgtttgtgccttcaccgaccgccgcaaacttccactcactgccgctgcggtagatttctgctgtaatcaggcttgttctgccggcgtaattgtctctcaaattgtacttgagcatttcctcgtgattagattgatcaactacgcggataaacgcattttgaatcatgccgaaatcttgttttcttctgacacaatcgtaaatgttcactacaaatacaagcttatcgatgtttccaggcactttatctaaatctatcataatttgctcgtcatcgcccgcaccgtcacccgtcaggttgtcgcctgtatgctgtacaccgccgcagcggcttttcaggttgccgaaataaatcaggtttttcttatcggtgaattttccgttttccagcatcagcactgaagcgtcacagtcgatattcggaccgcctccgccaagcagtttgctgaagaatcctccgcctgaggacactgggtcccagccgagaccgaccatcaattttgacagaccggcttttccttttgttaaatcaattcgttgacctttttctaaagaaattgccacacgattcactcctactcatcaaaatgtgaagatagtcacatttatttttacgctcacaaggaaaataagccgtaaattactaatatatacgtttgttattatatcaaagtttcgtaaaagttaagaataattgacgaaaaacctcgaaaaaaaacttccatatttgatatatgatttgcaaatgctataaagtgcgcttcttaaacaaaccatttgacgcgggcaagtcattttgcctattctggtgtcaccatctaaaaacagacagaaaggaagcggccttttgattcatttaagcatacttgatcaggcacctgtttctaaaggagaaagccctgtgacaactctccagcattcggttgagcttgcccaattaagcgaacagtggggctataagcgttattggtttgccgagcatcacagcacgaaaggactggcaagcacagcgcctgaaatcatgatcgcccgcatcgcagcacagacaaacaccattcgtgtcggatcaggcggcgtgcttctgccccaatacagcccatttaaagtggctgaaacctttcgccagcttgaggccctgtatccaaaccggattgacctcggcgtcggtcgctcccccggcggcacgacaaaaaccagacttgcattaacggacggggtgaaaaaaagcttaaccgaatttaacagacagctgcaggatgtctcttattttctaacagattcccttcctcccgaccatccgtatgccggaatcaaagcggcgccccttattggtacggcacccgagctatgggtgctcggtcttggtgaaaacagcgcaagacgcgcggcgcaccaggggattggatatgtatttgggcatttcattaatcccgagcgaggagaaaatgcattccgcatctaccgggaaagctttcggccctcagcccatttttcgaatccatccgcactgtttacgatttttgtcatttgcgcaaaaacagatgaagaggcagaagaactcgcattaagccaggatctgtggcttcttcgcgtcggaaaaggcttggacagccgcgtgccaagcatcgaggaagcgaaagctcatccctatacagcgtccgataaaaaactcatagaagaaaacagaaagcggatggtgatcggttctcccaccactgtcaaacaacagctgttagacctcacaggctgctacgaaacaaatgaaatcatggttctgtgcaatgtgtttgattttgaggcgaaaaaagaatcttatgagcgccttgccgaattgtttctataaaaaaagcagttttccctagggaaaactgcttttcatgttatcggcttctttttttgcgctgagcttcttttttgataaacgtccaaactccctgaactgcaaatccgattaatagcaaaacgatcaatagcagggtaatagacggacctggcggcgtcccgagctgataggatgatgtcagtcccgtaaatacgctgaataatgaaatgagtatggctgtaatgaaaaccatgttaaagccttttgcaattctgatggcgaaggctgccggcaatacgagcagggccgatacaagaaggaccccgatgatcggaataatgactgaaatcgcaaggcctgtgacaatactgaatgacaacgagagaacgtttgtattgattcccgatgttttggctgtagcttcatcaaacgtcagcaggtagagcggccttctcagtacaataaaataaagcaggatcagcagtgtgataatactgataatatagacctgctgctggtttactgtcacaagcgatccaaataggtattgatcgatgctcatattggctgtgcctttggaaaggctgattaaaaacatcgcgaaggacaaaccagctgccattaagatggcaatggacacttctgaataagtccgatacgcccgccgcatgtattcaattccgatcgcgccgatggtcacgacgactatgcttgctgcggttatattggtgctgagaaaaaagccgatggcaacacctgacaatgagatatgtgaaagtgtgtcagccattaaggcctgtcttctgagaacgagatacactcctagtatcggagccatgacggcgatcatgccgcctgctagaaaagctcgtcgcatgaattccaagtcaaacatttccatccgcctttttctcctctctctaatcgaatcactttatctaaaaattgctgtacttcgttttgttcgtgagtaaccatcacaactgtgcggttgtgatttttcacgagatgatgcataaattcgtaaaatccttttctgctgtcgtaatcaacagctgtcgtcggttcgtccagcatcagcagatccgggttgctggcgagcattctggcgatacagattttctgtttctgtccgcctgataaatcaccgattttacgatggcggaggtcccacatttccaccattttcaatgctttttctacttcaagatgatcttcttcatttaaacgtttaaaccatttcccttttgtatagcggcctgactgaacaagctccagcaccgtgctcggaaatccggcattaaatgaagaaatttgctgcgggacgtaccctatggtcaggcgtttcccttctgtattccttttactgatcgtcactgtgccttcccacggtttcagcatgccgagcattacctttatgagcgtcgatttagaggcgccgtttggtccagtgatgccgacgaactcaccgctttcaatatcaagtgatactttatctaaaacaggcgtatgggaatagccgaaaacgatatctttcaatgagacgagattcatgttaatcttcctttctcacaaagaaatagtgtgcacccctccggcgcacactatcttatgatttaaccaatagtgaatctttcagggcatcgaggttttgtttcataatgtcgatataccctaaacctttatcctgttcttctttgctcaagccttccagtgtattcagcacttctgtcttcgcgccgatttcactggcgagcgtatctgcgacctttgaggatgcaatttcttcaaagtaaataacttttacattatgttctttggcatatgttttcagctttgccaagctggctgcgctcggttcttggtcaggtgaaagccctgcaatcggaacctgcttcaagccgtattcttttgccagatagccaaaagctgtatgctgcgtgataaattcttttttctccgctttttttgcggttgtacgatatagtttatcaagatcctgcagttttgcaatatattctttactatttttctcatagtattctttgttatccgggtcctgcttcacgatttgagccgtaatatttttaacttccttctgtgccagaacagggctaagccatacgtgagggtccattgcatgactgtgctcatgctccccatgatcatgctcttcgtgttcttcttcagagccttccattaaatcaatgcctttgcttgcattaacgaaaacggcatggccttggcccatgcttttttcagctgacggaacccatgtctccatgtattcactattataaacgaacaaatcagcatcctgaatgttggcaatgtctttcggcgtcggttcccaatcatgcggttcaacggaagatgggattaacagatccacatcgcctttgtcttttacaatttgttttgtgaattcatacatcgggtagaacgttgtgacaacgtgcagtttatcaccctttgaatccgccgacccttttgttgatgagttgccgcatgctgcaactaataaaaagcacgctgcaatcacaaacaaaccgctccattttttaaacatatcgtatatcccctctttttcagtaactttaaatcaaaatgataacgattttgtaatcctatatcataataaaccgaagtcattacgttttgcaagaataaatttcattttcatttattcttcccgcctgcagagcgaatatatgtactaaaaaaacccggctaaaaatgccgggctacttcaatcattagtttgttttgtccagaagatagaccctgctctcataaggccggaacaccatttcgtcatcaagatcatcgttgttataattgctgagaagcagtgaggcctgagctttgccgcagttcttaggccactgaaaaacagcctgctcttttgaaaaattattgaccgacaaaagctgttgtttactgttttctctcatgtatacaaacaactgcggatcgtccggaagcaaaagatcaaagctccctttcatgaggtcagcgtactgctttctcaggctgatcagctttttgtaatagtttaagacagaatcaggatctccctgcgcttcctccacattgattgcggtgaagttcggattgaccttcagccaaggcgtgccgtcagtaaatccggcatttttgccgctgttccactgcatcggggtccgggcgtgatcccggcttttggctaagatcgatctcatcacatcatttggatcatagcctttttcaaacacccgtttatgatacatattgatcgtttggatatctttgtagtcttcaatccgggtgaacggcgcgtttgtcatcccgatttcttctccctgataaatatacggcgtgcccttcataaaataaattacggctgccagcattttcgctgatgctttgcggtattccccatcgtctccgaatctggacacaatccggggctggtcgtggttgcaccaaaacaatgtattccagccttgatgttcaagcttcttttgccattttgtcaaaaccgattttaaatcagaaagctcaaggggcttcaaatcccaatgttcttttccgggctgctgatcaagctccatatgctgaaagtgaaaaatcatattcagctcatgcttatctgttcccgtatatttcaggccttcttccggtgtgacactgccgacctctccgacagacatgacatcataatgagaaaacacttcatctgtgatttcttttaaatagtcatggattcgttcgccatttggctgaaagggcttcggctctgcctgctgattgatatagtcctcatacgaaggaagatattctttcttagaaatgagatggagctgatcaattcgcaaaccgtcgacccctttatcgagccaaaatttcatcatgtcatacaccgcctggcgaacttcgggattttcccagtttaaatcagcttgtttgacggcattcatatggagatagtattctccggtgtgctcttcgtattgccagaccgggcatccatagtttgagagccagtccgtcggcgggccgttctttgtgccgggacgccaataataatagctacggtatttgctgtttttgtccagctccgcttctttaaaccacggatgctcgaccgaggtgtgatttaacacaaagtccatcaccagctttaatccccgctgatgcacctggtccagcagctcgtgaaaatcgtccattgttccgtaagaatccataatcgccttatggtttgtcacatcatagccgtaatcaacattcggagaaggatagatcgggcaaatccaaatcacatctgccccgagctcctttatgtagtcaagacgggaaataatcccccgcaagtccccaattccgtctccattgctgtcctgaaagcttctcgggtaaatttggtacaccactgcatccttccaccagtctgttttcatcccgcaatccccctgttttgtcttctattcaagctgagatggataaagtgtcattccgccgtcgacgaaaagtgttgcgccggtcacatagcttgcttcctcagatacgagccaagctgctgctgccgccacttcttcaggctttccgaaggctttcatcgggatttttttcaattgtttttgcctgctctcttcctttttcgtatcaacatttgattctgtggcaatggtgccgggcgctatcgcattgacgcggattcccttatccgcataattgagcgccagcgtttccgtcatcatcttgatgccgcctttggatgtggaatactgaacgtttacagggcgcggaatctgctgatgaacacttgagatattcagcacattgcccttgatattgtttttcatcatgtggttaagtgctgctttcgctcccagaaaggttccggtaacattgacatcaatcactctctgccaatcttcaagactcatctcatgcggcatcgcctcaacgccgttaaaaccggagttgtttaccatcacatcgagcgtgccgaaatgctctaaagctgtgtccaagagcgcctgaatcccctcttcttttgacacgtccgcctcaactgagacggctttccctccgttctgcttaatgatttccagagtttcatctgctccagacgggtcgctgtggtaatttacaacaacattcattttctcctttccgaaccgttccgcaatggctttcccgattccttttgaagaccctgtcacaatcgctgtttttccggttaaatctttgtacatacttgatatcctcctctgtttctcactatgcagtggaaaataccctgtttttccgagttgaaaacagcacaaaaaaagcagagaacctgtagttctctgccatttcctattgaaaacgctgctcggcaagcttctttttaatattcatcagcctgcggtaaaagaaagcggcggactcgtaatgttccaactgattgaaacgttccgctgtatcatgcagcagatcttcggcgtcagcaagaagctgcctggattccagcaggtcaaagcattctgtaagcacgttcaggtcgccgcttccaagatacagctcatgaatgaggcggaatttcgtcaagtacatgtcatcctcccattcagccgcgctctttatcccgcggtcataagcctctactgccttgtcgtattttccctctttacagtagatatgggtcagtgaaaatacagcttgaacagcttgctgaaagttgtgctcctcaaaaatggcggcggctgttttgaaatagccctccgcttctttgtaatcacccagactgtacttacagtgtccgacattataataggcagcagcgatcatgtacgcttcttcaagctgcctggcatgttctaaagcgctgcacaagtgggtcagtgctttttcatgatgatacacatcggtcaaatttccggcgatgataaattcacactgaacccggcggcgaccgtacagttcatatttcgtatagatatcaagcgcctggctcgcataattcatggaaaaatacgtttgtttgatgtgataatacacttctgcgactttaaaaagaaactcagctttttcgatctcatcctcgacatactcgagcttttcctcggcatgtttataatggtcaatcgctaatatgaaatttttctgcttgaattcgtacattcctctgaaataataaaagtagtattccagtaagcccgtgagtttttgctgattgctttcaatttcgttcagcatatcagagaacggaggcttggtatcgctgtctttcaccggcatcagcttatcaagcatgattcgatgccggaattccatcaaagaaaaatataaaagcaagtcctgattctcttccatatcttctaaatcatattcaatctcctgctttaacgcttctgcttgatctgcttcaaatgcgcgaatgagcttgtaccattcattcagctttactgctacttcttctgatggaatctttgctctcatcggtctgcctccttcctcctgctactatttatgttatattttatcatagctgttcgcttttagagagagtcaatcacttaaaagcgttaacattcagcacatcttgagaaagtgagaccgatatgaacttacccgcaaaaacatttgttatcttatgtattctatttcttctagatctttgttttagttatattcggcatgaatggcattctcaaaacgccttgcaggacatgcctgtcccctcggatcttcatccgattgtgaagcagaatgccgatgcactcaaagccgctgcagcgaataaaggcattgacgtcgtcattactgaaggattcaggtcctttaaggaacaagatgaattatataaacagggacgtacaaaaaagggaatattgtcacctatgcaagaggaggggaatcgtatcataactatggtttagcgattgatttcgcccttcaaaaaaaggatggcagcatcatatgggatatggaatatgacggcaatcaaaacggaaaatcagattggctggaggttgtcgagatcgctaagacactcggtttcgaatggggcggggattggaaacgattcaaggactacccccacttggagatgattcctaactagacacccctcacagccttttctttttccttatgtgcgcatcaatataggaagggtaaaccggcttatagacaagtttgcagtgctggtcactgcctgctgtaaaatcaggctgccattccagtttcacatcaaaagcggctaaaaatgcttctttcgcttcttcagcggaaacatccggcctgtgatttatcgcttccaattgttcaggttcaatatcaggcgccataaaagcgtcaatcaacccagtttccggattgacaatgatgcgggcagcgccgaaccgcagcggcactcctttataccagacagaaaaatggttgcggactctccctctttcatcaattcggacgggattcaccctgaaaaactcagccgctctcggatagagggcatacaaaaattgaagcgctatctcttggcattcttccgtggagcattggaggttgttccgccagtccataaaagaaagcgctgcttttaattttccggttcttttatccgtcttcattttgattgtatttttatttctcgtttcaaaatagcttcctatgcttaaatccttacgctccggcgcagcgcccctgcgccacgtgcttccaatttgttctccaaagtctctttcactgactttctgcatatcagaggtaaaacccagcaaggcaaatatatcaacttcttccttgttctgaagcggcggcagtggcgccgtgttttctattctttcatctgcgatatgctggtcgggcacaatttcgtctacatctgcgggatagctgtatcccggtagaatcggttcatatacaagccttggttcctgttcgccatcaatgacatcgtacatcagctcaaaagacattgtgtttaagtaatgggatacaaccttctcttttgctacaaattccgtcggaacttcggctttatgcccttccccgtaatatagaaagtggacaatctgaccgcttcgtgtcatatcaattaaaaagcctgaattgggaatcggaagccccagctccattttggtatagacaaaccggatgtgctgccccctttcttccttgccttgaaaatgaaaattcataaatgtgccgggatgattggcagcggcaaactgaagagccgtcagcttcagctcggcatctggaagttttttgtctgtctcggagtggacagttgttgaaaaggtgagcaaggcgccgtcatttctaagttcaactgtaatgtgcttttccggatctttagggtccttccagataaaatatgcctgcccgtacttcttttgcttttggtcgtaatcttctatctcaagctcataatgcgtcggtacatttccgatctcctgcgccttctttttcagctgtttattaaccaatgaagtcatccctttcaaagagtctacgacaaagagaatcctgtttattatataaaaagacctttcttcatttaaagtgaagaaaggtccttttctattattgtcattgttttttgagattctttctgttactttcatcacatactctcttctatatctgaggcaattgcgtgacttttggctgtttcaccatatgctgaagacaggctcccctgtatgtgcatcgataaaatgcggatacaccggcttatagacgagccggtagctgtgttcttcatcatccccgtactctctttcccagccaagctcaactttaaaatgctgccaaaagatagacttggcttgttcaactgaaatagccggcacaggatcaatggttgccagcttatttgggtcaatatccggtcccatataaacggtgatataccctgtctggcggctgacacaaattctgatctgcccaaatcggagcggaactccgtgacaatgcgcttcaaacgtaaaaccagcgactgcgttttcttcttcatctttttcgtcgtatctgatcctaaaatattgatcggcattcggaaataaagcaaatagaaagcgaagcgcgattttttcacactctgccaaggttactgtcagcggcccttttttctccataaatgacatgacgccttcgagttttccggtttctttgttatagatggttttcagcacttgatgagtccgtcccttaaaccagctgtccatgcttttatccgccggctgatacacagggtcatccggattccgccaaacgattccaattctcccatctcccaaatccgcttcccgctctttgacaaacccattttcaataccaatcatgctgtcaggatcggccttttcgcggatgccctcgaataaagggagaggaaagctctccggctccctgtaatcatcgtcatcatcaactgcttgttcttcttgaaccaaatccgcaggtacggtaatcgccctaccttcaggctcgtacaccaaatgcggctgatcatctccgtttttgtaaacagaacgatggagaacctcaaacaaaaggtcgaactccacgtccttcttgataaaggcaagtgcctcttcaacatccgcgacccgctttggcttgatgatgctgcccgcttcgccgtaataacggaagtaaacaatctcacctgataaggaaacatcagccataaatccgctcatggggagaggaagcccagcctccatttgaacatatgaaaatctcactttatcgccgtatgcacggtcattttcttcacgaacaaaggcagagagtgcccccggatgatgagtctcgacaaattggcgcatgatatcctctagtttctcctcagacagcctttctccgctttcaggctcaatatcacgggaaagggattccagctctccgtccggtccaagctccacgataatgccggtattctcatcctgaggatctgcccaacaaaaatgagctcttttatcatcaccgccataatcttcaatttccagttttaagtgtgtcggcacccggccgatttccagtgctttttgtttcagtccctctttcttcacaaaggcggcccctttcatccttcttaagttccctccaactaatcaaaaagtaatagtctaaaatacacagttttctgagtttaccagttttaccagaacatttttcaccaaaaataggatgatgaacctattcaatataaaagctaataatcttaaaattaattccgttgtaactttttataggtccattcatgacaaaggagggcggagtttccagaaaatccggtgaaaaccgtgagaaaagaactgatttttttggttatatgatgctaatccattcaaaaagatccatttctcaaagacaaaagactcccctttcctaaaccatttgaggaggaaaaatgaatgtttcagaaaaaaacgtacgctgttttcctaattcttctgctgatgatgtttacagctgcttgttccggcagcaaaacaagcgcggagaagaaagaatcagaaacagaaaaaagctcagatatagctcaagtcaaaatcaaggatgtctcttacacacttccgtctaaatatgataagtccacttcagatgaccagcttgtgttaaaagtcaatgtcgcggtgaaaaacacaggaaaagacccgctgaatgtagacagtatggatttcacattgtatcaaggtgataccaaaatgtctgacacagaccctgaagactatagcgaaaagcttcagggcagcacgattaacgctgacaaatccgttgaaggaaatcttttcttcgttgtagataaaggcaagcaatacgagcttaactatacgccggaatcttacggtgataaaaagccaaaatcagttacttttaaaattgacggaaaagacaaaaaaatcctggcgacggcagataagctccaagattctgcaaaagcgttatcagcttatgttgatgtccttcttttcggcaaagataacgccgatttcgaaaaaatcaccggcgctaacaaaaatgaaattgtaaatgattttaatgaatcagccaaagacggttatctctcagcttccggcctttccagcacatatgcggacagcaaagcgcttgataatatcgtgaacggcattaaagagggattaagcaaaaactcttccattcaagcaaaaacgacttcaatctctaaagacgaagcaattgttgaagccacagttaaacctgtagatgcatcttctctttcagaccgcatcgaagacaaagtgaaagactactacagtaaaaactctagtgccagctatgaagaggcagtgaaatacgcgcttcaagtctatcctgaggaattcaaaaagcttggacctgcttcatctgaaaaaacagttgaagtgaaaatgaagaaaaatgacatcgaccaatggcagcttgatatggatgattacagagcagcagaattagtcgaagcattcatcaaagaataaaacaccaaaaggaaatagccatgacggctatttccttttttatttgaaaatgtcgctgatgaaattcacttcatcttcggtcagttcaatgttcaaggttttcaggttatcctgtaattgctccggtcgtttagctcctggaataatggcatcaatcgccggtctcgttaacagccacgccaaggcgacatgtgccgtatccgcttgtttttcctccgctactgctttcagcttatctacttttttgagattgtggataaacgtttcaccctgaaattgaggtttatcctttctgaaatcatcaaagactgtgtcttgcgtgaattttcctgtcagcagtccggacgcaagcggaaagtaaggaataaaggagatgccttgtttttcacagtatggaagaagctctttctcggcatcacgctgtatgagagaatattcggcctggaagacctccaaatagccgtcagcattaaaatcctgcaattgctgataatcgaggttcgaagcgccgatcgctttgattttcccctcatccttcagctctttcaaagtgcccgccacttcagcgagaggtgtttttccatccggaaagtgaacataatacaaatcaatgtaatctgttttcagccgcttcaggctcttctccacctcgctgcgaagaaactcccggctattgtctaattcaatgctgccgtccacttctttatgagctcctttggtggcgatgatgagctcattccgcacgccgcgttcctgtacgacttcgccgattaattcttcagatcgccccaatccatatataaaggcggtatcgataaaattgacgccgccatccaatgccgtgcgcactaaatccttccctgtttcatcatttagatttggaaatagattatgcccgccgaccgcattcgcgccgaatccgatccgcttcaccttcagcttcgttttgccgagtgtacgtgtttgatccattgttccttctcctttgaaaccaattttgatgaaaaatagtgcagggtcactttttgtattagatatcctttttctattttccttcttttttcaggatatacaaaaaggagaaagtgtatttctcctttcgcaagtttattttggaagaacccatttgtctttcaggaagcaggctctggctagtaaaaagaagatggcgatgagcacggcgatggttcctgacgtagacaaaatggtagccgggtcaaccatcccgaataaaagctgtttaaataacgcatgcaggttcagaaacgggatgagaaagtatgataagtcaaattggttcggtgccttgctgaagatgaaaaacatcgggaacacaggcagaaagacgacgagagacatataactttgcgcttcttttaccgagctggacatgatgctgatgaaaagctccatcgcagatatcagcaatgcagagagcacaatgattaaggctgaagcgccgattacactccacatatgatctcccagctggaaggccgtttttaaattttcggtaaataacacggtggacaaaatcaaaaacaccaaagcaaatacacctgaagccacgccaaaagtggaaaccgcaagccacttgccgaccagcactttgtttctgctgactggcgttaatagcagcgcctcgattgactttcggtccttttcaccggccatgatatcaagagcgatcggcattgcgccggaaacaatggaagtcagaatcagcatgggcagaatggcggaaagcataatagcggaagtccctttctcctcatccgcttccttttgctgaattgtaaacggctggatcaccgattgatcaatatgcttatttgttaaacgttgctgcacaatttcatttttgtactgatctaaggcagactgcacaagctgcatggcatttgacgacccttgatcgattgaattgccgtaaacatcaaccttaaaaggtgtcatgctgttgacatatgagtcgaactctttcgggacgttcagataggcatctgcttttccttcatcaactgcctcttcaggctttgcaaatgtttttacgctgatttcgtcaatctcattaagcttgctttccagtgcgggcggaagcgaatggccgacagccagcgtgtactgctcccctttgtcggacagcatgctttcataaaaaaagacaagtccaagcatcataatcatcggcactaagattgtgagtaatatcgtttttctgtcgcgtaaagcgtcgatcatttcttttttataaatatggctcagcatttaagaaatccccctgacaagcttagacataaagatgtaattcaaatcctcactgcgctcgctctcgtatagtgattcaagcgcccctcggtaaatcacctctccgctgtgaatcatgatgacactgtcacagagcgcctgcacttcctccataatgtggctggagaaaagaatcgttttttgttctcttttcagctgctgtataaattcgcggaagatgttgcttgacgtaatatcaagcccagttgtcggctcatcaaataaaatgatgtccggatcgtgaatcagcgctctggcaatggcgactttctgcctcatgcctttcgaaaacccgcccactctccggttcatataatcgcgcatgccgaaccgtttcgataaatcttctattcttgctttgatctcgtggcggttcagcccatacagcctgccgaagtattggagattttctttagcggtcatcctgtcgtaaagcccggtttctcctccgaataagacaccgattctttgtttgacctcagccggctgcttgaccgtgtcaaagccgtctactgtgattacaccctgtgatggttcaagcaaggaagcaatcattctcagcatcgtcgttttgccggcaccgttttctccgagaatgccgacgacttctcctttttcaattgttaagcttacatctcgcaccgctttgactacttttttcttatcctgaaacctgcggctgcaatcggtcagtgtaatcatgtcacaatctcccttatctttatttctagtaatgactatatacgaaaagctggattagttggataaagttgtcgcgaagagttctttttatgtcgtgaaatgggatagaataaagatgattctatgtaactaggggaatgataatggtaaaagtcggacttgtagatgattatcgagtagatttagagaagttagaagcgatcgtgtccagaatgcaggacgtcgaaattgtcttttccaccgattcagcgaaggaagcctacaggcgggtaaagaacggagacattgatctgctgcttgccgatatcgagatgccccatatgtctggctacgagcttgctgatttgatcaaatcccattcacttgatgtggatgtgatttttgttaccggccacggcggttatgcggttcacgcctttgacctgaacgtccatgattatattatgaagccgtactatgccgaccgtctggccgcttccttcgaccggtacttgaaaaagaaaacggaaacgagtttgaatgggcgtatattgataaagcaaaagtctgaaatgcacgtcctgcaaaagaaggatattattttcgcagaacggacgggacgttcgacgacgattgtgacaaccgccgaagaggtgcaaacgtatcaaacattaaatgatattaaaggcgacctgcccgaaaaagattttcttcgttcgcatcgttcctttattatcaacattcattacataaagcatttttccgcttataccaagcattcattcacagtttcctttgagggaacgtctaaaaaagcgatgatcactaagcagcagcttgattattttcaaaactactatttttgaggagtttagtacgtgattaccctttttcaatgtctttatctgattttatttagtttcatatgttatcagggagctgctgctttttcacacagcacagccgcctcttggctcgccgctgctttaggcgcagctgctgcaggattgtacatttggaatacgaagcgggtgtggaaacactgttcctcagggctttgtgcgtggattgcggtgattcaagtgatgtcggtgggagtggtgttgattggcacagacatcatgccggtattatgtgtaatcgcgatatttgcagggtgtgaagggctccgtatcggacagtctgctttgcaggcaaggctttctgatcaaattgataagctgactcaagctgaacagcacgccaatcaaatgctgattgatgtcagaagccggaatcatgacacaatgaaacatatcactgcaatcaaatcagctcagcccaaggcagatacacaagcatatattcaaaactgggcggatcaatacagccaatatgaccgttttttgaaaggagagaacgcgtacgttgcaggggtgctttatgattttttagaaaaagcccgcgcctcgaatgtgagtgtttcgctgcatatgcatacaccgctttcttcccttccgttttcgcctgctgatcaggtcagcttggtcggcaacatattagaaaatgcgctcgacagcgcggcggaggcccgagaaaaagcagagattaaactggagacttcactgcgcagcgggctttatgtactgacttgtgaaaacagcactcccgggatggacccaaaagtgctcgatacaatttatcaatcgtttggccgctcaacgaaaaacggcgctcatgaaggcatgggcacatatatcattcaaaaactggtgaagggcgcttttggcaggctggattttacctaccgccaccccatcttccggttagaaatcaaaattccgtttcagaaataaaaaaaccttgaaaagcctggcttttcaaggttttttccattatgaggataacgcttgtgcaaaacgatctgcttcatcttgcagcgtgctttcaatttctttgtaacggctggaaatcgttgatgcgctaacgccgtattttttcgccagtttagcctgggaaacggacgcgccgttaagagaaattgcgtttacataatattcaactgccgccgcaaaagcttccggctttctgatgacaggtgattttttctcgcagaatgttttccagatgtcaataacagctgggatcaattcagtcggatactcttccccgctcatgccttcttcaatagccgcagcggtttctttctccaagtcgtttgcccactcaacagtgcttacttccgctttctctgcttgtggctcttcatctttctcagctaacaacgcgaacagaacgttgttgaattcctgcttcatgaagtcctccggcgttttgccgtccttcacagcggcatccgcatatttcttcaccttgctgatcagcgcttctgttctcttcaccgggaagatcgtgaactgcatgaagaattctgctttttccgcttcgtggattgggtatccaagaatcaggcttcccactggaggaaggtcttgattgctggcgtccatttccacttcgaattgttttgccgtaatgacatcttcaaagtgaatgatgccttccttcaggtccttcagcagcaataaagcaggcgtcatgctctgccatgattctacgatctcacgcgttttcggacgagtgatcgaatcgccttttttctgaaggtactcttcgaagattgtcttctcaccagcaagcgggtggaagaagattccccagattcctaagttaaatacgctgatgtctttcgtctgtctgtccatagcagaaagaaaatcatgctggttgataaagcctgaaatgctttctctatgtactgtgaaggcatactccactaagtcttcctgaatttgtttcgcttcttttgccgctagttccgccgggaagtcgacaactttacttccgcagcattttttatatttcttgccgctgccgcatgggcaaggggcatttcgtttcacttttcccacaataaaccctccgaattctgttgtaacttttctattttaacaaaaataacttctgagggcttggtttcgggctaaaaaagaatttggtaatgtgataagctggctgattatgccaatttacctatgacattttcaccaacttttgtgatttaaggcttatcacctattcccactttaggcccttcttttttacaatcattaggtgtttatttaacattttaaggagtgtttctattggaactagctggtttcatgctgcgcgcctgcgctcttttacttgatgtaatcattgccgcagcagtgattttggcagccggatttacgtttggcgatgggtccgccggtgtcattattgtcgccatattgatgctgattgtgtaccctttgctgatgccgctgacaaattggaagggcacactgggcaaaaaaatcatcgggctgcaaatcgtgagggacgaaacatataaaaaaatatccttcccgcaagccattgtccgttacctgatagcgtgggtgcatgtgttctcccgcctgatctatttgactgccgcatttacgaagaaaaaacaaaccgttcatgatatggctgcgaaaaccattgtgctgaaagcagaataaccttgaagaatagcattcttcaaggttttgtttttcattaattcgtattctggcccccgccgttcagcccttctttaatcaggctgttgacttggctgctgtacagaaggccgatgtgtccaacgccatggatttgaacgtttctagcaccatctaatcttgataagtaattcatgacaatcatatcggcactgctgtaaatggatgtgtataaaatcttttgatttggatctgttcccggaagcgccttgcctgtcgtcaaacggttcgcgccgccaagcgtcacgacgtttgcaactttatttccgccgtccagattttttatgtagtaaagtgtgttcgcgccccccatgctgtgagcgacaatatccacttttttcgcacccgtttcatctaaaaccttttgcacaaatcgtgataataccggtccattgttataatttgtgcctgtcttgtcccaaaaatcaactgcatacagcttgtcccgcgaccagccctgagatacgagatagctcttaattcccgcaaaattgaatgatgcccctccaataccgtgaaccataacgactggattgtgttcagcggcttttgctgacggctgcaacgcaaacagcgatgtaacagacagcatcaaaattgttacaagtgcaatgatccttctttttacaaatttcataatatcctcctttttttgtaacaaattctccaattatattacgttaccaaattaattaagtaaagggtaattttggcttatttttaaagaaattttaagattcagaggtcattattggtcctaaaaagccaaaaaaaagaaggcttattcgccttcttttcttcaatactcattgaaataagcttggattttttgaggatcatttgttttggtaagcgcaagcatcagcaacatccgtgctttttgggggtttaaagagttcgatgccagcaagtccttttccgcatagtcttggtttggtgtgacgacaccatttcccgtgcgggtagagcgcaccactgtaacgccttttttgactgcgctgtccgcccctttttcggctgcatcagataaagacccgttcccagaaccggcaaatacaatcccctttgctccggcttttacagcagcgtcaaacaggtagcttccgtcattttggtatccatagataatgtcaacctgcggcagctcatcaagattagaaaccgagaaatccgtgtccttcgtatgcttacgggtaatctcattattaaaatagatatcatctgcaattgttccgacgaagcccatttcttctgatttaaatgtatctgttgtagttgtgtttgttttggtgacatatcgggctgaggcaatccggtcgttaagaacaacaagcgtccctttcccttttgcctcaggggcacctgccactttcactgcattgtacaggttagaaggcccatcagcgctgatggctgtggaaggtctcatcgaaccgacaataacaaccggtttatcacttttcacggtaagattcaaaaaataagcggtttcctccaatgtatctgttccatgagtcacgacgattccgtctacatcatctgaagcgagcaagtggttgatgcgtttcgccagcttcagcaatattttattatcaatatttgtgctgccgacgttaacaatctgctcgccgctgacgtttgcaatgtccttcatttctggaactgcctcgatcagtgattcaacgccgacaacacctgctttatattcagttgttgaggttttcgattgatcggcaccagctatcgtgcctcctgtcgctaaaattctaatgtttggcagatcctttttttcagaggcagaagccgaagagactttttgtgtctgagctttttctttcggggattcttttgtttcaggagaatgtgaacatccggtaaaaacaaacaatagtgcggtaaaaagtacgagcattcgttgttttttcatctatttctctccttacatccatatgatgattaatcattgtacattttatctattcagtcaaaagatcagtcagcttttctctcagtattttttgttgtcatatccttctttttttgtcttttcatacaatgaatttttcttgacaattgatgattgaatcaagataatagaccagtcactatatttttgattgcaattcagtaaggtgggaatgttatgagttatggagattcccgtgagaaaatcctttcggcagctacccggctttttcagctgcaagggtattacggcacggggctgaaccagattataaaggaaagcggcgcgcctaaaggctctctttactaccactttcccgggggtaaagaacagcttgcgatcgaagccgtgaatgagatgaaggagtatatccgtcagaaaatcgcggactgcatggaagcctgcaccgatccagcggaaggcattcaagcctttttgaaggagctctcctgccagttttcatgtacggaagacattgaaggcttgcctgtgggcttgctagcggctgagacgtcattgaaaagcgaaccgttgcgcgaagcctgtcatgaagcctacaaagaatgggcctctgtgtatgaggaaaaactgcggcagactggctgcagcgagagccgtgcaaaagaagccagcactgtggttaacgcgatgattgaaggcggcatccttttatctttgacggcaaaaaacagtacgccgctccttcatatctccagctgcattcctgacctgctgaagagataaaaaaaacgacatactacatgcagttgatagagaggggaaatgattttggaaacaacagctaaagcatctcagcaatacaaagtgatgccgattatgatttccttgctgttggccggttttatcggcatgttcagtgaaacagcgctgaatattgcgttaaccgaccttatgaaggaattgaacattacagcggcaaccgtccaatggttaacgacgggctacctgcttgtactcggtatccttgttcctgtttcaggactgctgttgcagtggttcacaacaagacagctttttaccgtgtcacttatcttttcaattttaggtacattcattgcggcgcttgcgccgagcttctcgtttttattagcggcaaggatcgttcaggcacttggaaccggtcttttactgccgctgatgtttaacacaatcttggtgattttcccgcctcataaacggggtgccgcaatgggaacgatcgggcttgtcattatgttcgcgcccgccatcggcccaactttctcaggattggttctggagcatctcaactggcactggattttctggatctctcttccattccttgtgctggcgcttgttttcggtatcgcatatatgcaaaatgtatctgaaacgacaaagccgaaaatcgatgtattgtctatcatcctgtcgacgattggcttcggcggcattgtattcggattcagcaacgcgggtgaaggctccgggggatggtccagcccgactgttatcgtgtcgctgattgtcggcgttgtcggccttatcttattttcaatccgccagctgacaatgaagcagcctatgatgaacctccgtgcgttcaaatacccgatgtttattttgggtgtgatcatggtgttcatttgtatgatggtcattctgtcatctatgctgcttctgccgatgtatctgcaaggcggcttagtcctcactgcatttgcatctggtcttgttctcttgccgggcggtattttaaatggatttatgtcccctgttacaggccgcttgttcgataaatacgggccgaaatggcttgtcattccgggatttgtgattgtcaccgttgtactatggttcttctcaaatgtcacgaccacttcaacagctgtgctgattatcatcctgcacacctgcttgatgatcgggatttctatgatcatgatgcctgcacagacaaacggtttaaaccaactgccgcgtgaattttatccagacggcaccgccattatgaacacgctgcagcaaatggccggcgctatcggaacagcggttgcggtcagcattatggctgcaggccagcatgattatatgagtacagttaaaaaccctgccgatccggcagtcatcccgcaagctttgacagcaggcgtacagcacgcatttgtgtttgcaatgattgttgccattatcggtttaattggcgctttctttatgaaacgcgttaaagtagatcattaatatgaaaagcccctgactagtgttcaggggctttttcatgtttacttgtggatcgttttcgccgcgatttcatcaatcgcgtgccgcatttcctccttcgtattataaaaatggggagcgagacggataacattttcccgcggcgcgcaaatcacttttttcttcttcagcaaccccgccgtttccgatgcccgctcatcccggatcgcaaccatgcccggctgaatcccaccttgtgccgccgccagctgcaggcctttttcagcggcatattgaactgcatcggcacagatcgttttcacatgatccctgatatgagaaaccccaatatgattcagcagcgataaagccgctgcagctgcgtatacgctgataaaagctggggtgcccgtttgaaaacggcgcgcgacttttgcataagccccatcaaatccgctctctcttccgaaccaagctgatgctttcggcttcagtgcgtcagccagctcctttctcacataaagaaacgccacacccggtatgccgagcaaatacttccgggtgcctgctgccagcatatctacgccccattccttcacatcaatgggaatatgcccggctgattgataagcatctacaaacaataaagagccctttctctgagaaatctcggcaatcgcttttatatcctgaacatagccgtcacgataatgaacgtgaggaacacacgtcagtactgtttcatccgaaatatgcgtttcatattgttcaagcggcagcacgccgtctattgatggaatgacggatacggtataatcggagtgtgcctgccaaacatgaggcaccgccggaaaatccatatctgtatatacaacgtgcttctttccaaatgcagttaaggacgatgctacagaaaccagtgcatcagaaactgacggcacaatcgccacttcatccggttcagccccgatcagctttgcaaactcgtttctcgcaaactctgttttttcaatcgcttctttccagttcgtccctttatacagcaggctatcataataatcctggatcgcccttgatacaggctctgccaatgcgctctgagaacagctggcaagcatcgtatgcgtctgcaaggttgggaataactggcgatactgctccggcaaatgctccattatgattcactcctttacattattttgatgaaaaacccataaataaacaatagaataaaagaaaaaggagatgggagaatgagaaaaaaagtgctgatcacaggctttgacccttttgacaaagaaaccgtcaatccatcatgggaagcggcgaaacggcttaatggcttcgagacagaagaagccattattacagcggaacaaattccaaccgtctttagatccgctctggacactctgcgccaagccattcaaaaacatcagccagatatcgtaatttgtgtcggccaagcaggaggacggatgcagattacaccggaacgagtggcaatcaaccttgcagatgcgcgaatccccgataacgaaggacatcagccgattgatgaagagatttctccagatgggcccgccgcttactggacaaggcttcccgtgaaacgaatgactgctaagatgaaggaacacggcattccagctgcggtttcctacacagcggggacctttgtatgcaactatttgttctacgggttaatggatcacattagccggacatccccacacattcgcggcggttttattcatattccttacattccgcagcaaacaatcgacaaaacagcgccgagcctcagcctggacacgattgtccgggcattgagaatcgccgctgttacggccgcacaatatgatgaggatgtgaagtcaccgggtggtacgctgcactaagcggccgccgctgtttcttccctcatcctctttttgtagacaaacgccgatagggtgacactcacttcaaacaggacaagaagcgggatcatcacgagaaaatcagaaataaaatcaggcggtgtaatcaatatggacacgacaatcagcagaaaataggaaagctttctcgctttggccagtctgtaaggatttaagatgcccagccttgttaaaaacatcaccaccaagggcatctcaaacaagaagccgaacggcaggctcaaattcaccataaacctaaagtagcggtcagccgtaaacatcgtttcaaagtggccggaggataaatgagtcaaaaagctgagcacgatcggaaacaagacaaagtatccgaaggagatgcccgccaaaaacaacgcaaataaacctggtatgtacatgagcgtcaccttgcgctccgttttagtcagcgccggtgcaacgaaacgccacagctggtacgcggcaacagggatagaagccgcaatggcacaaatgccggaaagcatcatatacacccagaggatttcactcggtcctagcacagccagctttccatccaaatccctgatcagccagtcataaatgtcctgtacgaacaaaaaagccgtgatgagaaatagaaaaaatgccgcaagggtgacgataatccggcggcgaagctcttctaaatgcccgatcagatgggtttcttttttatccattcaaaaaagccctccctttcataaaaaaagaggcagacccggtgtctgcctcatcagcattcagcccgcgtttttgtcctgctttaccgctgtcagctcagctgatttctcttctttttcatcaccagacacaagtgattttgtggcgcttttaaattccagcagtgtccgtccggcggcacgcccgatttccggcagcttggaagggccaaaaataatgagggcgatgacgaagatgagaatcaagcccggtattccaatgtttgaaaacataatttccactccttaattcgtgatttttgcacgcttcttaatcatttgtttttcgtgggctttgttgtgcgaaaagaaacgatcctcttcgacctcatcggattgcttcaccccgccttggattgttgtggatgatacctttctcaacccggtttggtctttctggtaaacgaatgaagcccgcgtggaaatggctgcgcccggctcggtcacaaatggcatcacccgataatcggctttccactggtgaggcgtcactgtacagcggacatatccgcgatagtcgttaaagaactggatgtgcggattttcttttaaaatttggtccgtatccgctcgcttatccgctccgttccctccggaagtgatcgaggttccaacaaattcggctccgaatatttttgaacttgtcttctcgaaatcgacatgcaaattcgatgcccagcttgcgtgtacatcacctgtcagtacgacaacattattcagatttttgcttttaatgaaattgataacccgttcgcgctgagccgggtagccgtcccacgaatccatgctgtagatcgggcttgcgcttgtcccgaaattccacttggcaaagaaaatctgctgcgccagcacattccagtgggctgtcgagctgcccaaattgttgaagagccactgctcctgttcttttccaagcagagtccgattcggattgcgcgattcatcagaaggcggcttattgccgtcgttattggcttggtcgtccctgtactggcgggtatcaagcacattgaaggacgccaggtttccgtacgtaaagtgccggtacagctgcatatctgggccattcggcaaagaggaaatgcggagcggcatatgttcatagtatgcctggtatgctgccgcgcggcggagcacgaatgcttcaaccgactgtcctttttcaggtattttattggcatagttgttttcaacttcatggtcatcccaagttacaacccaagggaatgccgcatgtgcagctttaagattggcgtcagaacggtattgagcgtgacggttccgatagtcttgcagcgtaatgatttccgcgctgttgtgcgtgcggacattgcctgtttttgatacatattcatttgggccgtattcatatatgtaatcaccgagatggaagacaagatcaagcttttcctttgccatatgcttgtaggccgtataatatccgtgctcatattgctggcaggaagcaaatgcaaaggtcatttgcggcacattggcgccaggggcaggcagtgtttttgtttttccgacagggcttagttcatggccggttttgaaacggtaatagtacactttgtttggctcaagcccgtccgcttccacatgaacggaatgggcaagacttggtttagccatttcagtgccttttcttacgattttgcggaaatgctcatcctttgcgacctcccatttgacaggcactgcttgcttcggcattcccccgccattcagcggatctggtgccagacgtgtccaaagcacgacactgtcagaaagcggatcacctgacgctacccctaatgtaaacggatagcttgagaatttaggcgcagcatttacttcaaaggccccaaccgactgggcaatcgttaatccaagagaaagtcctgcaatcttccccgctccttgaataaatttgcggcggtcaaacgtattgttttgaaagctttcctctttcagtttctgtacccattcatcaaaacgactgtcgtatgccattcaagatcccctctctcctcattgatcgtctccattataggaaatcattgttaaacgactgtgaagaagtgtgaactgattgtaagcgctgaacattaaaaacaggtcttccctcacaagcctgctgctgaaacatgccgaaagctggctgaatgacgcgttttctgcatatcctgtcgtttgcaagccgcccattcggcctatttttcttcacatgatcttaaaaaaacaaaaacaccgagccatttcgcagaatgactcagtgctctttatcagttatttcgaaaacaatctgctgaaaaagcccttctttttcggcttttcagcaggaggctcttgttctcttacaatccctttttccttcgcttctttcagccaaaatggaaattcagcaagcagagcatcataaagctcatcatcagaaatgcggtcaatctcttcgatatgcaggaagttcgtgttatcaatgacacgcccttctaacgtatccagtttattgagaaaatcaaagtttccgtttccgatgccgacaaactgccagaacaccggtttatcagaagaagcttcaattatcggtttgattgactttttacagcccccgtcattgataaaaacaatgaaagcaggatacgagctcggttcctccgtaacatatttgcgcagcacgtccttcatgactggcggctcatcatttctgccgaatttatgcaagcggtcattatttaaaatttcacgatcgacatagcccgaaaaatccttttctgaaactggctttaatcgggaaaattcattatcatacacccatacatccagcaaaccgttatcatcaaactgatcagccactgccaaaatccgctccaccacattttgaaccgtcccgtttttgtagagcggtctcatcgatcccgtaatatcaagaaccagtccaacacgagccgtcaccttcgttaactgctttttctccagtacgatctttacacttttcttttgcaggtcaattgttgccattctgtcatctccgtcagctcttttttctttgattatctcacaggaatattttgcattgcatcttttcaaagaaaaacaccgttcaatttgaacggtgtcctgtctctaaaatgtgttatatacattttcacacgtctccgccgtcggctgataaaagcagtgtgacttaaatctggccacaaacggctggttataccactgggctggacagtccccctgcggcctgaagtaccataaactaaattttgcaggccagcgcctttcaccattaatcgaccggcgtgcaagggcacgctcgctatctcgcgccctttgataaaaatatccatgagtcacagcctcaaacgcgtgtggctgataaatcatctgcctgatggtgcggaggcctttaaaatctgagcaattcgcccgcagccgattaattccaacgttgccgacaagcagcatcccctgcttgccttcgccttccgcttccgctctgagcagccttgccatcaaatcgacatccgcactcgttgctctcacgaccgccatcacgtcacctccccttgatctcttttcatcatatttcattacttcagaagtgatgacggagggacaggagaagtttttaaatttattcatctaaaaacagcaaacataatgggctgttgggcatcaaagcagcgtccggtgcagtacaagcttcacgtttccgctgtcgaagcgccgcagcctcaattcctggattcacatcattgacctctccccagcagatttgcacccgcctccgaaaagaaataaggtttaactttttacatttgaggaattatacataacaaatcaaatgacaaaaggaggaattgtaatgacacatgtgaaagcgctcgctattaaaggtattatgacgattattgtgttgtatctggtgcttggtctgggctttggtttcacgtttggtgatacgctgctaatgacgattgtgttaggggttatttcttatttgctgggcgatctttatgtattgccgaaatggaataatatgattgcaactttggctgattttggtttggcctttctcgtgatctggctgatgggcatgccgctttctatggggatgactggcggtgaagttgcattggcggctttattcggcgcgatcgtcatggcaatcggtgaatattgcttccatttctatatgatgagcaaagagattggcaagaagcattatcttgaaacaagaacagactcataatggaaaggccggtgctgacagcatcggccttttatacatattgggcgcctttgtttacgcatcctgcttgtccgcattcctgatcgccatgtaggaaaagaacaaaccgaatgccgctaacgataacgggatatacacaacagatgaaatcgagaagcccggacttgttgagctgatgagcatcacaattactacagatgaaatgatggtcgccggaaccgagtgtctacgcatcccaaaaaagatgggaactaaactggttccagcggcgccaaaagcgaaaaccgccattttgaccgcctgttgagaaatgatctcggaagtaagctctcccggtatgaaatggcagatcgagttcagccaaaagaaaccggcggctatgagtatatttgaaagtaaaatcgtgataaacgtcagtccgcccgcgatcatgagcttagcggtgagcagctttttacggctgatcgggtacgtgaacatcacaagaatggttttgtttttatattccgaaatcaccaattttacgatcagcacagcgccaaatacgataaataccgctctgacgaaggtgccgatgatgaggaatgcttcatccgtactttggaacgaaaccccgccatcggctttttcggaataactgatcagccacataaaacccataatgatcacgttggcaatgagggcacctctgatataccagcccattttcatttttcttaattcgattctgatcaaattcatcaacgtgtctctcctcctttacgcactgatgctattgccgttgatcaatttgataaaataatcctccagcgacgtatactttttgttcattgattcaatgtctacatcatttaaaatcaatgctttggatatggcagcctgagaggcttcagcctcgtaaattcgaatcgttttctcatttaatattttaaagttggttaattgcagctctttctccagcacaaagcaggcccttgtctgattcggcgtgacaagctcgatgtattcagtgttctggcccctgacatcctccattgatacctcttcaagcagcctgccgtcccgaatgacgccgattgtgtccgcgatttgttcgatttcacccagcaggtggcttgagatcagcagcgtcatcccgtactctttgctcagcacttgaaacaattgcctgatctttttaatgccgagagggtcaagaccattcaccggctcatccagaataagcaggtccggcttcgtgaggatggcacgcgcaattccaaggcgctgcttcatcccgagggaaaaggttttgacgggttttttgtcgatttgttttaaattcaccatatccagcacttcttgtatggcttttttattgtggtatcccatatattcacaatgcagatctaaattttcttcagctgtcaggttttcataaaaaatcggatattcaatcatgctgccgatgttccccagcacctcatatgacgtgtgggtgaacttgttcccaaggatgatgatttcaccgcttgtcggtttgacaaggctcgtcagcattttcataatggttgttttccccgcgccgttcgggccgagaaagccatagatttcaccttttttaatatgcatgctgacattggatacgacctctttgccctgatatgttttggtcagcccgtttgtttgtacgatataagtcaactttgtttctccttccctctcttttcctgttttctattgtagcggcgagccctgtcatttttatttctcaaaccttaagaaattcttacgattaatatgtcatgcgtttcaatgtgatcgtaaatgcagtccgttcgtacggcttgctttggacggatatgatgcctcccattttttctgtaagccgttttgtgatggttaaacccaagccgcttccttgaaatgctttatttctggattcttccagtgtgtacagcctctcaaacacccgctgctgatcggtttcactaatcccttttccgcgatcccatacggtgatggcgatgttcctctcatcataagacagcgtcagcccgattaacttgccggccgcgccatattgaatcgcattggacaataggttttgcaggattctgtccagagcctcttcattcgcctgcgcatacaccggcgtatcggggatatcgatggctgcttgaaagccttttgactgaacagcgtcataatagtgcaggatatttcgtttgcatatgtcgttcatatgtactttggtgatcgggatctctttatcttcagattctaatttcgctaaatcaaaaaaggaattgatcatctgaataagttcatttgttttctggcggagcttccccagcaatctttcccgctcttcgtccggcatgttcgggtcactttgaatggcttcaatataaccgagaatgaccgttaacggcgttttcaggtcgtgcgacatattggtcagcatccgcttcatggattgctctgttttggcaaattgggcgctgatctgctgacgattctcaacgataagattgatgttaacaagcaagtctttgagcgcatgatcgtctgtaggaagcaaaatttgtcctgccgaatcccggctgagcatgtagctaagctggtcagccgtgtaagccagattcccgtcccgcttctttttcattatgaattgaatcacattcagacacgccagagcgatgacagcggccacccatagcactgtcattctaaaactctcctaatttataaccgatgccccataacgttttaatatattgaggggaggaggggtcatcctcaatcttttctctgagccgccgcatatgtacgttaatgatgttctgatcatcaaagtactcttcattccaaacggaacggtagatttgttctttcgtaaacacttttttaggatttgatgcaaataagcacagcagctgccattctgttgacgtcagctggagcggctctccgtttttcaaaacggaaacattgtctatatctatcgcaagctggtgaatccggatcaccttattcacagccggctcctctgccgaatattgcgtcgcccgccgtatcgcggcttttactcgggctgtcagctcaatcatcgaaaacggtttggcgatataatcatccgccccaaagcccagtcccaatgccttgtccacatctccatcttttgccgaaatcattaagaccggtatattgcttttttcccggatgattttcagaaaatccatgccgttcagcttcgggagcatgatatcaaggaggaccaaatcgtatgaaccctgctgaaacagccggatgccctcttctccgtcgaaagcatgcacaattccaaagccttcttttgttaaataatgatccaccatttcactgattgagtggtcgtcttctacaagcaatatgcgctgcatctcctcacctaacctttacaaaatcaaaaaacacacacgtaattacacttattgtaattgaaaaacgtgtgtgttttataaaaattattctttttttcctgttttcagcttcctgtattccatgcccgtaatgacaaaaaatacgccaccgcatccaatgacttgaatgagcccgagccgttcaccgagaaataaagctccatagaaaatcgtcaggataggccctgccattgaaatggcggcggctcgctgtgccccgattcgttttatgccctcaagcattagcacaaatggaatcactgtggtaacgactgcaattactgcgaacaaaccatacatagaaagcggatatgctgccattggcgtattcatgccagccgccgattttatccctgtgtaaagcatcatggcagctccagcagctgtcatcccgtatgcattgagacggatccctccgatttgatggacgagatgcccggaaaggacaagataaccagcatagacggccgaagataacaaaatgaatacagctccaatcatattcgcctggaaaagctcagcattccagccgcccagcgccaagaaaagcccaaacatgaccgccagaactgcgaaaaggtcctgaattgaggacattttccggtcacgacacgcggtgaatccaaacacaaacaacggatagctcatcagcaatatacgttcaaccattgcggatacatggttcagcccgataaaatcaagcaagggagacagaaaaaaacaaaacactcccgcgccacaagccttccataggtctccttttttcttaccgtctggcattggaggacggtatattaaaaaaatcagccaaaacagcggaacagccagcagctgcctgtatagcagcacggcatctggctcagcacccatttggtatgcccattttatccaaatcgatttagacgcaaaacaaactgttccgatcagcaaaaaaatcgtacctgctgcggcctcacgaatcttactctgctcttctgctctcatctcagctcagcttttctcctttacttattcaaatgcttttggataaaatcgagaagcgtatatccttgagcagtcagaataacaccttttccgctgcaggccgggcaaggtgttccttcgatttctcccgctctttcacatttaggacatgcgacctcaagatcatcagttgcaatgaccatttgatatcctcctttctaactcatctgctatgccaccaccagccatcgtacattggccgtcacctcctttaagaaacacaaaaaacccccgtcctatgcaaaggacgagggtctcgcggtaccacctttattaacagctatacagccgttcactctaagtacagaaaacctatgtttcgatactcctctcttggtaacggggagagaaacccggcatcgcctactatccgttcagcaaagcaattcagaagcccattcggcatcaggggaggatcggttcacacctgccaccgactctctgaacctccattctgatgcgtacttgctcttcctcacgattgttaatccgttctattatttgtagagtttataatactcggttcatgaaacgaagtcaattcttaatccgatgttacaccaagtgcttccagcgccatattgatgtgttcctcctgctgtgtttgcagagctagcttggcgatttccaccggatacgccgcctgcatctctgagatgtgttcctgcatttttgcccatattcggccgcctgcttgatcatagtattcaagcaaacgggcagtttctttttctccgaaaatggtttgataaagaacaaaatccttggctgggtcagcaaccttcgcttctgtccaatccagaagtcctgtgacacgtccattttgatcgataaggatatgcggcgggtggagatcgccgtgtatcaaagaagagaaacccggccagtatgcatcatcatctacccacttttgccatctttcccaaagcgtcgtagatacgccaagcttattcttcacatcaaccatagagtctgctgtcatttgcctgaaatcttctggccttatcacttctattccggattgcccagcagatatttgatccgtgccatgtaattcagccagtatgtcggcaagtgtgcggacaaagtcgtctgacggcggctgatgatccatattccatacatattgcttttgttccaagtcaattccagcagccggcgttccttttaacatggggtaagcgatcaattccggtgtatgaattctccaatccggcacatcagcagtcagattcgcgcggagaaaggcaagcgttatgccttctgcagatgctctttccacaacatcacttcgccgcggttttcgcagcacccatggcatacctgtgtcgtccttggcaaatacaacttgaaagtccattccggtttcattcaattgcgcgttctcagaatgaaccgtcaaaccttggctgcgtgcaagcccgacaatctcagtgataagctgtttttcgttaaggtttgtcatcccatttcccctttctcatgctccggcctgcagtagagagaagggatgcttgaaggcacaaaaaagggcaggcacgccaccctcttttttgataaccatataagggctcatacataggcggattcatcccgattctctcgcattcaggcgagagttgttcactattgaattcgtgtcactcggaatctaatgaatgccatgctgtaacccctccgtttcctatacgctgattttcattttacagcatattccatctttccgctataaaaacatgaatcaagtcactggagcaggattaaacaagcacaaatcattatgaagaccccaacggtctgcccacgtttgtttgcggccgcttgccacatccaaaatcgtcctgaagatttcccagcctacgtcttcgatactggcctctcctgtcgcgattcggccggcattgatatcgattaaatcagcccaatgctctgataaggaatgccgcgtcgatactttcagaaccggcgcagcagccaggccatatggtgttcctctccctgtcgtaaacacctgcaaattcatgcccgcagccagctgcagggtgccgcacacaaaatcgcttgccggtgtcgccgcgaacagcaggcctttttgctttgctctttcaccagggccgagcacgccggagatggggcttgtgcctgatttcgctaccgaacctaacgctttttccaccacattggataatccgccttttttattgcctggtgacgggtttgcgctacggtctgcgtctccccgccgaagatagctgtcataccacttcatctctttgatcagcgattgtccgacctcttcactgacagcccgcggcgttaataaatgaatggcatcccgcacctctgtcacttcagaaaacaaaaccgttgcacctgcgcgaaccaataaatcagccgcataccccacggcagggttcgccgtcacgccggaaaacgcatcactgccgccgcattgcaggccgataaccagatccgaaacagggcatgacacccgggttctgctgttcagcctgattaaccgttcctccgccatttccaaaatggattggatcatcgccgcaaaacctcggtgatcctggagcgatagaatgtcatcatcattttcggaggcaattctttccgggaggagcttttcacatcccaatccgattaccattacttcaccgccgaagttcggatgcttcgcaagattttgaatcgtgcggatcggaatgacagcgtcgggcgcattgatcgccacgccgcatccgtattgatgatgcagcggcacaacgtcatcgacatttgggtatttcggcagcagctcttcttttattcgtttgactgcataatccaaaacgccaacaacacattgaacacttgtcgtgatgccgaggatattttttgtccccgcactgccatccgcatttcggtatccttcaaatgtatatccttcaagtgggggccgcggctgcggcaccctgtttgcgagaggaagatcgtctaacgccggaggagcgggcattctcacgagggcttcccgtatccagctcccgcgtttgatcgtctcatcagcaaatccgatcacctctccgtaacgcacgatctcgtccccttgattgagatcggtgagggccaccttatggccttgaggaacatcctcttcaagtacgagcccgcatgagaaaacagtgccctttggcagccctccatcatttacaataatcgcggtgttatctatttcatgcactttgatgtaaaggggggcttggttcttcctgaggttcatcgccatatgaaaatcactcctcatattttagtaagcgttttctaaattggtttaaaaaaaccgcagctcttacgtttcaactgcggttgctcaccattatttttcatccattccttttagaattttgtcacggacaaatttcagatgctcatacatgtggtaatgtgctttgtacggatctcttttggcaagggcgtcgtagatttttttgtgatattcgaccgttacatctctctccctgtacggaatttggctgtcaattttcgcatgggtgatcagcagggactgaatcatcccttcaacgacggggttattggcgcttaacgcaataattcgatggaactctttatccgcttcaccataatgattgtcagtgctgttggcaatatcgtcgatcgtcttctgcaaacgctgaagctcttcctcattgattttttccgcggcaattgtcacgagcccgagttctagcgccatccgcgcttcaatgatagccggaagattatcagtggccaaagcaagcatgacggaaaatggctgcatgccgattttatcgttgaaatatgtgccccctcgtgtttttctcgtaatgacgcccagcgtttcaagtgaactgagtgcttcccgtagcaccggcctgctgacatgcaaaatgtccatcagttccatttctgtcggcaatttgtctccggccctcaactgtccgctcgataataaatggacaatccgttcgatgacctgcttggctaatgttttccgattgactgtatcgactttcaaatcctctaaaccttcgtacacgaacaactctcccttcagttgttcaattgtaagacaaaatagcggatatgacaatatttacaatcaaacttatcgcacaagacacgggcgcttccggtcaaattcccagttgctgatcaggaactgcattgggatcgcatcattccgtgcgcctaaattcattttccgatagatctcatgcgctttttccacttgttccatatcaatatcgacgcctagtccaggcttatccggcaccttgacacagccagaagaaatctcaaaaggctgtttcgttaatcgctgcccgtcctgccagatccaatgggtatcaatcgccgtgatccgccccggagccgctgctgccacatgggtaaacatcgcaagggaaatatcaaagtggttgttggagtgcgagccccatgtcaaaccccaatcatggcacatttgcgcaacccgcaccgacccttgcatcgtccaaaaatgcggatcagccagcggtatatcgaccgcgtggagctgaatcgcgtgacccatttcccgccagtcagtcgcaatcatatttgtcgcagtcggaagccctgtcgcgcggcggaattcagccattacttcacgagcggagtagccattctcatccccgcatggatcttccgcatacgcgagcacatcttgctttcctttgcataatgcaatagcttcctctaatgaccatgccccgttcggatcaagagtgatccttgcctctggaaaacgtttcgataatgcggtaacagcttcgatttcctcttctccccgcagcaccccgcctttcaatttgaaatcctgaaagccatagcgctcctgtgcggattcggcaagacgcacaatggcctcgcttcctcatggcgcagacggaaccacgcacaatctgactgctcatcgctttgatacggcaaggtcgtccgatttcggtcgccgatgtaaaagaggtaaccgagcatttttacttcatcacgctgcttcccttcgcccagcaaagccgcgaccggttcctgaagaaactttccaagcaaatccaacaaagccgcttccagtgcggtgacggcgtgcacagtggtgcgcaaatcaaacgtctggtttcctcgccctcccctgtcctgatcgccaaactgctttctgaccgtttgcaatatcgcctggtacgcaccgatagattttccgacaacaagcggctctgacagctccagtgtgcggcgaatatgctctccgccaggcacctcgccgactccctgatttccgctgctgtctgttaagattacgatattccgggtaaaaaacgggctgtgtgctccgcttagattcagcagcatgctgtcatgtcccgcaacaggaatcaccttcatttcagaaattgagggaatattcgatcttttttctttttgaacctgctcttgtatcggtgaactcatgcattttcctccctttataaagcgctttcataaatattagacaggcaacgattgatcggggtcttgttcttgtttctttaacacgacccgtttgatcggcccgaccagcagcaaatagctgaggatcgccgcaatcgcgttagcgccgacaaacacaagcgcgccattgaaagatccagtggcattgacaatgtatccgataataatcggtgttgtaattgaggcaatattcccgaaagtgttgaacaaaccgccgcttaatcctgcacattctttcggagacgtgtccgacacgacagcccaacccaatgcgccgaagccttttccgaaaaacgcgagcgacataatgacaacgacgagccatgctgaatctgtgtagttacagacaatcatactgcaagacagcagcatgccggcaatgattggcacttttcttgcaaaggtcagtgaacggccttttttgagtaagatgtctgacacaatgcccccaagcacgccgccggcaaatccgcacagcgccggcagggaagcgacaaacccagcttcaagaatagacatgccgcgggcctgaaccaaatataccggaaaccatgtgagaaagaaataggtgagagtcgtaatacagtattgcgcgatgtacacgccaatcagcatgcggttcgttaacagctgtttgatatacggccatttcgattctgtttcttgtttgcttttactgtcatccatggaaatcagcccgccgccctgttcgatgtacgcaagctcagcttcattaaccttcggatgttttttcggttcatacaccgtttttagccagatgacagccagaagaatgcctgcaatacccatgacaacgaaaacggaatgccagccgaaagagtgggtaagccagcccattaaaggagaaaaaatgacgattgcgaagtattgtgctgaattaaaaaaggctgaagctgtcccgcgctcggagcttggaaaccatgaggcaacaactctgccgtttccgggaaatgaaggcgcttctgataaaccaaccagaaaacgcagtgcaaacagcaggataatcgctgtgccggcggagaaaaagccaatcgccccttgcagcaacgtaaaaaacgaccagaaaaagatgcttaacgcaatgatagtctttgaaccaaaacggtccagcagccagccgcccggaagctgtccgatgacataggcccagccaaaggcagaaaagacatatcccatggcgaccgagtccaatcccaaatcgtgctggacggaatctccggtgatggaaagcgtcgctcgatccgcgtagttaatagaggtcacaagaaacagcataaacacgatgaaccagcgcacggacgtttttttgcccgccggagtaacactcgcaaagtcttttttcatagtatcttctccttttcaaagtagagaatcatatgctggttgtgataaaccgggaaagagacgcacgcctctttccagcaccattacggcttcacaaaaacagttttgatcgctgtgaaaaagtccttcgctgcctcaccctgttctcgggagtgggagctcgactgcttcatgccgccaaaaggcgcctgcagctcaacacctgcgctttctgcattgatccgaaccagcccggcatcgatttcatcaatgaaagaaagcattcggccgatgttttccgtgaagatggatgcacttaaaccgaacttcacatcattggcgatgttcagcgcctcctctatcgagtccaccttgatcaaggcgatcaccggaccgaaaatttcctcctgggcaattgtcatctcagatgtcacattgtcaaagatggcaggctgaacataatagccgttttgatactttccgttctccagcttttctcctcctattaaaagggaagcgccctcctgtttgcctttctcaatgtatgacaggcagttatcaagctgattcttgctggctatcggtcccatccagacatcctcttttaagctgtctccgattgtaatatcttttgtgcgctggagcagtttttctttaaagcgctcgtaaattccgctttgtacgatgacacggcttgtcgcggtgcatttctggccggttgaacggaaggcccccgttatgacagcttctgccgcagcttcaaggtcagcgtcatcagctacgatgacagggtttttgccgcccatctcaagctgatatttggctcccctcgctaaagcggcttgcccgatgatttttccgacttgatttgaaccggtaaacgtaacggcgtttacaccgtcatgctcagcaagcccctgcccgacaacagaacccgggcctgtcaccaaattgatgacccctgccgggagccccgcttcctcaaagcaggcaatgatcttcgcgcatgtcacagctgtttctgtcgccggtttgatgacaacggtattgccgtataccaatgccggcgccattttccaaatcggaatcgccactgggaagttccacggagaaatcacaccgaccacaccgagcggaacacgggtggtaaacatgagcgcgtctttgtcagtagacggaatgacgtcacccgtttttcgcatgccctctccggcgtaatagcgcagaatggcaatcccccgggctgtttctcccttcgcttccggcaatgttttacccatttcacgcgttgcacaggcggcgatttcctccaagcgctgctccatgatatccgctgttttgtataagtattggccgcgctcggcacccgtcagctttctccaagccgttttggcttcattggcggcggtgacggcacgttccacatcttcagccgttgaattctgtacatatccgacaatatcattcacatcggcagggttttcgactttgaccatatcgcctgattgagacttaacccactctccgttaataaagttgaggtacgtgttttgttccgtgatcacagacatgcccattgcccctttcgtgttttttctggtcaaaccgtcgcggcttttttcggaaaacggtcagccgcctgcttcaaaattgcttccaattgctgataatgatctttttcaaccgggccgacaggcggtctggctgtattccttacattcaaacccatgatttccataccggctttaatcaaggatacggcgtagccttttcgttgtttgcgaatgtcgttgatcggcagaatcacatgccgatagagttccttcacaagctcgtcatttccgtttttcaatgcatcatagaacattcgcgaaatatgcgggatataatttgaaatcgctgaagagtaagagtggaacccgatcggcagataagccggcatcgtcacttcagccatcggcattccgttgagccatcccaagcggtcgccgatcgtatagacgagattgatattcaaatccatatttcctaccccgtctttgacaccgacaagctgttcacattcggtcagacgtttgatctgttcaacagagagaactgcgttatcgcgctgataaagaatcgcgttcaagtcagtgctttcaataatcgttttcgcatactggtacagcccctcctgttcgccatgcaccaaatacggaggcagaatcaagtagccgtcggcgccttttttctccgacagctgcgcccaatcaagcgctgtgctgaggttgccgcccacccccgtgtagaccggcacctttcctccggctgccgagactgcgacttccaccatttgctcatattccttctggctgagagattggaattcaccagacccgcaagcgataaatatcgcttccaagccctcattcagcaaaaactcaatgttttgaaaaagagcttcttcctccagttttccttgtgtgttaaaaggagcaaccggaaaacctaaaattccagcgggtgcttttctgatacggctcatcaacataacctcctgttatttgtgtatacggcctctatctgtaagcgcttttattaatttttctttcacatccgctccttcccatatatccttttgtttaattgtaagacaaataaacaataagtcaatatctttattttctgatattttataaaaaagcggtaaatcactgtccggccgggattctgcgcagcaaaaaaacagcctggtcagccggctgtttggtttatatccttctttgtttcatcgtctcatgcaaaagctttgcttccaaaaaaaacacgtggatgaattttttcatatttattctagcaggtgcaaggggttttgcatccttggattggagttctttcattttctggctgacaaccggaaaatcaaagaatttcgatgcataggtttcaaattttggattcgaaaaatcagttgtgcccagtgaagcaaaatggtgcagcgaatgaataatcgctctgcggatacgctgctccgaggctttcatttcgcgattgacttccgtctgtgaggctcctgtccccagcttccgtaccgctacttgggtgaatatttgttttagcgaagggctttgtttttcgtgcggctcggattgctcgtgttctgctaaatactgcaggaccgccatgagatcatgtgcgccgccttctcccatcatgcccagctcggacaacaggaatgttcctgcctcttttaaaccgctgtcactcttctgctggggacgcgctttccgttcagtccgattgacaagccggcttagagaatgctgaatggctccaatcgagtgttcaagctcgatccgctccttcaccttttggagaaccgtgacaatttcaatgcggttaatcggcttatggataaaatattcgatgccgagcgagtacgcttccccgaccatttccttcgcctccacttgagagatcattacgattttgccggagtacgtattctggatctgacgaatcgtctcaatgccgtctcttccgggcattaacagatcgattaataaaatatcaatctgcttaaattgcagcatatgcccttccacttggcttccgtcgtctgcttcaccagcagcttccccgagatcttcgtcctcaatgatctgccttaaaattgaccgcaccgcacggtcatcatctgcaataaaaaaacgcatagcttttggttcaccctttctgaatcaaatgccggacaggcagcctgatggcaaacaccactccccgctgctgattatcaaacgtgatatccccttctagctctgtcacgatttcctttacgtaggaaagtccgatacccgtagaaggcgtgccaaattcgtcatattttgaagtaaagcccgggtcaaacacaatgtctccgattttctcggaaatcccggggccattgtcttccacctggaattctaccatactctcatttggcttacggagcctcaggctgaccattccctcttcatccatagcctctaccgcatttgctgttagattattaatgatcgaaagcacgataaatacgtgatattcgtcatgctctccctcgatcgagcagtaaaaatcaatctgcttccctagtgcttcagcgtacttttcattcattcgaatcacgagctgcagcaaatcagaagccctcatataatctctcaaactctcattcgaaatcagttttgaaagccctgcgaatatccgctggttgtcctttttcacttcatgaatctctccggccagtctcaggattctgccgctcagctgaacatccttgcccttcatttcccgatagagctgatacgaatcgtttgtcactttctctgtcgttttcaatgtcttttttaggtgcaccgtttcttcatataaattggaaacgatcatcagcatgtgctcgtgctgctgccttgtctgtttttctctcgattgtgtttcatacagcttcagcacactataaaagctcatcacaataaatgtgtgagaaatcgcaatcaccgcaatgtcagtgattttctcaggcgtgacaaccgtatgaaaaatgagaaattgcacagttagctcgacacaatctgacacaacttcaatcataaacccaatgaaaccgagcataatcggccgttcacggaaacgattggcctttaatatggaaaacagacaggcgtaagtcatataaaagaaaaagccagacgcttgatcatacagaatcggagtcagcccattgtgtcctccgccccataattccagaaagacgcgaaagatgaaaacagccgctccagtcagaaaacccggcagcacagcgggcacatgccgcaacaatgataaaaagaagaaaaaaaccggtgccccaaagctgacccggaattcttcattgaggggataaaatttcagttcaccggccagcggcaccgtaatcagcatgagggccagtatatatccgtctttttcaataaaccgttccagttttatgttgatcacatcctcgctttttattttggggaatcgggagaaaacctgcaaattgcttttgacccagaacatgaggtttttataaatcttactgcttattttcaaaatgtttttgtcgtattttgtatgattctgtagtctccattatacagtaattataccttccgctattatgaaagcgtttaacgcccccttagccttcgttttgatacacctcagtcctttaagaaaaaaatcagtgaggaggaattcgatgaaagaattgataaaagagcaccagaaagacataaacccggcgttacagcttcatgattgggttgaatactatcgcccttttgccgccaatggacaaagcgcaaactatatccccgctttaggaaaagtcaatgattcacagctcggcatctgtgtattggagcctgatggaacgatgatacacgccggcgactggaacgtctcttttaccatgcaaagcatttcaaaagtgattagctttattgccgcctgcatgagccgcggcattccctatgtgcttgaccgcgtagatgtcgagccgacaggtgacgcctttaattcaatcattcggctcgaaatcaacaagccgggaaagcccttcaatcccatgatcaacgcgggtgccctcaccatcgcttcgatccttcccggagaatctgcatacgaaaagctcgagtttctttactcggtgatggaaactttgataggaaaacggccaagaattcatgaagaagtattccgttctgaatgggaaaccgcccaccgcaacagagcgctggcctactatttaaaagaaacaaactttttagaagctgaagtagaagaaacacttgaggtgtacttgaagcaatgcgctatggagagcactacagaagatattgcgttgatcggcctgatccttgctcatgacgggtatcatccgattcgacacgagcaggtgattccaaaagatgtggcaaaattggccaaggcattaatgctgacgtgcggcatgtacaacgcttcaggcaaatatgcggcgtttgtcggcgtgccggccaaaagcggcgtctccggcggcatcatggcgctggtgcctccaagcgccagaagagaacagccttttcaatccggatgcggcatcggcatttacgggcctgccattgatgaatacggcaacagcctcactggcggtatgctgctgaagcatatggcgcaggaatgggagctcagcattttttaaacatgaaaaaagaggtgattctatgcagcaaatcctagaacatatcgtcggtattgcaaatgatcttttgtggtcaaagctattaattgttttgctcctttcttttggaatctattttacgttcaggcttaagtttttacaggttcgcatgctgaaagaaatggtcagggtattaagagaaggtgctgcttcccggtcaaaaaacagcatttctccgtttcaagccttttgcatcagcatggcggcccgtgtcggaacgggaaatattacgggcattgctatcgccattgcactcggcgggcccggtgcaatcttctggatgtggattatcgccattatcggatcagcatccagctttgtggaaagcacactggctcagatttataaagtaaaagatgtaaacggcttccgcggcgggccggcgtattacatggaaaaagggctgaacaaaaggtggatgggcgcgctgttcgctgtgttaatcaccttatcgttcggtatcgtcttcaactcggttcaatccaatacagtcagccttgcctttgaaaacgcgtttggcacaaaccgcctgacattgggactcattttaattgctgtattcggcacgattatttttggcggagtcaagcgcattgcaaagctggctgaatccattgtcgtcgtattggctgtcctgtatatcggagttgcgtttttcgtcattttctccaacattacgcagctgccaggtgtgcttgcgctaatcgtgaaaaatgcgtttggttttgaccaggccgccggcggggctttgggcgcggcactcatgcaaggcgtcagacggggaatcttttcaaacgaagcgggaatgggaagcgcaccaaatgccgctgccaccgccacaacaagccatcccgtcaaacaggggctgatccaagcttttggtgtactgacagatacactggtcatttgtacaagcaccgcttttatcattctgttttcggatgcctatcatactccgggtctgagcggaatcgccttgacacaagcctccctcagctcccatgtcggatcatgggcatcaggctttctcgcgattctgattttgttattcggattctgtgctctaattggaaactattattatggcgaaaccaatatcggctttttgaacaaaagcaaaaaactgatttttgtctaccgtatcggcgtgctggcaatgatcgtgtttggctgtgttgccaaagtccagctcgtctgggatcttgctgatttgttcatgggtttgatggtcatcgtgaatttaatcgcgattttcttactatcaaaggtcgtttttacggcgctgaaagactatacacgccagaaaaaagcaggcaaggatccggtcttttataaagatgtgctcaaaaaccataatggcattgagtgctggccggtttcagacacaaagactgacacgcacaacaaacaaatatcataagaaaagggtgttcagacatatgggctgaacacctttctctttttgcgtttattgacaaacacgtaagcctccattacgattttcatatctttttcaaaaaaatctgaaagaaggcatcggtacattctatgaatcctatccaacacatattagatacatacccgcttattgtgctagacggcgccatggcgaccgagcttgaacgcaagggctgtaatttgaatgacagtctgtggtcggcaaaaatcctgatggaagagccggagctgattaaacaagttcatactgattattttgcggcaggcgccgattgtgcaatcaccgccagctatcagtctacatttgaaggctttgccgcacgcgggctgagcgaagcggaagcacgccggctcatcgagttgtccgtcagcatcgcagctgaagcacgtgatgaattttggtcgcttgaagagaaccgtttgaatcggccaaaaccgatcattgcggcttctataggcccttatggcgcttatcttgcagacgggtctgagtatcgcggcaactacgcaatatcagaagatgaactgattgaatttcatcgcccccggatgaaggcgctgattgaagccggagctgatgtattggcatgcgaaacgattccgtgtctgactgaagccaaagcgattgttcggctgttgaaggaatttcctgaaacgtatgcatggatcagcttcagtgctaaagacggcttgcatatcagtgacggaacacctgcagctgactgcgcatcgtggcttgatgaacaccgccaaattgcagcactcggcatcaactgcacgccgcttcagcatatcccttccttgatagaggagttaaaaaagaacacgtcaaaaccgatcattgtctacccgaattcaggtgagcaatatgatccggaaacaaaaacgtggaacggcgcagcatgcgcagaatcttacggggcgagcgcccgcacctggcatgaaaaaggagcgaggctgattggcggctgctgccggacaaaacccgaaaatattcaagaaattgcggcttgggcccgctctttaaaaacaacttgacttatcggaatagtttgtatattctaacttaaagccggttcgccggagtctcgtgtcactttctgacatgagattttttattaggaaggaaataaatcgctgatagaaagttggaaaaagatgaactctgcccacaacaagaatgagacaacctttcagagaagtatgaaaagccggcacctctttatgctttccttgggaggtgtcatcggaaccgggctgtttttaagctcaggttataccattcagcaagcaggcccggccggaacgatactcgcctacttagtcggggccggcatcgtctatctggtcatgctatgcctcggtgagctgtcagtcgccatgcctgtgaccggcgcctttcacacctatgcagccaaatacatagggccgggcaccggatttacggtcgcttggctgtattggctgacatggaccgtggcattgggatcagaattcacagcagccggcctgttaatgcagcgctggttcccccatacatcggtttggatgtggagtgccgtctttgcgctgttcatcttcttgcttaacgcattttcggtcaagtttttcgctgaatcagaattttggttttccagcatcaaagtattagccattgtattatttattcttttaggcggctctgccatgttcggcatcatcccgatcaaaggcggagaagccgctccgatgctgtccaacttcacggcggaaggcgggctttttcccaatggatttgtcccgattttgatgacgatgctgtccgtcaattttgccttttcgggaacggaactaatcggaatcgcagccggtgaaagcgttgatcctgacaagacgataccaaaagcgataaaaacaacggtctggcgtctctcgctcttctttgtcggaacaatttttgtgctgtcagggctgattccgattcaagatgcaggtgtcatcaaaagcccgtttgtcgctgtctttgacagagtcggtgtaccatacgcagccgatatcatgaactttgttatcctgacagcgatcctgtcagcggctaattccggactctacgcttcttcccggatgctgtggtctttatcaaaagaaaaaacgcttcatccgacatttgcaaagctgacgtcaaaaggaaccccttttaacgcgctggtgttcagcatgatcggcggcattctgtcgttgctgtccagcgtatttgcgccagacactgtatacgttgtgctcgtgtcgatttccggttttgccgtcgttgtcgtgtggatgggaatcgctgcttctcaattcatgttcagaaaacgttatatcgaagcgggaaacaaggttactgatttgaaatacagaacccctttgtatccgttcgtgccgattgctgcgttcctgttatgcctggcttccgtcgttggcattgcctttgatccgaatcaaagaatcgcactctattgcggcgttccatttatggccatttgctatgcaatatattatgtaaaaaaccgcaaaagccagccggctgctgatatgactcattcaaaataaaaagaacctgcctccgggcaggttctttttcgattttcacacttccactgtccagttaaacgggccttttaccttgccaagctgaatatctgttatcgtttcatacagctttttcgagaggtccccgatttgcccgtcgcctacaatcaccgtttttccatggatgttgagttcaccgacaggcgtaacgactgctgccgtgcctgtgccaaagacctctgtcaattctccgcgtgcagaggccgcatacacctcatcaatcgatattctctcttcacgaaccggaatgccccagcttcgaatcaattcaatcgcagacgcacgtgtaaccccgcttaaaatgcttccgcttaaagcaggtgtgacagcttccccgtttatgacgaaaaagatgttcatgctccctacttcttccacatatttcttttcgatggcgtccagccacagtacctggtcatagcccagttcattcgctttccgctgtgcctgaagactggcggcatagtttccagccgtttttgcaaacccgactcctccgttgaccgccctcacatactcatcttcgacatagattctaaccggcttcagctgatcgtcgccataataggagccgacaggcgaaagcacgatcataaatgtatagctcctggatgccttcacaccgagactcggttctgtggcaatgacaaaaggacgaatatacagtgacgttcctttttcctttggaacccaatctttctccagctcaactaattgcgtcaatgcctcaagcaccagctcttcgtctaaagggggcatgctcatgcgctcacacgatctgttcagccgtttgatattttgatccggacggaacagcagcaccctgccgtcgtctgttctgtatgcttttaatccttcaaaaacagcctggccgtaatgaaaaacagatgaagacggatcaagcgtaagcggtgcgtacggcgcaattctcggatgatgccatccaatcccctcttcgtagtccatcacaaacatataatctgtaaaatattgtccaaaccccaaggaagacgggtcgggcttttccttataatatacagttttttctcgttcaataagcttattcaatctaatcagcacacctttcacataattgtttaaatattcagtctttttaaagctgcaaaaagtatacagcctttcctttaataatacgccgcttcacacctataaatttcagaatattctttaggatcatcagctattatacaccacattcattgtcagatgaagctgaaattaaagaaaacagccagttttattctggctgtttgatttagagcgctaaacaaaggacgacaatgtggcaaatcagcaaaatatacactgcgaatacaaattgccaattgatcttccgcgcccatgcaaacaccaccatcaaaacaggcagcatcacagtccccgccagcttgttaaccgtcagatccggactgttcgcaacatcataatgaatcggcatctgcgtcggcagaaaagggtaaaatacaattgaaaggatgaatgcagcaatcactgctccccacagcacttttccattcgtaaataaaaacatagaaccaccattcccttcttaaaacacattgctttatgaatgatatgactgttctacggtgaatttcgttcggtctccccgtgtaataatttgcgcatattccaccacttcttcatttttatcataggtaagggattctgataaaaacgcaggcgctccgacattggttaataagtgtccgctgatcgtttcatccgttaaaatcggttcgatcgattccgtgcccctgctgatttcaatattgtattttgtccttaacaattcaaacagcgagccggtgcattcctcctgcgccagccccggtgccgccttccagggaatatatgaggtatgatactgcaaaggttccccctcggcgtatctgactctgacaagcttgttgacaggttcattctctttcattttcaaaagctcggcgatggaatgatcggcaggaatcaccacaagctcaagcacttttgattcagaacgaagtcctctcatttgttctgcaaagctcgtaatcttatgcggaatcggcgtttgtattttggccgccgatacaaatgtcccttttccttgaattcttttaatatatccctcaagctctagctgctgcagagccagtctcacagttgttctgctgacatcatattgttcgcaaaactcactctccgtcggcagctgatcattcgcctgatatttgcccgatttaattaactcaatgattttaaacttgataacagaatataaagctgtcatttcattctccccattctgtatgcaatccgttctttttcattgagaccataataccatttgccctcccaatatgaaagatttgtatccttcttttataacaaattttcagaaattaatattgacagtttgataagggcggtgctaaattcgtaatgacaagtatcataaattggtcataacaaatatggtgcttgtctatctctttgagggggtgtcacatgaagattctgatcgccgagcactacgaagaactctgtaagttaagcgctgccattattaaagaacaaatacaagctaagaaagatgccgttctcggcctggcaacaggaagcacaccggtcggcttgtataagcagttgatttcagactatcaggcaggcgaaattgatttttcaaaggttactacatttaatttggatgaatatgctggtctctctccatctcatccgcaaagttataaccattttatgcatgagcatctttttcagcatatcaatatgcagcctgatcatattcatatcccgcaaggagacaatccgcagcttgaggcggcatgcaaagtatacgaggatctcatccgccaggcgggaggcattgatgtccaaattctcggcatcggcgccaatggccatatcggttttaatgaaccgggatctgattttgaagaccggacacgtgttgtgaagctctcggaaagcacgatacaggcaaatgccagattcttcggcggcgatccggtgctggttccgagactcgcgatttcaatgggcattaaaaccatcatggaattcagcaaacatattgtgcttttagcaagcggcgaggaaaaagcagacgccattcaaaagatggctgaaggtcctgtcacgacagatgtaccagcctccattcttcaaaaacacaatcatgtaaccgttatcgccgattataaagcagctcaaaaattaaagagtgcatcattctcataacacaataaaaggagactgtcatgtttaaaaaggcatttcaaattctgcagcagcttggccgcgcgttgatgactccggttgccgtcctgccggcagcaggtcttttgctccgtttcggagacaaggatttactgaacatccctattataaaggatgcgggcggcgttgtattcgataaccttccgctgattttcgccgtgggggtcgcgatcggattagccggcggagaaggtgtagccggacttgccgctgtcatcggatacttaattttaaccgtcaccctcgacaatatgggaaaattactcggccttcagcctccgtatgaaggagccgagcacctgattgatatgggggttttcggaggaatcattatcgggcttctcgccgcctatttatataagcgattttcatcaatcgagctgcatccggtccttggatttttctctggaaaacgctttgtcccgatcattacttccgtcagttcattggtgatcggcgtcattttctcattcgtttggccgctgatccaaaacggaattaacgcagccagcagtttaattgccgattcaacagtcggcctgttcttttatgcaacgatctatcgtttgctgattccttttggcctgcatcatattttttatacgcctttctattttatgatgggagaatacacagacccatcaacaggcaacaccgtaaccggcgacctgacaaggtttttcgcgggagacccgacagccgggcgctttatgatgggggatttcccttacatgattttctgtctgccggccgttgctcttgccattatccataccgcgcgtccggaaaagaaaaaaatgatctccggcgtgatgatttctgcggcgctcacatctatgctgaccggaattacagaaccggttgagttttctttcttgttcgttgcgcccgtgctctatttgattaactctattcttgccggcgtcatctttgtcgtttgtgatttattccatgtccgccacggctatacgttctcaggcggaggaattgactacgtcttgaactacggactgtctacaaacggctgggttgtcattcctgtcgggatcgtgtttgctttcatttattattatttgttccgatttgcgattctgaaatggaatttgaaaacgcccggccgtgagacagatgaagacggtcagaatgaggagaaagctccagttgcaaaagaccagcttgcctttcacgtgctgcaggccttgggcggacagcaaaatatcgctaacctggatgcatgtatcacaaggcttcgtgtgaccgttcatcagccaagccaagtctgcaaggatgaattaaaacggcttggtgcagtaggtgtgctggaggtcaacaacaacttccaggcaatattcggaaccaagtccgatgccttaaaagacgacatcaaaacaatcatggccggaggcgtccctgccaccgccgccgcgctggacacggtaactgacaaaccgctgaagcccgattccgatgagacctttatttatccgattaaaggagaaacagtctctttaggggatgtgcctgatcaggtcttttcagaaaaaatgatgggcgagggatttgcgattataccatcagaaggaaaagtcgttgcacctgcggacggcgagatcgtctcgatttttccgacaaaacacgccatcggctttatgagcgccggcggcactgaaatcctgattcatgtcggcatcgataccgtcaaactgaatggggaaggctttgaagcacatgtcacaagcggacaagccgtcaaacaaggcgaactgcttctcacctttgatctcaattacatcaagcagcatgccgcttcagccataacaccggttattttcacaaatacctctgaagaagatctaaagcacattcaaatgaagtaaaaaagtcccccctgctgcgggggactttttcgccaacataatgaaagcgctgtcaaaataaaataacttgaaaaaaggtgtttgcatttgaatcacgaatgatatgaatatgcctacattctatcgttctaaagggggattcatttgaaaaaattaatcgcgtttcaaattttaatcgctttggctgtcggcgcggtgatcggccacttttttcctgatttcgggatggcactgaggcctgtcggagatggatttatccgcctgattaaaatgattgttgtgccgattgtattttctaccattgtcattggagccgcaggaagcggaagcatgaaaaaaatgggcagtctcggcatcaagacgatcatttggttcgaagtgattacaacgttggtattagggcttggacttttattagcgaatgtcttaaaaccaggtgtcgggcttgacctctcccatttggcaaaaaaagatattcatgaactttccggctacacagacaaagttgttgatttcaagcaaatgatcctggatattatccctacaaacattattgatgtcatggccagaaatgatttgcttgccgttattttcttcgccattttatttggtgtcgccgcagctggtatcggcaaagcttctgaaccagtaatgaagttttttgaatctacagctcagattatgttcaagctcacgcaaatcgtcatggtcactgctcctatcggcgtgttagccctgatggctgcttctgtaggccaatatggcattgaactcctcctccctatgtttaagctggttggcaccgtattccttggcctgttcctgatcctctttgtcctctttccgcttgtcggtctcatctttcagattaagtatttcgaagtattgaaaatgatatgggatctgtttttaattgcattttccaccacaagcactgaaaccattctccctcagctgatggatagaatggagaaatacggctgtcccaaacgagtggtatcatttgtcgttccctccggcttgtcattgaactgtgacggctccagcttatatttatcggtttcttgtatctttctcgcacaggcctttcaagtagacatgacattgtcccagcagctgctcatgatgcttgtgcttgtgatgaccagtaaaggcattgcagctgtaccctcaggatcgcttgtagttcttctggcgactgccaatgctgtaggactgccggctgaaggcgttgccattatcgcgggtgttgaccgcgtcatggacatggcgagaacaggcgtgaacgtaccgggacatgcgatcgcctgtatcgtggtatcaaaatgggaaaaggccttccgccaaaaagaatgggtttccgcaaacagccaaactgaaagcatatagaaaaaaagaacacctcaatacgaggtgttctttttttattcagcagcagcgtgatcttctgtttcaatcgctgccagtcttgcgtttacttcttcttctgtcatattatgctctttcacatacaggtttcttgggttcgtgcggcattcgtggctgcagctgcgcatatatttatactcattttccggtgtgcatatcatttttttattgcaagatggatttgcgcagttcacataacgctcacacggttctcctgtaaagtagtccttgccgacaatcacatgctcgacacggttgacaggcacgctgattctttcatcaaatacgtagcactggccgtcccaaagcttgccttgcacctctggatcttttccgtatgtcacgattccgccatcaagctgagctacatcttcaaagccttgcttcaccagccatcctgagaacttttcacagcgcacgccgcctgtacagtacgttaaaatctttttgccttcaagcatatctttgtgctcttcaatccattcaggtaattcacggaaggcttcgatgtcaggacggaccgcacctctgaaatggccaaggtcatactcgtaatcgttacgcgcgtcgatgacaattgtgtttggatcctgcatcttctcataaaattctgcaggcttcaaatgctggcctgttgtttcgttcggatcgacatcatcttcaagacgaagcgttacaagctcttttttatggcggacgaagatttttttgaaggcatggccttctgcttcatcaattttaaataccatgtccgcaaagcgaggatcagctttcattgtttccatatatttttcagtctgttcaaccgtacctgataccgtaccgttaattccttcagaagaaacaaggatacggcctaacaaaccaagctccttacaaaaagccagatgctgctctctaaacgcctctggatcttcaatcggaacatatttatagtaaagtaatactctgtattgtttttccatgttttaaacaccctgttcaattatagttagttgctatgcacactcttactatatcatacaggaaaatgccgcaaagatgaacagatccgcccagactgataaaaatatccaagctcttacaaacctaagcagcacaagggtttattaataacaaatagtattttccattaactcactaataaaagtagttgtctgaaaactatttttgtagttcctcttcaaaagataaatttaccggttcatctaaaagttctcccggcatttcaaggtttgttgaaggaacgctctcatctacctcttcaaaaacaacatgatccatccacacctgacccggcccagataattgaacgccaaaagatatcacagcgctattttctgggacatctaaaacgatagcataatgattccaattggttgttccggtaataggtctgttgctcatattatcaaattggagaacatcatcagcagcactgtcaacccgcatccaaagtgaggcaaaatgctgcaccccctttgttttgataaaacttgatagacgaagcctttttcctagatagcgatctgctttgaattgctgcatcatcgtcgcaaattcaccgatatcctgaaccatcgttgactttaaataccctgaagcttttccctgatgtacattttcccggtcaatccccatttcgaattggaacggatggctcccgctcaatacccagcctttcatttttttctccatgtaagattcctccttttttgaagtaaagcgtttcataaatgttcggtatgctcctggcggcatgtgatacatctttttgaacgtcctcgtaaatgcttcttgagattcaaactgataatacaaagcaatatcgataatacgatgatctgtataaagcaaagctgccgccgcattcgcaagacgtcttaaccgaatataagaagcaaccgacatgccgacttctttttgaaaaatccgatgaaaatggaattttgaaaagcttgaaacgttaacaatatcctcgtttgatatttgctcatgtaaatgtgattcaatccaattgattgttttctggacagctttttcataatacattgcacgctccaatctcctttctgttttagaataatggatcacggattatatgttttgattatttttgcgatatgtaaaaatcccctgtttaccacaggggacaccgctcacttgataatgacagagggcgtgatatgctccagccaaatgacaccgtcatattgttccttcaggatcatctgctcttccatgtacccccaatagagcgcagtccgcggggtatacatccacgaagtgcctttcttgttttttgtatggagaaaatcaacaaaaacagccggtcggtccgccgctttcagcaaagcttcaaggctcccagacggcggcgggcttgtaaccggcttaacagtcttattatcggagctatcaagactcgcacctgagtaagcataaatgccaatcgtatatgtttgttttttcagccgctccggcaaataatcacccatgttagggccgtttagctgtacccagtcctttatcatcttcgtattctgtttgcgtagatggtaattgtggccccagacaatgattttctttttcggataaagggtgtcggctacccactgaaattgttcagccatcatgcggtctctcataaagaatgaaaaatcctcaatattctccggatactcctctagtttttctttcatttcttccagcatatatgtttccattacgtcaattctcagctgaagagaatgcataaacatctcataagctttcggctcttttggaaggttttcttttagctctgaagcatgtgttttagtgaacttgatcagcttctgatagtttttcacaagcttttccttcttttgcgaaaattcatcaaacgtattgctgtctgtcactaatgttgaaaaatcattttctgattgggagagcaactctgctttctcagggtccaccgcttttacccattgagtcgcagctacattgaatgaattcttcatgctttgaatatcaaaaccggtaaggatcagcggatcgcctttctctttttgctctttcatgtaatcaaacaattcgacgacatcttctgtgtgccatacagcgtaaatggagtttttcatcgtgcttttaggggttaattggtccatattaaggtaggatgcatttgtatcaggaaagccggattcaaaggccaatacatcgtatcccagctcttcgtggaggtatttgatcattctgacctttgtggcattgatttcgccagcaccgtgtgtggtttctcctaactgaacgattcgttttcccttcagcaccttttttagaaatcgaaggtctttgtttgaagcattggaagcatccagaggctgtgcatgtcgttcaatccagtgatcccaatatttttcttcagaagcagcacgggctgaggctgaaaaagaagaaaacgccagacaaacgatcagcagcggcagggtcattctcactatcattcgtttcaattctatctctccttttctgctaggttctctagtcattacgagatagatatagaaaaagtttccttttcctgccaacaaaaaaaagcttctctgttgaaagaagctttagctggattctctcatcacctgatgaaagtaaaaccgatacgtattttgtaaaaatgtctcaaccggaagctgcacatccgcttggtatttgctgatgatgaatggaaaccgctcgattcctttttcgcgcaaattgttcgcttgttcatcatccattactttctcttgcaaaaccgcttcaacgatcggccagcacacttctcgcacttgccgcaggacggcttcatctccggtgttctgataatctgtaatccagctgatgatttgtttctccatgaatctcacctttcttcaaaaaaagaggcgctgcgtttatgcaagctcctctttttattcttcgtaacctatcagttctccgacttggacttcttggccttctgctaaatgggcggacggctggaacgcgtctttttcaaaaaccaaaatgacggttgagccaaatgaaaagtatcccagctcctcgccgatctccaattcagtacgggtattcgtctgcacgatagaattaatattcatcgcgccgacaggaatcatcaggacatttcggctgccgctattcagctcgtacacaaaccgataatttttcgacagcacatctttcccgtattttaagcctagttgatttaccgggtatgagcgatttccgagctcggccagcttttgatacctgcagctgatcggagaatggaaacggtgataatgcctcgggcttaaatacagcacgacgaaatatccgccgttgtattgatggtctgcgcttttacagccggtcagctcagcgaatgagtaatcttttcccttcaccgtaaaggtttgattcgggttgatgattcctaccgtctgaaccacaccgtcaacagggctgaccaccgcatgcgcctcttttgacacagggcgccgctccagatttatttgtcgaatgaacaattcggacagcgatccgtaatcagcagccgtaccgtccacatcatcccaattcagccgaaaatgttttgagaaaagcggaatgaccggtttgctgattttcgactcgcaaaatcctttaatcagataggatgacagacgatgattcgtcagctctatcaatgatcgatacagaatctttacagccgtattaaacatgaataatccctataacccttccgattgtaataaaaacaaagcaccataaaaaggcgccgattgcagcaaacgcaacatacgttttcagatccattttgccgatccccgaaaagtagcacgtcacatgtctgacgccgggaataaaataacctaaaataagagaatatggaccgtatttcttcatccatttttccactttcatcattctttttcttttaagccgacccacttgccgtacttgtcgataaacgggcgtccggcttttctgccaatcatgtagctgatcagcatacctaacaaagccccgacaaaactaatcaatatcgaaagctcataattcaatacatcggtatgcgtgaaatagccaacaacggtcatcatcacttcatctggaatcggcaatcctacaattcctaataccagcatcaaaaaaatagcgagataaccgtaatccgctatgagctgctgaactaattccatctcccagactccaggttttctgccgcatgttttttaaaatgagggaattttattttactcaccatcaaatatgagagtccgcaagtgccgattgccagaaggatcgggttataggtgaagcttagaataacgagacacatgcccgcaaacggaatcggcataccgataaacgtcgggagcttgctttgttcaatgttaaatttagagaggcgaagcattccgcaaatgctgtacgtcaatgcgcataagatcccgataaatggcagggtatacaacgcgacactgtaagcaagcatagaaggagccaccccaaacgtaaccagatcggcaaacgaatccagttctctccccatatcagaaacggcattcagcttacgagcagccatcccgtcaaagaaatcaaggaacatgcctgtaaaaataaaaagcactgctgaatgaatgttgtgatatagcaaggaatgaatcgccagcaatccgcaaatgaagtttcctatcgtaatcatacaggggatgtaattcacagtgtaaccaaacctccaattgtaaaaccatctatattatttgacgatagtgatcgaatagcgttacaggaaaaatttttctccaataagcatgataacatagaatgctcccaaaaaaagcagcattcaaattctattattatacaacatttgttaccttttgaaaaatgaatgccaatcttttcatgttccttactattttatccccccgcataaaaaggacaagacgcgttgattgacgtactctggctgctccagagataacagatgtccggcgttctttacgatttcagcctgaattcccggcaccaataccgaagcccgctcaaaggccatttgctgatggtacatagcctcgtgctcaccgaacatcagaagtaccgggacttgtattgatttcaattcctggtctgtgaacacgtacggaaagccgttttctgtcggcttcaggctcctttgctcatcctgccattccacgcccgccacaatttgtctttgcagtaaaggatgcagatcataactgtcgcctgtgatccacttgatatatgattcagctcctcttgcccctgtaagctctgcagcgtatttatagacatccggatgaaatgaaataaacgcttcagcgggactgataacaaccgcccgctctactctttcaggcgcgcggagtaagaaattcacgatatgggacccgccaagcgaaaggccggccagatgtgccgtctcaagtccaagagaatcaaagacatctttcatccattctgcaaaatcagctctcgtttccatggctgctgatggtatacttttatttttgtctcctattatatcgaccgcatatgtacgaaattgactgctccacgctgcgatattcggataccacatcgcagagctgaaaaggcctccgtgaagcaaaatgagcgaaggtgcgtcctttggcccacttgcaatgatatgtgtttttccaaaacgagtagaaacatagaatgcttccgactcaatcggccacaaagaaaggctttgatcatatgcctggtaaaagcgcagaccactttcaaccgcggcaaactgcattgaatcttgtatcatcttcttctttttcctccgggtttgattgatataaaggataacgccccttttgtctcgtaagaaaaaatacctatttcttattatctcacataataaatttccagtatatagtttggtttcctgcaataaataaaaaaggcagttcccttaaaatcaaggaaactgctattctttgaagactaatggaatggcatgatcttttttatcctctgttaacgagatgtgatgggttactgatgtttcacccttcgtcaacgcgactgagtaatcgccttttctgccggtatcccatttgatatctccgtttttgtctgttttaccgagtatctcgccaatctctgtactcggctcctcatctgaagagggcgctttgacaatcgtcacttgaaccccttcgaccggcagccccttagcatcctccacatgaagagtgacaggaatagtcgtttctttttgagaagaatgcgtctgcgaactgcacccgcataaaaacaaaatagacatgaatatggctagtttgctgtatttattgatttgcccaatattgaatattgttgaatacatcgttcgtcacccttgttcccaagttatatgacgatcctccgttcgtgtgaatggcaatagctgtctgccctgtatcactgtagtttcgataaacaggcgagccgctttggcagccgtacgtatcggttgtataggtcagcttatacgtttcagcggagcgaatcggctttgtatcagaccacatcgtgccaaaggttttgtcacatgggaatcctgtcactgacgaggaaaggcccacgggactgctgctgtttgtagtccggtagccgtaccagccaaccgtgtttccaggagaaccgtttaatttaatagctccgtaatcatagttggtgtctttgctttccgtccatcctttgacggagtaaaacatcgtgcctgaataagtaccgtacggatatgacgaaccattgcggcccggcgcggcggttatcgtcgaagcccatccatgatcctggctgtacacacaatgtccagccgtgacgactgtatttggattgactaaaaatccggtacatccataagtgcttgaagtgttgggatacttgattgacagttgaacggttgctctatatggaaaagatgtcgtgctggagattctggtgcgttcatcagttccgataatgctcgaaggctgtaaggtttgaatgtttttttccagttccgtttggccgccgtataacgatttacttgtttttccggttccctcataaggggcggaaacctgatctgcttttgacgtttggtttttcgtagcatcagcttctttaccggtattcgatacagaagtttgcgggttctctgccgcttttgccggtacgccaaaagaaaccgctgctgccaaagccaaacacaaaaccgttaagtaagcgaaccattgttttctgaatcttggaactaatttcattttgtcatctccctcctttagtgtcaaccacccgtatcgatggaagacttttacattataatcaggtttctgattcttatgataaaacttttacggagaaagaaaaaaacaggccttgtcccatgacaagacctgttcaaactctattttaaaattagctggtccaacgctttctttgcattctctcttgccgtttcaactgaatcagcagcagaaagcgcaactgccatacgacgtccggcttttgttatcggctttccaaagacgcgcacttgagtctttgggactgccagtgcgttttccaatccttcaacagtgtaatccgctaattcttccggcgctttgaggggcctgctggcgccaggagaaagctgtgtgatttctgtaatcggaaagccgagaatcgcccggacatgcagcgcaaattctgacaaattttgcgtcaccagcgtgacaagacccgtatcatgcggacgaggagatacctcactgaaatataccctatctttcgcaaggaacagctcaacaccaaacaggccgtatccgccaagctcatccgtgatcgttttcgcaatatgcttcgcttcttctatttgctgctctgtcatatcatgcggctgccacgattcgatataatccccgtccttttgcacatgaccgatcggctcacaaaatgccgtaccgttaaccgcacgtacggttaagagtgtgatttctgattcgaaagggataaactcctcaacgatcacgcggccgtttttcacccgtccgccttccatcgccgtctcccagcagctctctaaatccgcttcagagcggcacacactttggccttttccagaagaactcatcaatggtttaacgacacaaggaaaaccgatctgagctgccgcttgtataaattcatcatatgtattcgcaaattcatagccagctgtcgcaagtccaagcgtttccgccgcaagtcgtctgatgccttcccgatccatcgtcagcttggccgcacgggcattcgggataacgtgaaatccttcctcttcaagcttcagcaattcatccgtcgcaatcgcctcaacctcaggcacaatcaaatccggattttctttctcaatgatggttctgatctgctctgggtccagcatatcaacgacataactgttatgcgcgacctgcatcgccggagcatgctcgtaactgtcaactgccaccgtctgtaccccaagacgctgggcttcaatcactacctctttacctaattcacctgaacctaacaataaaaccttctttgattgatacatctttgcccctcctatctgttccaaaccattataactgaaatatttgaaaaataaatttttattaaaaaagataaaattattattgagggttaaaatcttttaaattcttaaacgaaagcagacaaataacggtctgctttctctattcctaaacagcaacatcatacaagaaatcccccaaaatcatgctacacttaatccaagaccaccacaccgacaggaggcatcccatgcaaaacgaaacccgcacactgcagcttgacccacaccttcatatagaagcctaccgcttcaagggaattatgcagaagttcccgaaccactttcacgattattatgtgattggatttattgaaaaagggcaacggtatctggcctgtcaggatcaagaatatatcatcaatccaggtgatcttctcctctttaacccccgtgacacgcatagctgtgaacagattgacggccggacgcttgattatcggtgtatcaatgtcatgccggatatcatggagaaggcggtgaaagagattactggctccgggcatctcccttatttctcccagcatgtgttattccgccatgagctgacagccagcctgcaggaattgcatattttgatatccgaggaaaaacaagctttgcgtaaggaggagctgtttcttcatctattagaggagctgatccgccattattcagatgtcacgttccttagcagcgttccagaaccatcagacgaagtcaaaatggtttgtgaatttttagaagagcattatgccgaaaatgttacactcaatgatttgagtgaattaacaggctggagcaagtatcatttattgcgttcatttacaaaacaaaaaggcattacccctaatagctacatggaaacaatccggattaatcaagccaaaaaactccttgaacaaggggtaaggccgattgatgcggcatttcagacaggattcagcgatcagagtcatatgacgaagttttttaaacggcaggtggggctgacgccgaagcaatacatgaagatttttgaaaaggagcttcacagatgaacatacaaagagaaacttcggggcatatcgcagccattgtgaccattctgatttgggggacgacctttatttcgacaaaagttctgctggctgacttctctccaatggaaatattattttatcggtttttgatgggctttatcgctcttatcctcgtccgtcccaacatgattccgttcagaaattggcggcaggagctgttgtttgccggagctggtttatttggcgtaaccttatactttctattagaaaatatagctctcacctatacatacgcctccaatgtcggcatgatcgtgtccattataccgatgatcactgcggttttggcccattttctgctcgaaggcgaaaaattgcgtctgacttttttgattggatttatctcggcactgatcgggcttttattgattacgtttaacggcaatgtggtactgcgtctaaatccgctcggagacatcatggcagccggggctgctctcgtgtttggcggatactcgatattcatgaaaaaattaagcgcctacgaataccacatcatcgagctgacacagagagtatttttgtatggtttattgtttatggttcccgctttatttttgttcgacttccattttgacctaagccgattttcatctgcttcaaatatactcaacatgcttttcttagggattggcgcttctgccctgtgcttcgccacttggaattattcagttggagtgctcggagccgtcaaatccagtgcgtatatttacatggtcccggttatcacgatcgccgcttctgtcctgattctgcacgaaaacatgacatggatcgctcttctaggaggcgcgcttacacttttaggcctctacatttcagagctgaaaccgaaagcgaagctgttggagaacggatgtaaaatggatgcttaacggcatccatttttttattttgtcctacgtttgccacctataaatgaacgcaatctaacaaaggaggaatcgaaatggttgatgaaatggtcttaatcacacagcaatggctgaacgatacgtacagcggcaaacatgggtataacccagttgaagaaagcgggaaaactgggtgggatacgatctacggtctgactcgggcgcttcaaattgaattgggtatctcagagccagccgataacttcgggccgacaacacagcgcttatttaagcctcttaaacgccaagctccagattcaaaaccaagcaacatgaattttattttacaaggggctttatggtgtaaaggctttaatcccggcggttttacaggcgtcttttacgaaaaaacagaaaatgcggtaaaagaatttcaaaaagctgccggactgacaacacaggatgggattgtcaccacgttaattatgaaagccttattagacatgagcgcttttaagctggtgtctgggggtgattcaagaattcgccagattcaacaaaacttaaatcgagactacaatgactatatcgggttaatgccttgtgacggactgtatggccgcgatacaaataaagctcttatttatgccctgcaaaaagaagaaggcatgagcacaagtgttgccaatggatttttcggaaacggcaccacaagtttgtgccctactttaactcccggcgattcaagaacaggatttgtcttaattgttcagtacgccctctattgtaacggaaaatcgttcgatcctggtgagtttgacggcaaatatggtgtgggtgttgtttcagctgttaaagcatttcaagagttcatgtgcctgccgcaaacaggttatgcagatatgccaaccattaaagctttattatcaagctcaggagacacaactcgcaccgcttctgcttgtgacactgctacaattataaccgcagaaaaagctcaaacactgcggaataacggttataaaacggttggcagatatttgaccggaaatgtgcggacaagcagcggcctcacatctaaagccctgacatctaaagagcttgcagttattcttgatgccggattgaaggttttcccaatttatcaagacggcggctatgaatcttcttattttgtcaaagaccaaggcacaagagatgcatatagtgccgcttctgctgctagaagattaggttttccgtcaggcacgaccatttatttcgctgtcgattttgatgcatacgattatgaagtgaccgataaaatcattccttatttccaagagattaagtcagcatttacaaaaatgcagacattttcaaccgcacctaagtatgaaataggggtttacggaccaagaaacatttgtatccgtacatctgaagcaggactgacaaagtatagttttgtggcaaatatgtcaacaggatttagcggcaatctcggctatccgatgccaaacaactgggcctttgatcaattttatgaaggaaccatcggaagcggctctggaagcatcgggattgataaagacgggtattcaggaagagactcaggtgcaagcaatgtaaatccgccgtctgatccggtatatgatgcaagactgcgtacactgacagacattttatctaccattccagctttagaaaatctaacaagtctggcaaacgcgatgtttgaatttgatacgacagaaaccattttcacatcacctgagttggatattattctatcaacttcacttctggcaaccataccaagtgaaggttcaccaaacacaattaccattacaaatggtaaaccaggtgcctatatcacgggtttattgggcgacactcaaacgtctctcactgcgtcacaaatcgactcttatcaaaaccttttaaatagtctgagcttatcagtacgcaacggttatttggaggtttatgtaaatccaacagctgaatctttaaacattcaaattaaaatctatacacctgatattccagtcggtgacaatgtcacaactggactaacgactacgattacgtttaaaataaagacgtacaagggagtaccagttacgtctcccgagagtgaattagcgttagattggccgtcttatgatcaatatttattccctgttgtaggtgttgctgcacttttactaattgggaatatgggcagtgatttaacgaacaataaaggagtcaaagtcgctaccgcattatctgctatgttactggccatttttgcttattatactagctaactttaatacaaaactgcatgaacataagttaaaatatgctcatgcagtttttttagtttatctatcgtcttttggaggtttatcaaaaatgaaaaatgatcaaatagtttttgaaaaaacaaaaaacatcgctcatgatatcaatcagatgcaaaatcagcaggagataatagattatctttttcgccaagattctctgacactcaaccagttgaagcactattattcggaaccttctcttccgcttcagtttcttgtgaaagtagcagttttatgcatgtttatatctatgactttagcttctttccttttcatccaagcaaaagaagtcttcaccaatactattctttcagatatttcacctgcagtgttttctatttttacagtcatttgtatttttatgacttatactaaaatcataaaaaaaggaaataaaaacaaaggaaaagcatcccttaatcaacgatctgaattctatgagaaaaacaagttaattaatacaatactttataaaaaatataaaatggatcaacaaaacatacaggctaataaacatactgcctctgataatgaagattcaatgaattttagtgctgtattgaatcatgttcttacaattagtaaaaatgataaagagcttttgggctacttagatacaagagataatgctatgctaagccaattaaaagcatatttttcaactcgtccattttcccttccacattatatgagtttgatgttttgcggaagtattattgttgtctatgcaacttctttattttcaggacaaatcaattacattgacataccacacatttttatctttctattattaattattttcttgaaaatccttattgatttgataaagcttttaaatatatctagaaaaggacaattacatactgttctgcactttgcacagagagccgaatatttgcgaatgagaggagttatagattttattctaactgaaagatataacaaaaaatcatgtaattttgtttcatccttactaagaaatactcaatttttatactttaagagatgtatatattgaatgtagaccaccatacatataaagaaacagaaacagcaactttattttagaacataaaaaagatgataaagaacttcttattttcctaaacaaatatgattcaatcatgctgaatcaattaaaggtattctttagtgaaccattgcttacattcaaacacacttgccaaaatcgtatgtactgtgacattaataacgttatacttctattttttcagcactcgttttaatgaattaatagaattagctgtacaaatgttttttgccttgatcggccttttttgggtttttattgtttccccattttcaagaaaagttcaaatttctgaacgcttcaaacaaaaatccgaaaacgcccgcatagtcggtatgatcgacttcgtattagaacaaaaatacaaaaaaagcatctctgaataatctcgaaatcagagatgctttccctttgtcctcatcacttgtctaccacagccgcactgtcacgcgtaaccgcagctggctccctcagcatcacattcattacgctcgcaagcacgagcattccaatcgacaaataaaaagccagtgtatactcacccgttaccgtgtagatgacgccgggcacatacgcacctagtgccgatccgatctgatgggcgagtgacagccagccaatcatgaggccgatcgagtagttttgaaagtactgggtggcgagcatttgagtcggtgctaccgttgcaaagtccactaatccaaacagaatcgcaaaggctaaaagcaagtagggctcgtggctgtaaataagaatcacgatcgacagcgcccgcaccgcatataaaatgcacaggattttccggctgctccaccggtccgctacaattccggacagcaagatcccagcaatattaaagcctgctagcagactgacagcagcactcgtgactgtcgttgaaaagccatgatcatgagaaaacggaatcaaatgggtatccatcagccccacggtcgtaaatccacagatcaaaaacggaaaaatcaagaaccagaattgcctcatacgaaacatcccggccactgaaagagctgttgttttgggtgctgtttctttttctgatgcagccagtccgcctatcggctctgtattcttttctgaaggattgttccgcagcatcagcagcgcagccggaaagacaatcacgattaacagcagtcccaacaccacaaccgtcagcttccagctaaaccaatggatcaacatgagtgagccgggaacgagaagcatttgccccgcgccaaagcctgcttccatgatcccaaaggctagtccccgctttttgctgaaccaattgacgaccaatacacttgccgccacattcgatgctccgcccactccaagcgagacacccagcccgtaaagcaaaaacagctgccaaggcgaagtcacaaggtatgttaagaaaatgctgactcctgtcagtaacgcactccatgccaaaacagcccgggcaccccatttgtccacaagccgaccgatcacaggctgtgatatgccataaacaataaaactcaccgtcgaaatcagcgagatggtgcttctatcgattgaaaactgccgttcccacggctccacaaacgcaccaaacgacagccgcaccccctgaaccgccaataagatcaaaaaggtgacggagacgatgatccacgcataatgcagtcttttcatgacagctccaaatcccaccgttcttctgtcagctgctgtccccataatggcgcttcttgttttacttcacttatcctgaatccaaattttttatagagcggacgagcctcagccatcgtgctcaccgtccaaaggaaaatgcggtcaaacttcatgtcttggcagtatgcaaccagatgctccagcaattgcgtgccaagccccctgccccgaaaatccgcatcaaccagaaaccatctgagctggactgtcttttcatcgtgcttgaccaacccgacagagccggcaaatttcccgccgctttccgcaatccatattttttcgatgtcagcgtcaaatgtctcctgaagataagctaaaaacgtgtcatcccaaccgtgagcctccgcgtaaaattgtctttgtttctcaataaggagttgaagatcctccgaaagaaaataatctctaatcgatatctctgatgctctggcagaaagcgactgtgaaaggatcgcttcaatctctgccatcgcctcggcaagcttgtgctgctccttttggttgattaccttcagcatcagttctacttgttcgttggctttctcctccagctttttataaatcgtttttcctgtttctgtgacaaaaatgtaatggtggcgggcgtcatctttgctcctctgtttataaatcaaatcttctttttcaaactgcttcacaatcctgctgacatatccccggtcaagccccagcttatcctgaagagcttttgccgtacaattaggcgtattataaatctcaaataaaatccgtgtttctgttaaggaaaacgggctgtcgtaaatgtgctcattaaggaaaccaaggacgtttgtataaaatcgattgaactttctgaattttaacccgacagatgattctcttgttttcaaatcaattcccactttctaatatcgttgactaaagcaattataatcacatatagttgctttagtcaacgatatgttagaaagtgaggtctttttaatttcctgattccttccttttccttaccacaatcaatgtgatataggataaagccagagaaaccaagctatagacaacagcccatcccaaaaatgattgattaaaaatggtaaaggtgagcacaagagaaatcaccaaactaagcattggcatcagatacgggtttttacaaatacaggtcccgacaatcgatagcagcataattcctaacggtaaaataaagaatgcgatatctaattcatccatctttaaacagcctccctccagatttttatgttactagtaaaaaaatataattgcatttagtaaaaggataatattcacttccctaaggcccaatttgaaaattacccgtttacattcgctccggactatgataatttaagaaagcgctatcatgataagttaatagcttggatggagatgaggagagccaggaatccaaccccttttgacaaggggtgttttctggctctttttgtttttcgggaaaggaggcacgccacacatccagcacaaacagcaaagggggataattattaatgcttaatatatttaaaccggctcctcatattgagagactggatgattcaaagatggatgcggcatacaaacggctcagactgcaagtattcattggtattttcattggctacgcaggctactacctgctgcggaaaaactttgcctttgccattccttatctgcaggaacagggattttcgaaaacagaactgggtttggtgctggccgctgtgtccattgcgtacggcttcagcaaattcatcatgggaatggtgtctgaccgctgtaatccgagatattttctggcgacaggcctatttttatcagcaatcgttaatattctattcgtttcaatgccttgggtgacttcgagcgtcaccatcatgtttatttttatgtttatcaacggatggtttcaaggaatgggctggccgccatgcggcaggacgatggcccattggttctccataagtgaacgcggcacaaaaatgtcgatctggaatgtcgcccataacataggcggcggtattcttgctccgcttgtcactcttgggatcgcgatgttcgtcacttggaaaagcgtgtttttcttccctgccatcatcgccattatcatttcatttttaattgttttattggttcgtgatacgcctcaatcctgcggactcccgccaattgaagagtatcggaatgactatccaaaacacgcttttaaaaatcaggaaaaagaattaacaacaaaagaaattctttttcaatatgtgctgaacaacaaatttctttggtacatcgcttttgccaatgtatttgtttatttcgtgcgatacggcgtggttgactgggcgcctacttacttaacagaagccaaaggcttttctcctgaagactcacgctggtcgtattttctttacgaatacgcaggcataccgggaacgatcttgtgcggctggatcagtgaccgattcttcaaaagccgccgggcaccggcaggcgttttgtttatggcgggtgttttcattgccgtattggtgtactggctgaatccggccggcaatccgctcgtggacaatatcgccctgatcagcattggcttcttaatctacggacctgttatgctgatcggccttcaagcaattgacctagcaccgaaaaaagcagccggaactgcagccggtttgaccggatttttcggatacatcggcggatccgccttcgcaaacgccattatgggctttgtcgtggaccgttttaactggaacggcggctttatcatgctgatctcatcctgcattcttgccatcgtcttcttggctttgacgtggaatacaggaaaacgggcagagcatgtttaagaaagacacataaaagattaatagttttccaacacgccgtttacatccgttttttattatgaaagacaggtagtgcttatctataaggaggagaaatcatgagaaaaaatagaatactggccttgtttgttctgtcgctgggcttactctcatttatggtaacgccagtgtcggcagcgtcaaaaggaaacctgctgtcacctgaccgtatcctgaccgtcgcgcacagaggggcttctggatatgtgcctgagcacacgattctgtcttacgaaaccgctcagaaaatgaaagctgattttattgaattggatctgcaaatgacaaaagacggaaaattgattgtcatgcatgacgaaaaactggaccgcaccacaaacggaatgggttgggtgaaagaccatacgctcgcagacattaagaagcttgacgccggttcttggtttaatgaagcctatccggaaaaagcaaagccgcagtacgtcggccttaaagttcctacattagaagaggtattagaccgtttcggaaagcacgcgaactactacattgaaacaaaatcgcctgacacctacccaggtatggaagaaaaactgatcgcttctttgcagaaacataaattactgggaaagcattctaagccaggccaggtgatcattcaatcgttcagcaaagaaagcctggtaaaagtccatcaattacagccaaacctgccgaccgttcaattgctggaagccaaacaaatggcgtcaatgacagatgctgccctggaagaaatcaaaacatacgctgtcggtgcgggcccggattataaagctttaaatcaagaaaacgtccgtatgatccgcagccacggcctcctgcttcatccttacacagtcaataatgaagctgatatgcatcgcctgcttgattggggcgtaacaggagtgttcaccaactatcctgatcttttccacaaagtaaaaaagggttattaaaagcaaaaaaccttgcgacaactatcgcaaggttttcttctatattttattcttttccggcagcagcttctgactgtccattaagcagctgagaatttatctctttcgcatcctttaagtattctgtctggtagccgctcttcagcgcccacacatagaatacaagggataccatcgcaatcagaaccatatcccagccataatgaatgacattcaggccgccgaatttatcactgcccaaataagaaataaccatcatggccagcagataaaacaccatccagacgccggctttaaagttccggccaaaccctttccatttcgccttcgcctgataatagaaataaatcggaagaccgatcaggataataaacagaacctgtcctgttaacggccagcgcgcccaatacagcaccagtgacgcaaagataaatccaagcggagcaatcacatttaagccttttaaacgaagaggcctgtacaggtctttccccgtccgtctcaatgtcatcactgtgatcgggccggtgatataagaaattaacgtagcaacagaaataatttccgctaatacgccccatcctctgaacaggaacaaaaagatgaacgaaacaatcaagttaaagaacattgcttgtcgcggaacgccgtaaatcggatgaagcttcccgaatatactcggcatgtatttgtttttttccattccgtaaatcattcgggacgttgtcgccgtatacgtaatccccgttccagacggtgatacaaatgcatctgcatataacacaataacaagccagttaatattcagcgcaatcgccagatcagcaaaaggagaattaaaattcagatggctccagccgtgagcaatatcagaaggattcacagctccaatgaaggcgatctgcagcaggacataaatcactgtcgcaacaaaaagagagccaacaaccgcaatcgggattgatttccccggattttttgcttcacccgccatattaatcgggctttggaaaccattaaacgcaaaaacgataccggaagtggcaaccgccgtcagcacacttgcccagccattcggcgcaatgctttgaccgccagtaaagttttctccgtggaatccgacaaacagcaaagctccaatcgtaagacccggaataataattttaaaaatcgtaattaatgaattcgctttcgaaaatagattgactgtccagtagttcagcagaaaataaatgagaagcaatacagaggcaaacgctagtccttccccagtcagcgttccattcttcaccaaaccgcttgtccatttcgcccattcccaaggccaagaactcatatattgaacggaggccaccgcttcaaccggaatgacggacacaatcgcaatccagttggcccagcccgcaataaaaccgataaacgaaccgtgtgaatattgcgtgtatttgaccattccccccgcttcagggaacatagaacctagttcactataagaaagagcaataaataaaatgacgaccattccaataacccatgaaataatagcagctggtcctgctatttgagccgcacgccaagccccgaacagccagcctgaaccgatcatcgacccgagcccgaccatcatgagggaaaacgttcccattcttcgatgcaattgattcatatcgtaaacacctttcatgtatgatgacattctcttgctaattatattattattctgattactttactttgtcaatatttatcgaattttgactgaaatctataataagtcaatgtatattaccttccaatacaggaatgaagtcactagtttcttcttaaatggaatttactgttaattccaatgataaaaacacaacaggtttagcaatttccaaaacgggaatgatacaggaaacactattcttaaaatagaaaggagtatcaccatgaaacaaaagctgttactttcaggtctcgctgtttcaactgtcggcatcacttcttatctattaaaagacccgtcaaatcgccaaaaggcaagagaattcattcacagcatgaagatgaaaataacaaaacagccagacatggaaacgttcccagttgataaagccggccacccggacccgcaagatatcgaggacaacaaaatggtatcagaaggctccatgtatcccgtccaatactacgatgaaaaaaagaagtaatcaaaaagctctcttcgataaaggaagagagctttttaatttaactttttcgtctgattccgctcattacgaagccgctttcaggcaatgatggcattctggcgagactgtaatgcagtgattgttccggaacatcgtattcaatctgatggacgaggaaatccaggctcgctttcatgacttcaattgtaatgccttcccctggacagcggtggcctttctcggcgtgccccccgccttgaggaatcatatcaaacagattttcttcccgctccgcaaatcgttccggccggaattcatcgggatgatcccatagacgagggtcgtggttcgttccatataaatcaagcagcaccgatgtgcccttcttaaactcacagttattccatacaaaatcttttttgacaagcgcccctaaaaacgggccgaacggataatatctgcggacctcctgcacaaacatttctctttcccggctgtttccagaccgcagccattccttatacttcggatgctcatgaagcgccaaagctgaaaacaccagaaagtaagaaatggcgacaataggccgcagtacattaatcagctcaatggctgccatgcgggaatccagctggcttccatcttcttgtgtgtgaaaagccatttcatgcagcgctgttccggaagtcgttttcagcaagccggcacgagcatcttcaatcatgacttcaatccactcttccgcacgcggccttgctcttcttcctttccaatgccgcggtcccacagcaccgaacgcgtcgaccatgtcaatgaagtcatccgctctctctttgacttccgtttccttcaacggaacacctgcccaatagcacgctacccggcacaggatttcttttgcttcttcaaataacacaacctcatctgccttctcccatcttgtgactgctgctttccactcctctgtcatcaactcagccaaacgtttttgatgcggcggtgtcatcaatgacagaaaaagcatcttccgatggatatgcgcgctgccatccattccctgaatcgcattaacaccaaacagcgatttctgcacccgcttaggcaaagcgttctgccgctggaatcgatccgtatcataaaacaccttcgccgcctcagcgccagtcatgcaaataaagttttttcccaacaaacgggcctgaaacagatctgaattgtagcgctctgttctgtttttaataaataaatacccttccttcagcagtgtcagactgttatcgagacttttgtcatgtggaatctgctcattcatccgcttaccctgccttcctttttaccctctattttcacgttatcttccgactataaacccagtaacagtatttgtttgcaaaaccaaatttaagcgctttttgattattttttaaaggaagaacaaacgaaagagagaaaaggtagttaatcaaaacgaaggggagaacaaaatgaaaaaatggatatatgttgtgcttgtgctgagtattgcagggatcggcggcttctccgtccacgcagcatcatctgctcatgaaaaacacttgaatgtcagcaaaatgaatgtcgatgatgaattcaaggatacggatggaaccttcattcttcacgatttacaaaaggatcagacatttgtctataacagaaaacgggcaaatcaaagacaaactccgcaatccacctttaaagtcgtgaacgctttaatcggtttgcaggtcaaagctgtaagagatgaatacgatgttaaacgatgggacggggtcaagcgtgaattcgaatcatggaaccgcgaccatacgcttggctcggccatgcgcgaatccgcaatctggtattatcaggcattagcgagagatatcggcgaggaaagaatgaaaacatggcttcatactctatcttacggcaacgaggatatcagcgggggaatcgaccagttttggctgcaaagctcgctcacaatatctccgctggaacaagaaacttttttggagaaactggctaaagaggagcttccatttgacaagccggtgatgaaaatcgtcaagcgcatgatgattcaagaggaaggcgatcattacacgctctacgggaaaaccggaacccgcctgactgatatgggattaggatggtttgtcggattcatcaaaacagagcatggctcttatgtctttgtcaccaatgtcgatgattccggcacaaaagccaaaaacatcaccgtggatatcctgaaaaagtatggcctgattacatcctaaataaaagagccctgcacggcagggctctaaatctcatgctcaaaacaataatgattcacaagctcttcaatcaaatcatgatcgggatattccccgttaaattcaaattcgatttcttccacaaattctccttgatggtacacatggatggctccgttttgacggacaacgctaaactccggctgaaatgtatatccgcttcgttcaattgctcccatttcttacccgcctttctcaaagcagtaattcatacacctcgtttaattccttggcccgtttttgatcctgttcattctgggcatacttaatttctttttctaatacatggttcaaaaaagacatttcattatcatctaagtcttttacaaattcctcttcatttgcataacgcttcgccagcatcttcttgcaaatacgctggcagacttcattttctagatgattcgaaagtgattcgcgcaaataaccgagtgtaacatccattttatgaacacctttccttctgctatctttaccctatagcttgctaaaatagggaaaatccatacgcgaaaaataaaaaagagacatccgtgaatgtctcttttttatcgttattcagctgcttgttcgctttttgtcaaattggcctgcgtgcgtttgccaatcccaaacacataataactaatgaccacaagcgctaagaaaatcacgcctacaatcagggagatacgagtatcatcgttaaaccacatgccaaccagaaccatcagcaagaaagcaatcgtcaaatagtttgtaaaaggagcaaacggcattttgaatggatgtttatctaatgcagcacccttcgcttttctgaatccgatatggctgatcaaaatgataaaccaaggaatcatccctgggagcacgcttgcgctgtatacatagacaaagatcttcggcggcgcgatatagttcagtacaacgccgacagccaaaccgatcagcaccgcaattgtgccatacagcggcacaccattgcgtgaaatcttcttaaagaatttcggtgcttgtccattgacacccagtgtatacagcatgcggcccgcgctgaaaataccgctgttacagccggacattgccgcagtaatcacgacaaagttaataatgccggccgctgccgtaattccaattttcgagaacgtagacacaaacggacttccgagtgagttgagctcatcccaaggatacaccgtcacgatcacaaaaatagcgccaatgtagaaaatcaaaatacgccagataatactttgaatcgcatttcttagcgtgttttgcgggtccttcgcttcacccgctgtaatcccgatcagctcaactccttgataggctgcaatgacaagagacagtgcaaagaagaaacctgagaaacctcctgcaaagaagcccccgtgagaccacaggttcgacaaaccgatcgcatctccgccattgccaaaaccgaagaaaataattccgattcccgcaataatcatcaagataatcgtcacgattttaatcatcgcaaaccaaaactcaaattccccaaacgacttaacagaaattaaattcgccgcaccaagaatcaccattgccacgataccaggtatccaagcaggcaaatccgggaaccaatacttcgtataagaaccgacagcgataatttctgacatgccgacgataatccactggaaccagttgctccatgctgttatataacctgccatcggatgaatatattgatggccgaacgtcgcaaaagaacctgtgctcggctcgacatacagcatttcacccatcgcacgcataataaaaaagataaaaattccgcatattgcataagccagaaggacagatgggccagtccatgaaatcgtgctggcagaacccataaacaagccaacaccgattgtaccgcccaaggcgatcatctgaatatggcgcgcgcccaggcccctctttaattctttatttgccactcctcttcctcctcctaacaaaatactcataaatgagaaaacagcagacctgcttgccttcacatgaatcagtgataacaatcagaaaattcaaacttaaaattgttatataatctcctaaattacttatttcatcataataaatttctctggaaaatacaattgtttttttcaggtaaacacctttgttcagagttttgaatcgttcacttcttttaaaatcttttatataaaaataataaaattatttgaatattgggattaattcaccccttagattctcataaaaaataagctgtcctacatgaacagcttacctaataattcacacccgtttgacgctttaatgcttcaagccacccggtatctccggtcccatagctcttgctttgtcccacatctctcagagatccattgctgtaatcaattgataggatgaaatccggaatggcattatacccggcttccgcgattttactgagctctgaacgatagtaagatatagcataagaagccgtttgtttctgcactggatctttttcaagctcttccttatatacatccattaagtcacgtccctcaggcgtgacgtaccgcccatcaatcacttctaaatccttcaaatggtagcctgtaacttcatacatctcacgagctgcctgatactttttataggcctcttcggaaaattgtgctgaatcactgctttgacttttcatgatgtgtaaaaatagttctttgctgttgtctccagattgcagcacttgctcaatttgcttgatcagatcctgatcgtctgtcccgcttacccgcacctgatagtcaatcggtgtgattgtaaacgtcagctctgtcccctctggaatatgaatatggtttcgattcaacagtacttgcagctgctggttaacctgtccccgctgatacaccttttcattctcagcttccacttccccatgaaatgtgacattcggaaacacagcatcctgaaggttatagttttgcgccttccctttgaataaccattctgtttcattatcgtaagcggcctgtctttctgcagctgacagatcacttctgaaataaggagactttgaattttggtacttatccttaatatagcctaatggatcagactttgttttattaatcgcattcatcctgctgtatttttcatctagtattttgattctgatatcactctcagattcataggggttttgggattgaatcactgtttcttcccctgtgtctgtcactgttcgatcattcgctgattgatacactttgctgaacgtcccgctgtttcccgacacgctggttttagaataattgaactgattgattcccccagttgaagattgtgacttaagcctgctatatgccttttccagaactgccgctggattttcagtcgcattctcccgtttggcaggcgcattcttgctcaatatgttctgtgcaatcagctgagtgcggataaattgccgattcagacgcattgaattccctcccgagtattctctcttattcttttttatcggcgaatataatgtatatattaacctcaaaaaacatttatttacacctaaatcgttattatgtatgatggaaataaaaggaggttgtttgcatggtgaaaaaatggcttattcaattcgctgttatgctttctgtcttatctacctttacgtattcggcatcagctgtcggagtcactgctatcacaggaaacaattcatttgataccgcaatgccgatcggttattggaaatataaaaatatcgatacaacaatactggaagctggtcaagatgaagcctatttcacttttacggctaataagggagaaaaagtatacatgaggagtacataccagagcgcgtatacagggatgaaaattgaaatttatgacaagaacagaatacctgtttctcaagggacagaagttattaaccctaatacgttttcttcttttatttatgcaaatgcagacgcccaaaacacgacggataccttctatgtgaaagtgtcacgaggcacctatactggaaacatgtactttacgctttcaattgaagaccgaatcaaatcaggcagcggaacgttccaattcagcggcgttgctgaaaataaaggaaatacaagccttagcccctcaggttctgactccagcgtgatcaaggttgatttaacaaaccaatctgggataccgcgtgatgccattgtaaccagagttcaaacaaccgccactcaaacaccaagccagggaaatacacgccatctgatcatgacaagcgaaaataacgaatggagccgtgcccttgtaaacagctcgacttcagggtcttatgatatctctttgtcggatcaactcagtgtggcaaaggtatggagttttaaatataatacattagcgacagccagatcgacgatgagcaacgtaaaagcaaaaatagattatgaatacgacgtgacaaagcagttttaacttataccgagccggttatccggctcttttttattctccgtctagaaggtaaactatagtcagtacaaccaagggaagtgcagacatggcattaaaacttctaaaaaaactgctatttgaccgccctctaaagaacggcgttatcttaaatcatcaatacaaaatcgaagagtgcctcggtatgggaggctacggtttggtttatttgtgcaccgatatcctagctcaaacaccttatgtcttaaaacagcttcggccgacaaaagccaaaaaggaaaaagagaaagtccgattccagcaggaaataaaactgctcaaaaacattcaccacccgcaaattccgggcttcatagatgaattcatcatagacggacaggcttattatgtcatgcagttcattgagggagagaatatagaagaattattattttttcgaaaacagccgttcacagagcttatggcgttacaactgatttcgcagctgcttgagattatagaatacctgcatgatcgccttatcttccacagcgacatcagaacgcctaatatcatcatcaatgatggcaggctctgcctcatcgatttcggccttgccaaacaattgactcctgaagaaatggaggaaataaaggtacgaaaacaggatgacttcttcgatctcggagaaacgctgttattcttgctgtactctcaatataaaggaaaaaagaagaaaaacggcacttggctggaggaattaacactgacaaaggaagtaaccttgctgctgaaaagattattgggcattgaggaagagtatcagcacaccgcttccattcgcgaggatctaaaccgggccattcaatcggtcacataaaaaaacccttgtcccaaaagcggaacaagaactttttttggattaactgctgctgtagctccggcgtttgtaacgatgactgccgccataacggtcgtagtgtcttcttttgcccgaactgctgctgtagctgcgataatgtctgcgccggctgctgctgtaatgccggtgtctgcgatatcggtcactagaactgcttgagaggtacttaatcgttttgatgatttttttaaacatatgatgttcaccccatttctttctccctattatataaattttataggagaaagaaaaacatcagcggggtcactcttttgaaaacaagaaccccgttccgttatcatttgtatgcagctcataagtaatcgcaagcagcctgcatgtatcctcaataatctttaacccaagtccctcactgctctcattccgatcaaatccaataccgtcatcacgaataaaaacatcgccatgttcaatcgtgacttccatctttttagcttttgaatgccttaacgtattttgaaaaatattatcaaacagcctttccatccataacgtgttgctcatccatatcacatcttgatctgccggcttatagtgcagctcaatcccactcatactgtataaataatcccactttttcaccgctgtttctaatagctcgtttagacgcacttcttcatttacaatataagagctttccagcgtctcagcggaatatagattgaattcattagttaattccgagatatattcgatttgctgatacaatgattcgaatacagcctgaccatgacattggtcttccaaataaaataactgcagcctgagagccgttaaaggtgtattaatgtcatgccgcagtttttgcaaaagctcctttttgatttcctcctgctgtctcagctccagttcacgatatgtcgtccgttcaattaacaaattgaccgacttgatcagttccccgatttcatcagcacgcttcacttcaattttatcgggcaccctttgatcactcgccaaatgccgaatggtttgatttaatagattgattttatgcaacagagaatgaatcgactttgaaaataaaaaagctaacaataagagtgatatcaaaaatacaacgatcattgccgggtatgcaaacgacctgtgaaagggcataccatgattcatcggtttaaacatgctgtcataaatcaccgacatcaaaacactgaccgccagcaatagcatcggaacactaatgacggccgtaaacaataacaactgatattttgtcttgagcttcatttcttcacaacggtattcagccgatacccttctccatatatattttcaatcatctcacccgcttgatcattgattttagctctaatttttttaatatgcacattgacaatattcgggtttctatcttcgagctgccatagatattcaaagaaatgttcctttgtcaggatactgtctctattttcatataaataaaagaaaattttccgctcaatcgcagtaaataatacctcatcatgcaggctttcattgaacacttttttcgttaccgcatcaatatacaaatgtttgatttgcgtaaaggtcccataatgatgctcaagcatattccgcattcttaatagcagctctctcggatcaaagggctttaccatataatcctcgccgatctgcaaaccttgaagcttgctgtccatgtcattgcgggctgagagaaaaataaccggaatgcccagccccagctttttgatttttgcagacatttgatacccgtcttcacccggcagcatcacatccataatgaccaaatccaccttctgaatcaccgaaagcacatccgctccatctgttttccatatcacacgatatccctcgcgctgcaaaatcttttgcagcaaatcaccaatcatcacatcgtcctcaacgattaaaatacgataacccttcatcctagcgaacctttctcataaactccatggacagtttatatatttgatcaggctgatataaataaatactgtgtgttcccctcagttcctttatatcggcagtattgaattgagccgcaaacgcttcatagtcttttcggttttgtatagcatactttgaatgtctattttggtcagagactgcatctaaaatcaagacgggagtttcctttggcgcaggcagattcacagatttgctgccgttttggtaagactgtaaaagctcatgctccatatctgcattaaaaaattgcttaaagttaatggctttatagatttctttttcttcatcagttaaaaacgactgtcgaatcacctcaggattatatacagcggaaggtataaaccgatgaaaaccaatcgaggttaacaggtggaaccctctcactttcaatcggtcaactccgctcaatttatacgtgacgtactgctggggcaatccaatatccatcgcaataatggccttgatttccttaggatatttctgtgcccaatacatcgcttcaatcccggatatcgaatgaggcattaaaatataaggaggcttatttccgcttttcataagcgctttcctcgtctgttccaataccgtatcaatatctctgtcatcgtgagacacttcactgtatccataacctgcccgatctacaacagcaatcttattttcttttgaaaacttgctgtacagccccttcatttcataagcaggcgcagcaatacccgaaccggacataaacacaaacgtatccttcccgcttccctcttgatacacattcatctttttaccgtcaacatcgactactgtgcctttacctttcagcagtgccgcctccttatttagctggaaatggtgataaataaataccgagacggatacaagcaaaaccaaagcagccaagctgacaaaaacaattttgaggactttccataatgttttcatatgatgctcctttcacttgataccgaaggatacaatatgaaaataaatttctgattaactttggaacagttttttttcacatttgactttgcccttacggaaaggtgtacatttggagcatagcagaacatttgatgaatttacctactaataaaaaaatatttcattaaaaaaccttcctgcttataggaaggaccgtttcatcataatattcaaccgtttgtcgcacatacaagacggaaaatttcacaagcctgcaatcttttttaacatcttatcccaaccaacatctcccatcgttttagtaatgatctgaccgtattgacttaatagacaaaagctggggatgccttgtacgtgacaagttgtgacgatctcatagttttggtctaatacaatcggaatagctagtcccctatcaagagcatacgtcaagacaacctccatagatttctcttcttctatataggggacatgtactccgattactttcacattcatatcctttatatcttgaaggactttgtctgttaattggtgacagtttggacagctcattgaccaaaaataaagaagaagatatgtgtcacttggaaatgtaaaatcattctgtgattgattcaaccatggtaaatgacttggccattcagtcaacatttgttcatctttcatcctttcagtcctccttatctttcagctgaaaagcaatcagctttcctaatgcctcttcagccgcaaacggagcaactattcctgaaggatgttcatgctcgtattttagacatttatacatcttaggttcaatgcaagacggatcaatccatgcaatacaccaagatgcccaaaagcacgattgcccttcactttcttgagcgattttgatgacaaagggcagactgggcttcccgattctcattaatgaaatcgccgctgccattcttgtatcttccgcatgactttttaataaacatgatagctcctccgctgcttcactcgcgtcttccccaaactcacctaaaacagctgcagcaatattacacaaagagccttcctcttttaaggcctcaaccaaaactggtattgcatcttttcccgatttctttagctcacctatcgcttgaacaattgtgatctcatttgtattcgctaaattctgaacagataacgacaatttatcaccatttgaattcataaaagagcccctctcctcgttttaaaacaataactctacataaccactatctgaaacgataaaacaggcaccaacttaggctccctatgcagacgaccaccactaatgtataccagtcagcagtcaataaatgaatgacatacaaacaaatgccgctcaggcctaatgccataaaaaatgacttgtagtattgaggcaatgaaagcttaatatcgtttcggtttgtatgggtaaaagcaaaaagccttattgtcatgaaccatatatatatccctaagccatatatataccaataaactaaattcccaactgccataaaagtaatagaaacacagtaaagaatatacaaccagactgtattcgtcagctctagaataatgatttttttccaaagggcaccggggaataaatgaagggtgcctgattgagaatgtctgacaattcctgaataataggaacttaacatgactgccgagacgataagaaagaatagaagataaaaccattctggatacatgaaaatgacgacataaaagacgccactgagcatgaccgtatgaatgctatgaaaaaataaatattttttaaaaaagcaacagttccaaccacagaaaagaccaaatgccatttagaccttgcaagccccaccaagtcgtttttggtttctgtataatttgacctgaaccaaattgacgttcttgaaattcctcccagaattcagcttctttcaccaacgattccttcatttctacctgacggctcgtaaaagcaattgtcataaaagagactgtgataatcccaataaatacaaccacatacaacggtgacaatgtatcaaacactaatccaacgccactaataaaacgggcaatgctctcccatatcccagatgaatgttggagaaagaagaagcgataaagacatatggagtaaatgcctaacattagaagaaagactaaaacgtatacccttttcattttcttcactgttctggcacaagagaccgacatcaaccacacttcagcgataaaaaagagccctacaaaaattatggatcggcctaataaattgatatgatcaccagacagaagcacaattaatacatcaccgaatatggctgagatgatccaaagcaacgccttccaagtgacgctgaaaaataaaacactatacacaacttttgaaaaagatgtggcagtgccataaagccatataatatctgccatttgacttggtaatcgatttgaaaaaagtccaaatgccgtataaaggataaaaacacctgtaagtacccaaccagcaatactcatatcccatgtcgtagatctagaaacaaaacttacttgaaatccgatggccccaacaaaaaggagcatgatcaaaaaaggcattttttttcctgaccttgacttacaaaacgcctttttgactgaagccataaaaaagaaatgatattattcatctgaccattcccctagaagacgaatcacttcttttctccattccgcttgttcttcgaattgaggaacatacaaatcctgcatgagtttgccgtctctaattaatatcaccctgtctgctgtctctataacaaactctagactatgagttgatacaaatgctgaacacccttgatcggttttagtttttaaccagttagagagccactgttttgatgggatatcaaggcccacagtcggttcgtctaatatatacagcaaagcgtcttgaacaatcgcccccgccaggacaacccgctgcttttggcctcttgacagctgaccacacaattggtttgctttctcctccaagtgcacttccttcaatgcatgataaaccctttcttttacatcttttttacctggatgatatcctcttgccctaaactgaatatgttcagcagcagttaaagcgggatacaaatatggctgatcaggaataagcgcgacttttttttgaacatttatatctcctggaggagaaccctcaatgaggatatctcctttatccggcttatagagacctgtcaaacatcgaattgtcgttgtttttccagctccatttggccccaatagcgccacgatttctcctcgttgaattgagaaagacaaatgttcaaccccatcaccatttcgatagcatttgcttaaattttgtacttgcatcaattgcatcaaatcttctcctaatcattagagtgaagtatgctttggctgatcatgatgcatatgtttctgaagcttgaactgccacagcggcatacagacgagtactaaattatgaatgaaatgagctactaatacacaaataaaaccaaatttgatgaagagaactcccagaaagcaaccgaatataaatagatgcagccaacgtatccaccttgggtcatatccagttacttggtgcatcaccgcccataaaaaggaagatacaataatggagatgaggatatttccactcatccaccaaatgactggaatcattaatagccgatagatgacctcttctccaattgaactttgtatgctcatattcaatccttgcctaaaggtaaaacctgatagaaagacagttcggttagaaagctcaggtgaaattcgtaaatattgctttttctccaataagttaaacagcagagaagtcactcctaaactaatgagccctgctcctattccatagaaaatctgaactattggttgttcaaacgttttccatccaaaatcaccagcaagcgcatttcctgccaatgaacatataaatactacaaatcctgttaataatcctgtaagaagtgtagacaaaatacctaataaactgaccgttttgacactcattcttgcatcataagcatttacaattgttaattgaatatcttctttcagcgtcaatgactggcatattataatcaacaaacccagaacaagactgaagattatgcttgtttgcacatccataaatacaaggatgagaatcgcaaggatcatcgctaaagctgaacccagcataccagatactccgaatgtcgattccacttgttcatctcgaatgactttactcatttgatctgttagtatttcttgttcagtaccaatataagaaattcggccgccctgtaattcaacagtcactttgagccgaatatctcccgcttccgctatgtaccaataagtactgacctcgcgaaaatcctcctcttttttaccagtaccagtcatatttgctctagaccaaagtccatcaggtgaagccattaacctctgcttgagtgtctctggagaaacttgttcaaacttccccgaaagggtttttttcggaacatccgcataaaaaaaagtgatttctcgattggcattgacaccaactacaaatgattgattctggtgaacgaaacggactctccatgattcgaccaacccaacatcatataaaacctttctatttttcttaagtatgcctaagtgatgaagtttatttactgtatcgtggtcataccaatatactgaataaaaatcccagttctctacatctatcccaacaaactcttttataaattgaatgcttatttcttttgcctcatctttgcttaagagtagtgaagcaattgttgggggtttgaatttaataaataacagtaatccaacaactgctaaaatactccagaacaccaatgatagactattcattcctgaatccctgccttgacttctttttgaaaaggtaagtccggttcagatagctcaattttccctatacatttgcaattttttgcttcacattttaactgaagcaaacgagcaggtgaaccaatgtcagccatgctatcttctaaaatatgccctagcggcaaatcttctaattggcaaggagttacgtatccatctgctcttatataccaagcaagatatcctggtgtacaaaaatctgttgtgaacgaactctcttcgtgctcccaatcaattatgttcaggcgatctccccatttatgacgtgcttccctaagctgtatttgaaccatttcttcaaaatcaatatccaaagccttaaagccttctgtcgcacgtccaacagataacgtttttcctgcacgaaagataaaagcacccgcattggcacattgctccaccacatctgatacttcatcagcattggactcattaatggtcatagcgacaatcactggaatgtttgcttctgataattttttaatggtattcatactttctttaaagccgccttttctgcctcttaattggtcatgtgtattatccataccatcaatactaatctgtacagaaacattgcctaagtgactaagtaattcaacttcttcatctcgccagttcaatccattactaaatacattcacattggtaaacaacgaacttgcaacaacgactaattctttaaaccctttgatcagctttgcttcacccccggtcagcgtaatatcagcaactccatgggctgctagcttttgcataaccaatatccattgttcactagataattcctcaggatatggtttacctgagctggcatagcaaaacgaacagcttaaattacaagcatttgtcaactgtaaggtacaactaataggtaaatatgaatctagcgaacccgaaacgtgtaaaggctgatctaacagcccttccgtccaagcctccgtaaatggatgggcactaagctcttcttttaattggtcagcactcatctcttcttttttcataatctcccaaatacgtgccgttttatgaagatttttgttttttgataacagaaacgccaactgtgctccacgtccactgagtctgaaataaaacatactttttctatcaatcattacagcaccatgaggctgtaaatgaaccgctaactctggcaaatcaaaatctttaacacgatcatatgacatataaaatcccccttaagagaaaataaggagtataagcaaatacgctcaactccctattctcaaatgttaaatagctctcatagcaggatgcggaagtgcacaaacacgtgtcatagcaatactcttcgaggcccaacagcccatgcagccagcagctttcacaatcgaagtacctcccggcttcataagtccttttttactcacagattcccattctttttggtttcttttcataagtaaacctcctctcaatttttgcatagagtctattgacatagctcccatgcgatacgataataccagattgcaattgtcgaagtaagggggattttgtatattatcctaaaaattacattaattagtataaatagaatattttaaccctttaaaaatagaaaagctgacaagctatcctctcgagaaaaacaggagctcacccctaattttccacttatgttttgaatattttcttgttctataaacaaaacgtcaaaaagacggtccattatgttataaaaattctgatgcctaatagattgacaaaaaatctcttcgaggaaattaaatcaagagattattttcaaataaactttagtgattaagaaagcaatgactttggttaaatgaatgaagtctcctgtaatttaaatcaaatatctatactaaaaaccccttcggctaaaatatccagaggggttaaacatcttactccacagtaacactcttcattacgctgcttatcgacatcacaaccgagatgcagggcagcattagtaagcaatcagctgcaatcgacaacggaaacagagcaagcgctgtgtttacttccggcaatacgaatctgtcatccgcattgtctaggcctttcagcgagatgatgcaagtgtttactccccaagtggcaacttccttgacgtttacgcggatgttcaggtttacgttctcttgtgtttccagtgttcgatcaaggcaatcgtactgtacttcagctcgccgcggcaaagccttaagaaatctcattcagcttcagtgcaccttcgacacatacagaacgatgtcggcccttggaagactcatgcatggactgactacgctaaaaaaaacacccgcttgtataacgagcggatgttagaactttcgaaattattgattgatatcttttagcgcttgtttcggttgcgaattgaaaatcagcaatgatgcaataattgcaatcataacccctaacgcaccaacccaggtaatcgaggccaatgatacgttttccacaaaaacccctcctatacctgcgccgaccgccatggcgaattgcatcattgactgattcatgctaagcaaaacacctgacatttccggttctattgtagccaggtgaaattgctgtgtcggaccggtggaccatgcggcaaacgaccataatatgagaatcaccaacactccgatataggaatgagtaacaagtgacagcagaatcagtgtgacgatatgcaacgtcatcccgccaacgagtgtaaagggcactccccatttatcggtgctatatcccccaaacttcgatccaaccaaactggcaattccaaatataagcaaaacaccgctgagcagcttgccatttatacctgagatgttcaagagatacggtgacaaataagtgtaagcaacagaatatcccccgagccagaagaaagtgattgataatcccatagccactttccgttttttgaaaagagcaagctgttgaagcaaaggcacaggcttatccccttcagtatacggaagagtaaagaaaataacgaccattgcgatcaatcccaacaaagcaatggctccaaatacagacttccagcctaatgctactgctatcattcttccaagcggaacaccaatgattaaagaagcggtaaatcccatcacgaccgtagcgatggcactgccctgcttcccttccgatgcaatcttagcggcaatcgttaatgcggtgacaacaaccacacctgctcccatcgccataatgatccgcgctgcaataaaccatccataaccaggcagtacaaaagccaggacattaccgaacacaaacaaacctagggcatacatcatcaatttgcgtctatccatacttgctgtcaacgccataagtacgggtgtagaaagagcatatacaagtgagaaaatggtaataagctggcccgcggcagctaaagtgatcccgagagtatgagcaatttgatccaaaattccggaaatgatgtactctgaggttccaactaaaaagctgacaatggctaaaatataaattttccaagtgttagacataaaacattcactccttaattattaataaacatatcacgaattatcgatatgttattataaaaaaataaacacatcgtaatatgtcgatatgtatggtgtaaaaataaacatcttttgatgtttatttttatatctctgttttaagaaagtcagcaagtttcccaatggcttcttcatctcttttataatacgtgtactttccgattcgctccgccttaattaggccggctcttaaaaggatggtaagatattgagaagctgtcgattgcgtcattttcaatttgtctgttatttgactgacacataccccgattgtgttcatatcaatcccttcatggggtgcaaaatgacgatcgggctccttcagccattgtaaaatttgcagccttgattcatttgataaggctttgaatacttcaattggttccatatcgattattatatcgttatatttcgatatgtcaatccgttttttggatatatttaattaaaggtttatctctgactaattccgtgaaatgaaactgaagacagcatatcaattttgttcaccgcttaaatttatcagcaagctttacgaagttggtctcataatcatgtcactaaacacttggggaaacccggcaggtgacaaggatgttttcaaatattgttcaagtgactaatcaccagcatcaaattcatgtatttaaaatagatgtaaaaaaacatccgctcataacaacagcggatgttagatctttcgacaggaataacatgacagtgtactatgaattgacatctctttatgtccgcttaggatatgaataaaagttatcaatgataccataattgtaaaacaaaagaatcggcagttctttatgttcaattcacaacaaattccacaccgtcaaaacatttattttctttagattataagatcttttccaaatttttctctagatcattacataatttaaataccatcactcgttcacctgtccgggagcttaaatcagtatgaaaacttttcactttttctccggttatttttaagataatatccttaaggccttctatacctgattcgactaactctgaacgagtttgtttgatagataacataccctcttttgatccacaaactacatattcggctggtgttaaaatcccttttaaattgacgatgatcatgtcccgcagtatatcagtcttaacagatacagacccccgcccaagataatccttctcccattgagtaatggacttactgatctctgattcaatagaacccttagactttttcatatctaatacatctcctgagcaaaaaaattggcatattctatttgtgatttcgtctcattaatattctcttacaacatatccttcatatacaccttcaatatccaaatcagttttaccgtttcttgtgaccactatcattttggataacatattttcttccatcatagagtggacatgcaaaaatcgaacatttcctgaatgggtttcctcaacttcttcataagactttagatgataaaaatcaattgcttttctaattagtttttttatacattccatattttcacgatcaaacgagttcatttcctctattgttttcgtgacaaaatcagttaaattagcgctcatacaatctccttagaactgctttctccatatatgggtgcgtttagaagttaaacctgcatttcatcatgacaagcaatgatcaggcatggcttgacctgttttaacatcaggaacctccgcgattgagggttttccacccttatgattaacgaataaacctctaactttaacatatgacggcactaggggatgatgtcgaatcatatcaacacttttttcaatggtgtcactgctattttcatttagccattcatcgaccgtaccacctaaaaattcaggcttgcaattttgaaacagataatccaatgtttgtattttatctttcattgtttcaagttgagttagtccattacctgcagaagtcttcttatcttttgttcctactacaaaaatctcctcaacatcttcctggtaaatcgcaaaaataacagacctcatgatttctccataaggatgtgaaatactggcaccatagctttgtatagtcaacatattctctgcagaagtgttagtcgcttcttgtaaaataggctccaaaccgttttcaatatccgtcaaaaataatacttttttattttggtttacattcatacagcacacctcttccttatgtttatcatttttgtattgagtaacaaatccatttgataaatgcttagattcatcattaccagctttcccaacatccttctggatcaagactagccagtcggacccatccattttgaactttttgcagaaatgctgaatcatgatttaataaccgttctacatattctctaggtgcttggatgagtatcaataaacgaagaggagaatgataggcctcgtgatctgattccatgacggattgccaaggcagtccggctaacaaatcgcttgcattcccctgcataacgccgagacctgcagtaacggtttgagttgctttatttccgctgccataataatgaggtgctaccgttgatgcgtaatattgtaaattaatccattgggctacagttccaggtcctacaataatatttgctaggagttcaccgctttcatcctgcttccaatcataattatggagaaaggctctgccttccaaatcacaatcctgagttaattcacgtttaccgataataaaagcggcattacgagccagtccccattccggacgtatctcactccaatcttccgcaaatcggtttgcctcagccttcggattttttagcttcgattggaaattcggtaattgggctagacgttctgcgtttacatgatgtctcactttcggcataacggcttcaatttgttcaaatgcttcttgtgcagcttcggaaagctctggtacataaagccaatgtaattcatctactgttgtattatgttcagctgctgcaaaaactgtatcctcaggaattttaattccttcagctaaaagagcttctcgtacctctgatagattacataaagcagctaaaactcttgcattgaatccaccggccgctccaccacaggcaccacaatcaagggctgcagaataaggattattagtactttgactgccatgcccacaaatcacgaccaatggtgcgatgttctctgttaaccccatcatttttaatgcttggcgagcatagttcactttttcttcatcagtaaaacccacaggtatttctgcctctgtagcatcatgatgaagcgagagttttgtatcaggtttgcgtaaccaagcctcacggagattacgaatgaaacgacccgcctttcttggcacaaagctacgggctgccatttgcagagtaagccaaggtccacttagctcaggcagtagtaagctcgaaagcgcattctgcttcatcgttttaaaggtatggcttaaagaatgaattgcttgcttccgttgattgtattttttgaatacatcctcatctgcgaactcttttattttattttgcggtttttgtatgatcggcaaggaagcatgactgtgtttactgccaagttcacaagttgcaatcggcaccccgaagaaaccagcaataccaatcgtttcaaacgggccttctttttctagttgacgacgaaaaggttctgatcgtacatcgatgcagaatgctaattgagctaatgcagatttttcacggccggtttcacgttgtttcgagatgatcttctggcttaatcgatcagtgtacgtttgttcccaagcttctaaccaaagtttcttgcgaagtttctcatcaaagctgtaggcaaatgataaatattcgttttgttcactggccgtcatctgtgaccattcttctaatgtaagcccaccccaatgaatccaagctgctataaggggagcaattgaaattgttttcttagatcgttcattagtcaaaggtaagtatggctttataagagcccactccatggatattcgaaccgctaaatattctgttagtagtgcatgttcgtggctcgattgttgggagcgccaaagcatcatccctgcccatccaggtaatgaaagtaaatgaccttcaagataagtctggatttctgactctgggatttctagtgcgaataaagcttcttgtaaagccaaatgtgcctctttcggccaaccttttaccctttctcgctgctttttgctaagtgctggatcatattgaataagatgctgccaagcacgatagaaaccttcctcacgattaggcattgtccaacccgcttgagagtcatcaagatataatttactccatttaatgacatgatgatctagtatattgactagcctttcaccatcttgattctctatatacgaacttagtggctgcataaacacattctcgatatgatccaatccactacattcacttactaatttctccagctcatgtgatgataaaaggtcggaaggcaggggatctaactttaatgcagcatgacaaaatcgctctgctacgtcccgtgggatgtgataggaatgtgaatcaagccaacgctgcagccccatttccacaaaatcttcatcaatctcacctttattctttgctgaacggatcatagacgcactagggtatatatcaacatcgcgagtgtttttcaaccaacttgcaacctgatcaaaaggttggttttcaagtcccatccacggattacgtgcagcaaatgtagaaataggccaaagtggcgcaatcactcggctggcagatgtaatgaaaacgttaagatccctttcttgaacatcaatatctgtatctatcttttttacattatctttcgttaatacggatgtaatgcccatctcagattagctccttatgaaatatattgtttaaggtagtctgggtgactctctactgactttggttttgcttcacctaatcggactaaccaaagatagagtaccgcgaaaaaaacggaagaacgatgacgagcaacccacgtacctaaagcactgccaaagagtaagagacatacgacaatcatgacagctgacattggaggttgaacactttgaaaaatggttgtatgcagccacttatagaaaaggtgatgaatgataaaatatacgagggctgctcctcctaaaacagttaaaccggcaatccggccaattcggccctctccaaaagcgacaagctgatcccaagaaacggacaatgaccaccctaagatcagcgcactgattaagtgatacccgtctccaggagcagtgagccaaaaagcaacacctataactaaggataaaatccgaccagccatgacccataaataggatgttctttcattagtgcgagtcgatacttcatgacgccctactgctgaaccagcctgtagaaacaacgtagccttgaataaaccatgtaaaataaggtgaataatggctgctatataggcgcctaatgcacactgaatgagcataaaccccatttgtccaatcgtggagcctactaactggcgtttataatcaacctgaactaaactaattccagttccaatcaatacagaaatgctagcaagcagaagtaagataatcgaagcgataccaccatgaaatagaggtgaaaatcgagttagtattattcctccagcatttactaaacctgcatgcataattgcagaaactggggtgggagcaacaatagactcaaccaaccatctttggaacggccattgagctgcaggaatgatcaccgccagtacaatcaatagctgaatccctgttctctcccattctcccagcccagctaaactttcatttgttacaaccaatgatagctgccattgacctgtggcatgaaaaagccacatcatcgcaaaaaacaaagaaaaccaacttaacaaaaataaccgtccagaaattttggctgcttcactagccacttgccaagcactgtttaaccttataagtaaggttaaaccaacaagagttgctccccaaaatagaaccatcaagcggagatcaccacttaaccatgtcattgaagcagctcctgttgtgaaagtaaaaagcgtaaaatattttcgataagatcgatcccccattaagtaacgtacagaaaaacgctgaatgatgaatccaattgcaagaacaaagaaagtcattaaacaagctaaggaatctaagtgccaagggccaacatttccactcacaccactattggcaagaatcagtaaggaaaccaaaagtggtaaagccaagatcccaatatgaatgcgaacaaaactcaagggtacacgcggatgtaaaaacaatagtccactaatcccagaagccataagcataataaaaaataatgttaataatgatgacaaactcagcgaaactaacattctaaattctcccttttttaaaactcattattggtcaaaagacctttcaatcagatcatatttgtctattatttatttcaatttttatttatctctatttttttccaacaaaaaagccgacaacttcaaaatttcaatgattatgttagatcattgaatcctgaaaattgtcggcttcacttcaactaacttcagcgaagttttttgaagagctaccttattattggtctttactttatgctatgttttcatttcctttaatatagtcctgattatcaaataaatcgactcatgttctcttccttttttattaggatactttttcatcctatcaatatttaaaatgaaatatgaaaagaatgctaaaggcctacatattttaaaaggaaaaataaacatctgcatcgattattaagttacgtataagatatgctaaattttaaaagttgtcaagtttatcagtaaactggtctttactttcctctaaaagaatccaacccattatagatgattcactttcaatgaggaacatccatttcagatgaagctcgcttttccagatcgaggagcagtgtcttcatttcaaatccgccccgatagccagttaatgagccattctttcctattacacgatggcacggtacagtaattaataccggattagccccaatagccgcacctacagcacgaacagctgctggtttatttatatcatttgcaatgtcggaataggatttcgtctgtccataaggaatttcacaaagtgcattccagacggctagctgaaattgcgtaccggcgtactcaactggaacagtaaagtttttccgctttccttctagatattgagtgatttcaacggcatagggttcaagcttatcatcatcttcaacaagaagacttcccggaaagcgtttcctagcccattcgaacaattcctcgattggtttgttctgtgaacctacaaacacaagcccctttaaagttgaagcaatataaaaattccaatccttgaacattagtaaagaccaataaagggttggtttatttgtttccattgtacgtttcctccattttactcatttgacgaaatcgtgctggtgtctgtccagttttctttttaaataaagtaataaaataaggcgcgttagctatacccacacatatagcgatatctccaatcgctttatttgtctgaatcaaatactttttagccgcgtgtactctaacttgttgtatatactcaaccagcgtaatgcctttaatttttttaaatgttcgatgcatatgatacggactcccatgacaaatatctgctaacgattctagcgttaatttttctgtgaaatttttatcaatgtattcagtaattaaatcaacccactcgctatcaggcattttttcattagtgggcttgcaacgtttacaagggcgaaaatttgcgcggagagcttgttctgtgtttggaaagatacatacattttcttttttcggaacgcgagatttacaggatggtttacagaatatccctgtcgatttaacagcgtagaaaaattgattattgtacgctgcatcattatttataattgcttgccacttttcatctgttatcatttctgcatcattcgaaattctatgatcatggctctctttatgtccgttattgatactatccggcatttatctcacctctccttacaatgctcatctaattctttgaattgaatcccaatttaaattttcgacacgcgttttttatatcttgggccatttttatctactcccgtttagcattcttgataactacactataacctcataaatagaaaaaaataaggtggttagaatgtaatagcaagataacaaaatgagtaaagatgattatgtgataaactaatttcaaccagcgtgagttttcttataattatttaagataaggagaatgaaaaagtgacatggcatgaagtcaatgatgttattgtcattacattacctgaaattttcgacatgaatgcgaaccttggctacctaaccagggaaaaaaatgaatgcatgtatgaaatagagaacaatatcattacaaaagttatagccattggggaaattcggtccttagtgcaggtaagcgtaatcaataataaacaaatgattgttcaattcctaaacgattctagacctgttgagcagtggaaacgggaagagattgtaaaatatattcatgaatggtttgatcttgataacgatttaactccattttatgaaatggcaaaagcagatccattacttaaaatgcctgcccgaaaattttatgggttgcgagtgatcggcattcccgatttatttgaagctttatgttggggagttttagggcaacaaattaacttagccttcgcgtactccttaaagaagcaatttgtagaagcatttggcgattctattgaatggaatggtaaaaagtattgggtgttcccaccgtacgagcgaattgcacggttaacccctaccgacctggcagatattaaaatgacggtgaaaaaaagtgaatatatcattggaatagccagattaatggcaagtggagaattatcgagggaaaaattaatgaaaatgaactttaaagatgctgaaaaaaacttaattaaaatacgaggaatcggtccttggacagccaattatgttctaatgcgctgccttaggttcccgacagcttttccaatcgatgatgtgggtcttattcattcgataaaaatattacgtaatatgaaccgaaagcctacgaaagatgaaatcttagaaatatcggttccatggaaagaatggcaatcatacgctaccttttatttatggcgtgtcctttactgaatcatttcaactttaaccggaatgtactcaataaaaaaagaatgaactttaaaacctaatcccacaagtacattgtaagtgcgacttctagaattctttgccctttattaattgtcaataaaaaaacacgttatcattccaataggctctccggttttcggatttctagcatgctaaattccaactgctatcaaaagcgtatcttaatgaggaactgctctcttatatctgtattaacattagaaaactcagttaggcaaaagcagtttctctccaagttttaatgccttttaacctgattgaccgatctaatgaggaaacatcttaaatctatagccatggtcgatcgatagtcgggtcctgtaccatcaacttctttaatccatttttccactgtagacgttctttcgcttttggacataaaaacacccctttagataatcttatccaaaggggttaaacatttattactccacagtaacactcttcgcaaggttacgaggtttatccacatcacagccgcgatgcagtgcagcatagtaagcgatcagctgcaatggaacaacagataccaacggagcaagcgctgggtttacttccggcaatacgaatctgtcatccgcatcgtctaggcctttcagtgagatgatgcatgtgtttgctccgcgagcagcaacttctttgacgtttccgcggatgcttaggtttacatgctcttgagttgccagtgcgaatactggtgttccttgttcgatcaaggcaatcgttccgtgctttagctcaccgccggcaaaaccttctgcctggatgtaagaaatctctttcagcttcagtgcgccttcgacacatacgaagtagtcaaggccgcgtccgatgaagaaagcatttctggatacagtcaggtattcacgagcgatcatttccatttcgtctttctggtcgcatagagcttccattgcgtttgcagcgataccgagttctttgacgaggtcaaatccgatattgatgccatttttgtcagcagccacagaagcaagaaccgccagaactgcgatttgtgcagtgtatgctttcgttgacgcaacagcgatctcagggcctgcatgaagcagcaatgtatagtcagcttcacgagaaagcgttgatccaggtacgtttgtgattgtcagggctttgtgtccgagcgctttgacttgaacgagtaccgcgcggctgtctgctgtttctccgctttgagaaaggaaaatgaagagcggtttcttagacagaagcggcatgttgtaggagaattcactcgctacatgcacttcaaccggcacgtttgcccacatttcaatatattgtttaccgacaagtcctgcatggtagcttgttccgcagccaatgatatagatgcggtccgcttccgctacagcggcagcgatatcgccaggcacagacagcttgccgttttcatcttgatacgtttggatgattttgcgcataacaacaggctgctcatccgtttctttcaacatgtagtgagggtacgtgcctttttcgatatcactggcatcaagctcagcaatataagacgcacgtgtaatcacgtcaccatcaaggtttttgatgacaacttggtcatcagtgacgataaccatttctttatccatcagctctacgtattcgttggttacttgaagcatcgccatcgcatcagatgctacgacgttgaatgtatctccaagacctactaatagagggcttttgtttttcgctacaaaaatcgtttctctgttgtcgttatcgaataaagcaattgcataagagccttttaacagtgtaagtgttttgcggaacgcttcttctgtctcaagtcctccattgacgaattgctcgattacttgaacgactacttctgtatcggtgtcacttttgagctctacatcttgcaaatactcttgcttcagctgaacatagttctcgatcacgccgttgtgaacaagtgtaaagcggcccagtgcgctttgatgcgggtgagcgttcagatagcttggttcgccgtgtgtcgcccagcgagtatgcccaattccggctttcgcttctacattggcatccacaacttcacgaagatctgcaatgcgtcctttttctttgaacacatggattccctgttcgttggcaacagcaataccagcagagtcataaccgcgatactcaagcttctctaacccttttaataaaatttccttcgcatcaagctgaccgatataacctacgattccacacatatttttcttcctcctaagattgtaaaaggagacgaagaaagtcaaatttcaaggggactttcaatcgtcccctcctacatgttttttggaagatcatgtgatttctctttgttcaaggagtcacccccttggtttgaagaaatccttacggctgtgatctgcacactcagccgggaggcatccgccgaaaattcgataacctccatcctcgtcaactaagcctttttccgggcgcttagttcgggcgctataattataggtaaagcaataatcccgtcttcttttcctattgagaaaataagaacaagacaagcttgattttacaacatgtggcataaacggtcaattgttttttaagcaactttgccgtatgtctcacaattatcttatgtaaacctcgcttgtcttgttcactctctgataatagacttcgttactctaatcccatttctgaccggacgacttcaacaatgcgattgacatactcatcgcacagctctttcgtcttcgcttcagccatgacacggacgagcggttcagttcctgaagggcgcaccaaaatccggccgtcgccgttcatttctttttcaacttcagaaataactgcttttactttttcattttcttcaactttatatttatcagtcactctcacattgactaacagctgcgggaacttctgcatttcagctgcaagctctgacagcggcttgcctgttgcttttaaagtgttcatcagcataatagcagacaataatccgtcccctgtcgtgttgtaatcaaggaaaataagatgtcctgactgctctccgccgacgttgtagccgtcttttttcattgcttctactacgtagcggtcgccgacagctgtctgcacgcttttgatgccttctttttcgagcgccttatagaagccgaggttgctcatcacggttgaaaccactgtatcatcctttaaacggccctctgatttcagatgttttgagcatatgtacatgatttggtcgccgtctacaatatttcctttttcatcgacagcaatcaggcggtcgccgtcaccgtcgaacgcaagaccgagatccgcgtttttctctttgacaaacgcgctgagcgcttcgggatgagtcgaaccgacgccgtcattaatgtttaatccgttcggggaagtccccattgtagaaacatctgcatctaaatcagcaaacaggtgtgtcgccaaggatgacgttgcgccattggcacagtccaatgccacatgaatgcctgtgaaatcttcatcagctgtctgttttaagaattgcagatatttttgtccgccttcaaaataatcgtttacaagtccaaggtctgctccgacaggtcttggcagcttatcctcaggttcgtccatcaggcgctcaatttcagcctcctgttcatcagaaagcttaaatccatctcccccaaagaatttgatgccgttatcctgcactgggttatgagaagcggaaatcatgacgcccgcctctgcatccatcgcttttgtcaaataagatacacctggtgtagaaatgacacccaggcgcatgacttctgcgccaatggataaaagtccggcgacaagggctccctccagcatatggccggagatgcgtgtatcgcggcctatcagcacttttggacgttgtttgtcttttgtcagcacataaccgccgaaacgtccgactttaaaggccagctcaggtgtaagctcactattggcgacacctcttacaccgtctgttccaaaatacttgcccattttataatcgctccttttttattccgatgaggattgtgaattcgcagtggattcatcctcatcctgatcttggttttgatctttatttccgtcttggttttgatcgttgttgtttttatcagtgttctttgtatcttcttgctgattgttcttttgatcatttgtttgtttatctgtgtcctggttccctgatgtattgctgctgttatcattcgttgatgtattgcttttcttagacgtcagcttgattttggcgtttttccgccccaaggaccaagttacattctgtggcccgttcacttcaagcttcacgctatgctccccgtcctctaaatctgaaacattcacatacaattcaatatctgattttttcagtttatttatattcgtgggagagcctttagccgttacatctatcgcttgtgattcaggatcaagaaattcaatgttttgtgagctgctcagccctacagtcttgatagggacattctcgaacttctgatccgcttcactatcgacttctatatgcaaagtcacctttgacggtgagatttttttgacaccgtcaggaagcggaatatctgcctcgatatcggaatccttgttaattttacttaaatctaggctgacgccgtcaataaattcaagagaatccaacacatcctgtgagccgtaaaccgttacctcactggggctggattcaatattcgctatgctgacaccgtcaggaaggcttcctgtccgttcaattttaaagggcacttttttactcgggcttgtcaccggaacggtaatcttgatgaccgagggctccacgtcgacaggaagcgcgtttccgtctttatcatagacagtcactttcgcttccttttcaatcgtttcatctgcgttttccaaattcactgaagcttttacaagagaaatattatcgatcacatttttcgatccggtaatctgcacatttttcggactgacaatcggctgctccggagaatagccttttttcatcttgcttttgttgtagtactccacttctacgggaaaacttttggtcgtccgttcctgaatggtcactgtcgtaacagacggattaattgagattgtcagcccatccgacacgtttttggccttaagctcaaccttatgtgtgccggttttcaaatgttccatatcggcatatatttcaaagtttttggtctgccgagcctttttcacggcgcttgtcgagccttttatcgtgacattaaccgtttgcggaacacccgtcacgacgtaattttcatcatcataatacgctttaaccggaatatcagtcagagttgcttcatcagttgttgatgtcggaaagaaagattcacccggtttttttggagtcggtgcttggttgctgttaaccgccacataaagcaagagcgcgaaaagcagagcaataattttcacagcccagcggttgtttaagaatttatccatttttcttgcccctccaataccagcggttagaagaagtgtctctggtgtttttcttaaactcggcttcaagcatttctttcagcgcttcttctgtaagctctctgtgaaggtcgccgttctttgccacactgacgccgccggtctcttcagacacaataatcgtcaaactgtctgttacttcactgataccgacagctgctctgtgccgcgtgcccagttcttttgaaataaacgggctctcagaaagcggcagataacaggcggccgcggcaatttcattatttttcataattaccgcaccgtcatgaagcggggtgtttggaataaaaatattgatcagcagctcagagctgactttggcatttagtggtatgccggtctcaatataatcgcccattccagtatcccgctcaatggtcagcagggcgcctatacggcgtttcgccatataattgattgcttttgtaatggcctcaatcgttttctgctgcgcttcttcaacaggcgtgccgctcctcgaaaaaaagcggccgcggcctagctgttcaagcgctcttctcagctcaggctgaaaaataataataattgctaaaaatccccatgttatcgcttggtccatcagccattgaagtgtgctgaggcccaaatattggctggccatacgaacaagcacgatgactacaattccttttaacagctgaaccgctttcgtgccgcgtatcaccataatcaatttatatatcacataccaaacaaggagaatatcaacggcattgccgaggtactgcaaaaaagggatatcctcaaaagccatttcctcgtcctccaagatttcagtcatttcgtattttgtgttttacgtgttacgcatatgtactttacatagcgagcccattataccacatttcgatttagcaagtgaaatgtgccagccctctcagcccgcaaaaaaagagcaaagcggctaacgcgctttactcttctccgttcggattgaatgcatcgagtacacttttccccgcagacttcatcttgtaccatgtccagtcgaataactgattgatttcttcaatctgaccggtgacttgtccagcagaggccatatacttttcgccgtttacgacggttacatccccgtctattttgcctttaataatcagcttgccgtttttgacagtgacatcacctttgaccgtctcaccttctggcacggtcacagtatggttatgaaccacaagattcggctgcttggacacgctgaaattgtggtcattatgccagctgttaaaaaaacccccgcccatcaaaatgatgaataccgcagcagctgcgataacgggatgggttctgaaccatctttttacagaagctcttttcttctccttaggcaattttgccatgacattagcggtaaaatccgcgggggcttcgacatgcgatgtgctccgtacgagcgctatggatttctccatctcgtaaaaatgctttctgcatttctcgcatgtctccagatgttcatttaatacgtgttcatcttttggaaggatatctccatcaagatgcatatgcataagctgcacaatttgttcaggacagctcatttcatcaccccacttaaagatcccttaattgttttctaagagcctctctgcctctgtgaatccgcgttttcacagtccccacaggaatgtttagaatctccccgatttcaattaatgagagttcgtcaatatactttaatacgatgactgttctgtatttgtcaggaagctttaaaattttctgctgtatcgtgtttgagagctccagcgatacaactgcatcttcaggcaaaacaccatctgcgacgatttgagaatacatggtcaagccttccgtaccagccacctctgcgtcgaggtaataatccggcttctttttgcgaatgcggtcaatggtcaaattggtcgcgattcgataaagccaagttgaaaatttccggttaatatcaaaactgtcgatattaacgtacgctctgatgaaagcttcctgtgcaatatcctccgcctcatgcacattgccaagcatacggtagcaaagctgataaattttatctttgtaaatatctacgatgtccgcaaatgcatcctggtcgccttttttgacttgtttaattctttttttaatcatcatttccatatttatctaacctctgccttcaccggtctgtatgtatacgagcttcgtttcaaaaggtttcaatttttttataaaataagtttatcaaatttttggcagggtgtagatggtaattcgtgaataaactaccttaacatatttttaaaattattatacagactgaacagttagaagttggaatgatttttccgaaaagaaaaaagacaccttttgatcaaaggtgtctgtgactgggctagctggattcgaaccaacgcatgacggagtcaaagtccgttgccttaccgcttggctatagcccaataatggtggaggggggcagattcgaactgccgaaccctgagggagcggatttacagtccgccgcgtttagccacttcgctacccctccacataaaattttgaaaaaacagtgccggcaagaggacttgaacccccaacctactgattacaagtcagttgctctaccaattgagctacaccggcaagatggtggaggatgacgggctcgaaccgccgaccctctgcttgtaaggcagatgctctcccagctgagctaatcctccaaatggtgacccgtacgggattcgaacccgtgttaccgccgtgaaagggcggtgtcttaaccgcttgaccaacgggccgttgtgttctcgtcgagctgacaaaagttattatatacaggtcaccccctgtttgtaaagaggaaaattaaattttttattttcaaactttttaactccttttttaactgaaaaagcctcccaactaaagccatttattttatgatagagacaagcaaagcaagagaggagaaaccaatatgattctagtcagttcttgccttggaggcattgaatgcagatataacggctctcacgcagcgtcggagaaaatcagaaaactagtcgatgaaaagaaagcagtcatggcttgccctgaacttctcggcggcttctctaccccacgcgaacccgcagaaatcataggaggcactggcgaggatgtcctcaatggaacagcgaaaatcgtgacagcttcaggagaagacgtcacagaactatatatggaaggcgccgcgaaaacattggcttacgcaaaagaaatcaacgcttctgccgtcatattaaaagaaaacagtccatcttgcggaagcggttttatctataacggcacattctctggcaaaaaaatcaccggcagcggagtaaccgccgcactgttaaaacaagcgggctaccgcgtcatttcggaaaacgagcttaacgacatattgtaaggaggccaccccatgactcaagacatttctttatccttctataagcctgaacacttgcccgagctccaatcattcacgctcaccaacgatgacaaacgctttacctccctcccgaaagaggtgctgtctcaggctctgggcatacaggaccgatacccggttgtcatcttaaaagacgaccttccagtcggttttttcattttacatgcatcaaaagaaacgcttgcttcctattctaacaatccatttgctttactgctcagctccctgtctttaaccgctgtgcatcacggaaaaggctatgcgaaaaaagccatgcttttgcttcccgcttttgtgagcggatattttccatggtgcgacgaaatcatcttggccgtcaatcatctgaacatacgcgcaaaacacctttatatgaaaagcgggttccttgataaaggacggcgaagaatcgggccgcttggagaacagttgatccttcatcatttcttatagtcttaagtgaaataaaatttcaaaaatttaaaaacatagttgaaatatcataacagaaatgaatatactgaatattgagatatatcattttaaaacagggggcatcctcatgtcagaaccattaaaccttcaccgtcttacaacggaatcacgcaatagtcaaacagttgaaatccacaaagcaaacactctcggcatccttaaaatgatcaacaacgaagatatgaaagtcgctgcagccgttcaggaggttctccccgacatcaaaacagctgtagactgcgcatatgaatcgtttcaaaatggaggccggctcatatatacaggcgccggcacaagcggcagactcggcgtcatggatgctgttgaatgtcctcccacctacagcgtaagcccagatcaggtcatcggaatcatggctggaggccccgaagcctttttacaggcagcagagggcattgaagacagtgaagaagcaggagctgaagatttaagaaacatacagctcacttcaaatgacaccgtcattgccatcgcagcaagcggccgcacaccctacgccgcaggcgccctaagatacgcccgtaaagtcggagcacacaccatcgcccttacttgcaatgaaaattccgccatcagcaaggatgcggatcacagcattgaggttgtcgtcggacctgaggccattacaggatcaacacgtatgaaagccgcaaccgctcataaaatgattctaaacatgatatctaccgctgtaatggtcaaaatcggcaaggtttacgaaaacttgatggtagacgtcaacgtcagcaacaaaaactaaaagaacgcgccatcagcatcatccaaagccttacaaacgcttcatacgacacagccagatacactctggaacaagccgatcatcacgtcaaaacagcaatcgtcatgctcaaaacaagcacagatcagaaacaagcacagacattactcgatgaagcaaacggtttcattgacaaagcaatcgaacattaccatccatgataaggagagaactagaatggccacaggcggtttagcgatcatccaatcaatgaagcataagctccctccatccgagcgcaaacttgcagattatatcctagcccatccccacaaagcaatcgaaagcacggtcaacgaaatcagcgccttagccaattcaagtgacgctgccgtcatcaggctctgcaaatcactcggtttaaaaggatttcaagatttaaaaatgagagtagcaggcgatctggcaaagcctacgtttcagggctaccgggatattgttccccacgagccgctgccctccatttccgaaaaaacggccggcaatgccattcaagccattcaggatacttcagacctgatggactacaaagagcttgaacgagcggtttctctgcttctcaaagctcataccgtgcattttatcggcctcggggcttccggcattgtcgccaaggacgcccagcaaaagtggcttcgcattcataaacaagcaaccgcgtttacagacactcatcttgtggcatctttaatcgcaaatgcagataaagacgacatcgtattcgccatttcgttttcaggagagacacaggaaatcgttgaactgttcgccatggctaaggaaaaaggcatcacaacgatcagcctcacacaattcagtcagacatccgtctccgcactggctgatgtccctttgtatacagcccattccaatgaagccttgattcgaagtgcagccacttcttcccgcctcgcccagctttttataattgatgttttgtttttaggcatggcggctgagcagtatgaaacgacaaccggttatatagataaaacgagagcagccatacaatctatgagaataaaataaggcatcttgaaggggaggggttttaatgagcaaagaaaataactaccatcatctcgcacagaaaatccttgagctatgcggaggaaaatccaatatttcttcatatacgcattgcatgacacgcctgcgcattacgccttacgatgaaagcaaagcggatgctcaggctttaagaaagcttgacggcgtattgggggtcgttgaagctgaaaccttacaaattatcctcggcacaggagttgtcaatcatgttacagctgctttctcaaagctcgtgtcagcagaagaaggtgccgatgtcaaagaagcagcggccaaaaagaaagccgatatcaatcggaaaaatgccactccttttaaacttttcttacgtaaaattgccagcatttttatccctcttattcccgctctagtcgcttccggtttaattactgggattaccaaagcaattattcaagcaggctggctctctgcagactcacaaattgcgattatcctgacagtcatcggatcagggctgttcacttatctcggcattctcgtcggtattaacgcttcgaaagaatttggcgggacacccgcacttggggctttggccgggatcttgattatcaatccggagatcgcaaaaatcagtttatttggagaagagcttctcccgggcaggggaggtctgatcggcgtccttttcgcagccatattcattgcttacaccgaacaatttattcgccgttttattcctcaatcacttgatatcattgtcacacccaccgtttcactgttaatcaccggaatcgtaacgtatgtcgtatttatgcctttaggcggattcatttctgatgctattacatccggcctactgtccatcctggacatcggcggcatcgctgcgggctttattctgggcgcaaccttccttcctctcgtcgtaaccggactgcatcaaggcttgacgcctgtgcacatggaactgatcaattcaattggcaatgatcctctgctccctattttggctatgggaggtgcaggacaggtaggcgcggcctttgccgttttcgtgaagacgaaaaaaacaacactgaggaaagcaatcgccggcgggcttccatcgggactgctcggcattggtgaaccgcttattttcggagtcacgctgccgcttggccgtccgtttttaacagcatgtttaggagctggaatcggcggcgcctttcaagcttattttcaagtagccaccattgcgattggtgtctccggactgccgctatcttttctagtcctgccttcgcaaatcatcctgtatatcgttgggctctttatttcctacgcggccggttttttattgacctatgcattcggatataaagatgaaatggcttctcagttcgattaaattgtttctgttttagggatagtaaacgggatagaagcacagaaaggggctagcctgtgaaaacaaagacactgttcatattcagtgccattttaaccctatcgatatttgcgccaaatgaaaccttcgcacaaacagcaggcaacttgattgagccgaaaatcataaatgcagaaactgcacaattctcgacgaagaagctaaggaaggtagatcagatgatagaacgggatattgcagcaggatttccaggcgccgttcttgtggtggtgaaggatggacgcatcataaaaaaagcagcatacggctacagtaaaaagtacgaaggatcagaactgctgcgccgtccggccaaaatgaaaacccgcacgatgtttgacttagcctcaaatacaaaaatgtacgcaacaaattttgcattgcagcgcttagtcagccaaggaaaacttgacgtctatgaaaaagtttctgcatatttgccgggtttcaaggatcagccgggtgacctcataaaaggaaaagacaagatacgtgtcattgatgtcctccagcaccaatcagggctcccatcaagcttttacttttacacgccggaaaaagccggcaagtactattcccaagaacgggacaaaacgattgaatatttgacgaaaattccgctcgattatcaaaccgggacaaaacacgtatacagtgacattggatatatgctactcggatgtattgtcgaaaaactcaccggcaaaccgcttgatgtctacacggagcaagagctctacaaaccgctcaggctgaagcataccttgtacaatccgctgcaaaagggctttaaaccgaaacagttcgcagctactgaacgcatgggcaatacacgtgacggcgttattcaattccctaacatccgcacaaacacgctgcaaggagaggtgcatgacgaaaaagcgttttactcaatggacggcgtgtctgggcatgccggattgttctcaaatgcagatgatatggccatactgctgcaagtcatgttaaacaaaggttcataccgaaacatttctttatttgatcagaaaacagccgacctgtttacagcaccttcagcaacagatccgacattcgctcttggctggaggcggaacggaagtaaaagcatggaatggatgtttggccctcatgccagcgaaaatgcttacgggcataccggctggacggggacagttacaattattgatccagcatacaatttaggcatcgcattgttaacaaataaaaagcatacaccagttattgatccggaagaaaatccgaacgtctttgaaggtgaccaatttccaacaggcagttatggaagtgtcataaccgcgatttatgaagcgatggagtgaatgattagacgataggaggaagtttctatgagacctgtctttccgcttatcctttcagccgttctctttctttcatgctttttcggggccagacagacagaagcctctgcatccaaacgtgcaatcgatgccaatcagattgtcaatcgtatgtcgttagatgaaaaactcggccagatgctgatgcctgattttagaaattggcaaaaggaaggcgagtcctctccgcaagcccttacaaaaatgaatgatgaagtcgccagcctcgtcaagaaatatcaattcggaggcatcatcctttttgcagaaaatgtaaaaacaacaaaacaaactgtccaactgacagacgattaccaaaaggcaagtccaaaaatcccgctcatgctgagtattgatcaggaaggcggcattgtaacgaggttaggggagggcactaatttcccagggaatatggcgctgggcgcagccagaagcagaatcaatgcgtatcagaccggcagcatcatcggaaaagagctctctgccttaggcatcaatacagatttcagccctgtcgtggacattaacaataatcctgataatcctgtaatcggcgtacggtcattcagctccaatcgagaactgacatcacgcctcggtttatatacgatgaaagggttgcagcggcaggatatcgcgtctgccctcaaacatttcccgggacatggagacacggacgttgacagccattatggactgccgctcgtttcccatggccaagaacggcttcgtgaggtcgagctttatccttttcaaaaagcaattgatgctggtgctgatatggtgatgacagcccatgttcagtttcccgcctttgatgacaccacttacaaaagcaaactcgatggatcggacattctggttccagctacactttcaaaaaaagtgatgacaggtcttcttcgtcaggaaatgggctttaatggggtcatcgttaccgatgcgctcaatatgaaggcaatcgcagatcatttcggacaggaagaggctgtggtcatggccgtaaaagctggtgtcgatattgcattaatgccagcctcagtcacttcattgaaagaagaacagaaattcgcacgtgttattcaagctttgaaagaagccgtgaaaaacggggatattcctgaacaacaaatcaacaattcagttgaaagaatcatttccctgaaaataaaacgcggcatgtatccagcgcgaaacagcgacagtacaaaagaaaaatagccaaagccaaaaaaatcgtaggaagcaagcagcacctgaaagcagagaaaaaattagctgaaaaagcagtaactgtattaaaaaatgaacagcacactttgccgttcaagcctaaaaaaggcagccgaatcttaattgtggcaccttacgaagaacaaactgcttcaatcgaacaaaccattcacgatctcatcaagcgaaagaaaatcaaacccgtatccctcagcaaaatgaactttgccagccaagtatttaagaccgagcatgaaaaacaagtaaaagaggctgattatatcattaccggctcctatgtcgtcaaaaatgaccctgtcgtcaacgacggtgtcatcgacgacacaatatcagattcaagcaaatgggccaccgtgtttccgagagctgtcatgaaagccgcactgcagcacaacaaaccatttgtcttaatgagcctgcgcaacccctatgacgcagccaatttcgaagaagcaaaagcactgattgcagtctatggctttaaaggatacgcaaatggccgttatcttcaacctaatattccggccggagtgatggcgatattcggccaggcaaaacctaaaggcacacttccagttgacattccgtcagtcacgaaaccagggaacaccctttacccacttggctacggattaaatatcaaaacgggaagaccgctttaataaggagggacacatgagaaaaacaatattcgcttttctgacagggctcatgatgttcggaacgataaccgctgcctctgcttcacccgattcaaagaatcaaacagctaaaaaacctaaagtccagactgggatagacacgctcttgccagactataaaaaacagctcaagggaaaacgcatcggactgatcaccaatccagccggagtaaacacatctctaaaaagcagtgtcgatatcctttacgagaacccggatatcaaactgacagctttattcggccctgaacacggcgtccgcggtgacgcccaggctggagacgaagtaggctcttacattgacgaaaaaaccggggttcccgtatacagcctctacggaaaaacgaaaaaccgactccagaaatgcttaaaaatgtcgatattctaatgtttgacattcaggatgtcgggacccgtttctacacgtacatttatacaatggcatacgcaatggaagccgctaaagaaaacggcattccatttatggtgctggaccgtccgaatcctcaaggcgggaatcatattgaaggaccaatcttagaacctgaatacgcctcatttgtcggattgtatcccattccattgaagcatgggatgacgataggcgaattggcttcactgttcaacaaagaatttagtattgatgccgatcttacagtggtaaaaatgaaacactggaaacgaaaaatggattttgacgatacccgattgcctttcgtcctcccttcgcctaacatgccgacggtggaaagcacatttgtttatcctgcaaccgggctgattgaaggaacaaatatatccgaagggcgagggacaacaaagccattcgaattgatcggagctccctttatcaaaagcacagaacttgaagaaacattaaacagcctccatttgccgggcgttacatttagggcagcatccttcacaccgacgttttctaaacatcaaggaacgctttgccacggtgtgcagctctatgtgacagacagagataagtttgaagccgttaaaacgggtctttcagtcattaaaaccatacacgatctctatcctgaggattttgagttcctgtcaacaggttcattcgataaactggcaggcaacggctggatcaggacaaaaattgaaaatggaacttcggttgagaacatcataaacagctatgaaaaaacactccaacaattcagcaaaacaagaaaaaagtatctcatttattagaacataagcatcgtatgttacacgtgtaacatattcttattgaacgaaagacccttacttttacacataagtaagggtttttttcatgctaaaaacccacccgctttatataggaaaactttcatttatttggtacaatttttattgaaaatgattatcaattgaaagcttctgaaaaggtggtctactcgtgcaaaatgcagtgatttatcaaccagtacaaattgaatatctaaaaaagacaagtgatctcttctcagaacagcaattagccgattcattcgtgctgatttttcatttaaaaggaaacggctatatttcgatcggaacaaacaccaatcctctgcaaaaaaagacactttatgtttgtccgcctaacgagacctttggctttacgccagcagccgatggacatatagatgcctgtataatcaggcttctaagctatatcaaggaaaccgggcaagatattttcacaccgtgcacagaatcggaattagccaaactgaagcttatgaatgtttcacatatcgaaaatcttgcagtccggcttcaagagcttgccgcactatggaatgaatcgtctcagctttctcagctaaaatgtgtgattgaagtacaaagcctgatttatgatctttttactgccagtttatctgatcaaacggatacacattcagcaatcgaaaaaacaaaacactatatcgaaacccatgccgatacaaaaatcacgcttgcccagctgtcgcaaatggcaggaatcagtgccaaacactacagtgaaagctttaaaaaatggacaggacagagcgtaacagaatttattacgaaaacacgaatcacaaaggcaaaacggctcatggcaaaatcaaactgcaaattgaaagaaatcgcacaccaaaccggttatcaagatgaattttatttcagcagaatctttaaaaaatatacaggctgttcacctacaagctatatgaaaaaacgccgaaagaaaatcgccgcatacggaaggggcacaatgggccatctcatccctcttcaccacataccttttgcggccgctctgcatccgaaatggacgtcttactactatcagcattattcgacagatatacccgtccagctcagtgcataccggtttaatgaaaagtgggaagaaaacctgtacacgttatcacaggcagaaccagatgtgattgtcagcatggattctatttctccagaagaacaagatcgcctgaatcgcatcgcagaagtcatgtaccttccttcagaagaaagctggagaacccactttctgcaaactgcctcatttttaaaggaggagtccgaagcagaaaagtggctagcggattatgaccagcagacaacggccgccaaaaaaacacttcagcacgttcaagggctgcgttttctctttttgaggctgcataagcaaaacttctatctggctcataaccgaagtgtccgcgaagttttctttggggatttaggattcagctcggcaacaacggctgacacaccttcagaacaagcgatttcgttagaaaatatcgcaaattaccaagctgactgtatgatgctttttctttttaaagagccggagaccatagcttactaccagcaattacagcagacagaagcatggcaaaacctaagcgcggtacgagataaccgtgtttatcttctatcccttgacccgtggaatgaatactcagcttgcgggcacgaacgcatcgttcagcaaactgtttctttactatccggagattgtccatgataaatcaggaatttgtccatggtgttatatctgttcattctctataattccaattgataatagttatcaattgaacaggaggctctatagatgaaaaagatatctcttaccttattaatcttacttctcgcgctgacggcggcagcttgcggcagcaaaaatgaatcaactgccagcaaggcaagcggcacagcatctgagaagaagaaaattgaataccttgataaaacatatgaagtaactgtaccgacagacaaaattgccattacgggaagcgttgaatcaatggaagacgcgaaattgcttgacgttcatccgcaaggcgcaatttcattctccggcaaattccctgatatgttcaaagacatcactgataaagccgaaccaaccggagaaaaaatggagccaaatattgaaaagattcttgaaatgaagccagatgttatccttgcttcaacaaagtttccggaaaaaacgctgcaaaaaatcagcacagcaggcacgacgatcccagtttctcatatctcttcaaactggaaggaaaacatgatgcttcttgcccagctgactggaaaagagaaaaaagcaaagaaaattattgcagactatgaacaggatctaaaagaaataaaaacaaaaatcaacgataaagcgaaagattcaaaagcgcttgtcatcagaatcagacaaggcaacatttacatttaccctgaacaggtgtatttcaactccacactatacggtgatttaggccttaaggcgccgaacgaagtaaaggctgcaaaagcgcaagagctgagttcattagaaaaattaagtgaaatgaacccggaccatattttcgtccaattttctgatgatgaaaatgcagacaaacctgatgccttaaaagatttagagaaaaatccaatctggaaaagccttaaagcagtcaaagaagaccatgtgtatgtcaactcagtggaccctctcgcacaaggcggcacagcttggagcaaagtccgtttcctgaaagcggctgctgaaaaattgacacaaaactaattcagagtaggtttttgtatgtattcaaaacagtggacacgtatcatattgattacttctccatttgctatagcgctgtcacttttgctttcaatcctttatggggcaaagcatctcagcacagatattgtttttacatctcttattcatttcgatccgggaaacacagaccatcaaattatatggcattcccggattccaagggctgccggcgctctgctcataggggcagcccttgctgtttctggagcgcttatgcagggcattacgcgcaattatttagcttcgccatccattatgggtgtttcagatggttcagcgtttatcattacgctttgcatggttctgctcccgcaatcatcttcgattgaaatgatgatatactcttttatcggctcagcgttaggagcggtgttagtattcggccttgccgccatgatgccaaacggatttacccccgtgcagctcgccatcatcggcacagtcacaagcatgctgctcagcagcttatcagcggccatgtcgatttattttcaaatttctcaggatctcagtttctggtacagtgccagacttcatcaaatgagtccagatttcctgaagcttgccgctccgtttttcctgattggcattataatggccatttctctcagcaaaaaggtaaccgctgtatcattaggggacgacatttctaaaagcctggggcaaaagaaaaaaaccattaaaatcatggcgatgctttccgtcatcattctaaccggcagtgccgtagcgctggccggaaaaattgcgtttgtcgggttggttgttccgcatatcacgagatttctcgtcggctctgattacagcaggctgattccgtgttcctgtattttgggcggaatctttttaaccctgtgtgatctcgcaagcagatttatcaactatccgtttgaaacaccgattgaggtcgtaacatccattatcggcgtacctttcttcctttatttaattaaacgaaaaggaggggagcaaaatggctaaaaaatatgcattgttcatcgctttgattcttgttgtcagctatttcagcttaacgagcggatcattttctgttcgtcctgctgagctgctctccactctttttcaaatcgacccgaatccgcagtatgaaattttgctgttcgatttaagactgccgcgggttgtcatggctgctattattggactcggtcttggcattgcaggcgctgttatccaggccatcacgagaaacgggcttgctgaccctggaattctcggaatcaacgcaggggcaggagctggcattgtagcgtttatgctcttattccaaggccagaaggaagtgacatccatagctgcagcgatgggaatgccgctctttggattgataggcgggctcatcgcggcgatcctgatttacatatttgcatggcacagaggcaatttagattcaggaagaattattttggtagggattgcgatcaattcaggattcagcgccctgtctttgtttttatctttaaaaatggacccgcaagactatcaaatggccatggtgtggaaaaacggaagcatctggtctgccaactggacgtatattacagctgtactcccatggatgctgctgtttataccgattcttatcggcaaatcccgcctgctcgacaccattcgttttgatgaagacacagtcagaagcctcggtatttcatcaaataaagaaaaaaccatccttctcgttgcctgtgtagcaatcatcagcgcctgtgtctccgtagcgggaagtatggcgtttgtcggcttaattgctccccatatctcacggagactggctggcgtcgaacatcgctatatcctgccactgagcggtttaatcgggatgcttcttgtgataagcgcagactttgccggaaaactgttttttcagcccgcagaagtgcccgcaggcatcattttggcgatcctcggagttccttatttcttatatctgcttttcaagcaaaaaaagggggagaatgcttgaaaggatctctttcagaacacaaagccggcaacaggaggttcacgctgtacctccctccttcctacagcacagacagcgggggatttcctgctgtttacgtgcaggatggcagttctttgttccaaaaccaaatcgaattactagaaagcgcctttcaacagcaaaggctccctgaactcgtgctgatcggtatcgaacccgaaaaccggcttgatgaatacaccccatggccggctgcatcactcagtgatcggttcacggacttcggcggaatgggatatcactatctgtctgatataacgaaccagttcattccgctaatcgaagaaaactggaacgtcaccagggaaccgcagtcaagaggaatgatcggtgcctcattaggcggcctcatctcaatgttcgccatattaaaatatccgtcaatgttcgggaaaataggctctatatcaggttcatactggtacgagaacgcagcggaaaccattcatatatcttctttaaagcccggcactgcacgtgttttcatgtctatcgggagtgaagaaggccgtgaaaaacaatccattcagcgacatatgctgaaaaaaacaaagcaagttcatcaaagtctaaaagaaaaaggcttcactgaagaccagttgtgtctttcaattgaaaaaggagcggtgcaccaccacaagtatttctgcaaacagttcatcaacgcgctcgaatggctatacggaaaaaaccgctcaaccctatgagcggtttttttatgccttctgcaacattggttttaattcaaaacgattcagcatatagccaaacaaagcagccaatatctgctgaaacagcatgccgatcacaacaggaacggcaacctgagacgggaagaacgtaacggcaagaactgcgccggcactaatattcctcatgcctcccgtaaatataagagagactatttcctcttgccgccttttcatcatttttccgatcagccaagcagcggcataacctgttaacgcgataaagaataccgttacagctattcctgcaaatctcaaatcaatggatttgaaataaggagcaatcgctgaactgttaatcgcaatcactgccatcaagcaaagctttgaaaaaggcgacagcgcactgctcacaaacgcagttctttctggagatgacatctgattaaacagcatgcccaaaaaagaaggaatcacgaccattacaatcagacctttcatcattccccacacatccatgtgaacctgagcgccggccagcaatgaaagactcagcggtacgattagcggtgacagcacagtatcaactaaaataatcgaaagtgtcaaaccgacattccctttgtacatcgctgcccaaatcaagcttgtaatccccgtaggaatcacaacagccaatgttaaaccggtaatcgtcaaaggatcacctttaaatataagatggccgctgccccaagcaaaaagcggcatgaaaatatgaagaacgaatagtgcaagaatcatagggagaggatgagacaatgcatgtctcaaagattgaaagttcgcgctcaaactgcctgcaaacgtaataaaagcaaagatccaaggcacagcccattcatacccatttaaaaactgagacagcagcacgcccagcaccacactagtcggcgttaacagcggcatcactctccccaatacacggttcagcttctgaagcatcatatgcaagtcccctatttaaaatttctcttctctctattatatcaatgctgcttaagtgtatgttatataaaaaagcccagatctcattcatctgggcttctctattttatgccatctgtttcattagagatttactcgctttattcaaaccttttaactcagcttcaatgccttgttccttaaacttcgcaacaatcttatcaagtgcggccgcaccagaatcgtcccatacgtgagcttcagttaagtcaatcacaacccgctcaatatcctcttgatatataaacgcattcgtaagatcagtcactgacgcaaaaaagatttgccccttcacttgatacgttctaagcttttgatcctctgcatgagaaacgattttcagcttcgagatttttgctacaaagaacacggcacttaaaagaacaccgacaaatacacccttagataagtcatccgtcacaacaaccgtaaccacagtcacaaccatgacaatcgagtccgtgagcggcgcttttttgagaccttttaaagaagaccaatcaaaagtgccgacagacaccataaccattacagctactaacgccgccattgggattttcaccacgacatgacttaacaccgcaattaaaaacatcagaaaagcaccggcaacaaatgctgacaaacgtccgcgaccgcccgcttttgtattaatgacagattgtccgatcatagcgcagcctgccattccgccaaagaatccagtcacgatattcgcaattccctgtccgcggctctctttatttttatcactatccgtatccgtcatttcatcaataatctgtgctgtcagcaaagattcaagcaacccgacaaacgctaaagcaattgaataaggaaaaataatttgcagtgtttcaaaggtaaacggaacatcagggattaagaaatgaggcaatgaactagaaatattgcccatatcaccaaccgtccgcacatccacatggaaagtgaccgcaataattgtcatcacaataatcgccacaagcggagacggaacagcagtcgtaaaccttggcagcacataaataataaccaacgacccggcaagcatcgcatacatgctccaagaagcaccttcaaactggggaagctgcgcagagaagataaggatcgccagcgcattcacaaacccgatcatcacagaacgcgggatgaatttcattaatcttgcaattttactgatacctaaaatcacctgaataatgcctgtcaaaatcgtagccgcaaataaatactgaagcccatgatcagcaaccagcgacaccataacgactgccattgagcctgtcgcagctgaaatcatgccaggtctgccaccaaaaatagaaataataatggctatgcaaaatgacgcataaagaccgaccatcggatccacaccggctataatagaaaagccaatcgcttcaggtattaacgctaacgcaactaaaatgccagcaagaatgtcttttcggatattcccgaaccattgctgttttaatgtaaaactattattcaaatataacgactcctttttagtaaaaaataaatccgcaccatatctattgtattgggagctttttttattttacgggagaaaatgaaaagaaaaacgaccggagaaaacggggaaacgttgagtatattgtattgaggcaaggagttgtcatacaaagagtatcataataaatttttatcaattacgcaagatgattgctgaagaaaaaaatggctcaaatatagtctgagacattttatcatatccggatgaaaccaagaatcgttttaatgacagtaatatcttttctctcatttggcaacccgagctggtttccgaaaaaataacctatcatcattatctcaggctgataaatatgagcggcctcatttaactctgtattttggcaatcaataaaacagcttttgcagggattattcttagttttttcttaggacttatttatggccggcatgttcgccattattttattgtcaccaatcaattttatcatggaaaaacagaacaaacgacaagcatgctgttcgctgccaatggattggcggctctatcctgccaatcgcagtcggatggagtctggatgagtctcccgtacaaactgcattttgattatttatgactctcatgttgatcatgctagggattgtattggaattcaaaagtattagaaaactttaaaaagcagaagcttgataaaatggatactgacgaaagcaaatcggcacagatataaaacaaaaaacccagctcaatgagctgggtttaagc

SEQ ID NO: 59 - DNA, 59592 bp, Bacillus subtilis WAUSV36
actgccgcttaacgaagcagctttattactataacatttagcttcttttaagtcaacaacttttttcaaagtatttaatgaagcttttagttgatgtcagctgtttatcagcgacgaataataatatatcacggatattatcaaaaggtcaacacccaatttaggctgtatgtgaagagacattttatcggttatattcaattgtccatgctcataagatgtaaaacaagaatgatggacaagataaggaggcatcatcagtgaatcacttctatgtgtggcacattaaacgggtaaaacaattaattattatacttatcgccgcatttgcagctgccagctttttttatatccaaagagctgtcccgcttcccgtgttttcaactgacaccggacctaaagccatttataaaggagaaacagactctaaagatatttcacttactttcgatatcagctggggtgatgagagagcagaaccgatacttaatactctgaaagcaaacgggattaaaaacgcaacgtttttcctgtccgcttcttgggcagaacgccatcccgacacagtggcccgtatcgtaaaggacggccatcaaatcgggagcatgggctacgcttataaaaactatgccaatttagagagcagcgaaataaaaaaggacatgaaccgtgcgcaaacagcctttgaaaagttaggggtcaaagacatacagctattaagaccccctaccggccaattcaataagaatgttctaaaggtcgcaaagcaatacaattatacagtcgttcattacagtgtgaactctcaagactggacaaatcccggagttgaaaaaatcatcgacaatgtgaccaagcaagtttccggtggagacattattcttttacatgcctccgattctgcaaaacaaacagaagaagcattgcctgatatcatccatcagctgaaagaaaaaggattaaaaaatgtaaccgtgggtgatctcatcgcaaattctgatgccaaatccgcagaggtaaagtaattactttgctgcaaacttcggcagcatcagcaattggaaggcattacatgccattaacggaaaaagcattaaataaagccagtcctcatcatttactcttaatgcagggaaccattctaatgcggtaatcacaaccatcaaaaataacgatgacacaaatgttttcttagaggactgcttttgctttatataagctgtaatcactccaaagatcaataaaaacaccggtaaccacgcatagccagccagcgattctccgctctctccaaaaaataaaaaacgcacgtacattaaatcaaaagcaacaaacaggatgaaaaacaactgcagcaaattccacaaagaggaggaccttaatatctcaagcgcaaaccgatgaactgttaaaaacacgaaaaaacccatttggctgatcacactgaaaatcatgcctacaccgataaaccaaaataaaacagagaaaatctgtcccgcttcaaatgttagaaacagccctctatattctccccactttaaagcaaaacccacaatactcgtgataagcgccccgacagctaaaatagaaaagaaaaacgaactaaaccacggcttttcatttctttattcatcccctcaaaaatcgcgaacagcgatattttgttatgtataattccaaacagatgaatcatattaaaggtaagacaagtatgtgaaaggagcttaagcatgtcaaaagccaaaacgctattgatgagctgttttttgttattatctgtaacagcttgcgctccaaaagaccaagcagcggatatggactatgatcagaccaaaaaaatggttgttgatatattaaaaactgatgatggaaagaaagctattaaggaattattaaatgatgatgccatgaatgaagcgctggtgattgaccaagatgcaattaaaggaacaatagaaaaaacactcacatctaaaaaaggtgaagaattttggaaaaacatctttgaagacactgattttgctgagggctttgccaaaactcttcagacagagcatgaaaaagtgattaaaaagctgatgaaggatccagattaccagaagatgctgatgagcgttatgcaggatcccggcatggataaaaagtacagccagctggcaaaaagccaagaattccgcagttatttagaagaggttattaacgaaacactttctagtccgctttacaaaaagcagttcgaagatgagctgaaaaaagcagcaaaagacacagcaaaagaaagtgaataaagggaaagccgggatctggaatcccggttcaccttttatacctgcactgacatttttgcatctagttttttttgcgatgtcctgatatatttctccgattggatgattttcgtcataaacagacggagcaaattggtccttatcccaatcgggctgtttcaatgggattctgccgagcaaaggcacgtttagttcctcagccagtttatctcctccgccttttccaaacacatattctctttcccctgtctttgcactttcataataagccatgttctctatgacacccacgacctcatgatcggttttaatcgccatagagcccgctctggccgcgacaaaagcagctgtcggatgtggcgtagatacgataatttctttgcagctcggaagcattgtatgtacatcgagagcaacgtcccctgtaccaggcggaagatcaagaacgatatagtctacttctccccactctacttcatggaaaaaattattcagcattttgccgagcatcggccctctccatacgaccggggcattttcttctacgaaaaagcccattgacatgacctttactccaaagcgttcaacaggaagaagtttctctccttcaattgttggacgcacagtgatacccatcatgtccggcacactgaacccataaatatccgcatcaattaaaccaacctttttccctagacgagccagagaaatagctaggtttactgacacagttgacttgcctacgccgccttttccacttgctacagcaagaaagactggcgggttatccatatttaataatgtttttttctcagctgacggcgcccggaatttagcaaccgtttcttcaggcagctcttcaaatcgaaggccgactgtctcagctcctgccccttttaatacgtttacgatctcttgctgaatctgcatttgttctgcagttcctgtttttgcaagagcgacttttacactgatatgccgtttttcaggctttattttaatttccttaacggcatccaattctcccagaggtctttgaagaaaaggttcgcgcatttctccgactagttttcttacttcatcttctcttatcatcgaacctcacccttttgtgtattcgtttacaattattattatatcatacataaatggcgggtgtcttatgcttagaaccacaagaaaaccctccattactccggagggtctcctttttctgtgaaatatcgcaaaatgcctttatatatggaagatgccaccttgtcttgatatttcggtttaccgagcaacgttgcttcacttggattggataaaaatccgacttctataagcgcccccggtttggtgacgttttgcattaagtagataccatgaatccgctttgctttccgggttgtgttttccagatttcttctcagctcatcctgaatgtattttgcgactttctcattttccgcatatttcccgtaataaaagctttgggctccgctccatttttgtgacggaatcgcattaagatgaatgctgatatagagctccgcctctgaatggtttattaatttgactcgttgtcttagatcctcagcttttcgtcggctatagccttttgttccttctggagcgagatcagtatcactttctctggtcatgataacaagcgctccttgttcttgaagataatccctgactctaaaggccacttccagggtaacatccttctctaacagctttccgccgactgctccgccgtcaggcccgccatgacctggatctagataaatgattttaccgctcaagggcaggctccacggcttccaagagtcgttattgctgaactgatacttgaacagaaatagtaatatgatgaagcctagcaaaaaactgagccatttaagctttttcctcatcccttcccctcccgcttgtccgttattacataactatgggacagggtcgggaaatatgattaccgcatgcgaagcttacactgtttttctctttgaacaaaccctgctgtccaccaatctttaatgaacttgcgtgccgcttcataaacagtgtttttatcaaatgttgcgtattgctcgtgtatccaattatagagataatcaaaaaactccatacgcagctcttcttcttctcttgcagagcgggcactgatactctgcattgattctccgtaatagccgaatatcccaaaacgcccgcctaacaaataagcttcaatcgcaaaatcaatacagccttcggtaataatatctcgttcatcatgtaaaaatggaaataatggttccaaacaatccttaacagactggataatttgtctcagagagagttctttgagcaagttcttttctaattcaaaatccttttggcgtttcacatccataaaagacagtacttctgccatataaattcactctccttttaccgattattttgaggtttggatgatgaaacaatgcccgaattcggttggaaattcgcccaaatgaaggtgtaacattgataaaaaatcagctttctgcagggtgaggaacaaatgttctgtaattggttatgaaaaaagcagcccctctaacaggtcgctgcttttcatactttcacgcttcttgttgcagaatatgtatggatatattggtctaatacaaaaccgcctttatcttcataaaaaccagtaacgataaaaccggcatcaatttggcctttgatttggtcttctaaggaatggccgaattccagagcctcattattttcgatcagttttttcactttatgtttcggaagatcttctgggtcagcgtatggaatagagtgttttacttttaaaacaccttgctgttctaattctgtatcaaacagaaatacaacaggattgacaaaacccgagattagaatgccgttccttttcaacacacggtacgcttccttccataccgggaggacattctcaacaaaaacattggcaacaggatgtacaatgacatcaaatgattcatcattaaatacacttaaatcgtccatgcttcctttgacagtgtgtatcgtcagaccatctcgctcagcaatcattctatcctgattcagctgtttttctgagttatctaatacagtgacatccgcgcctgcggctgccaaaactggaccctgctggccgccgcctgatgctaaacagagtactttcagacctttgataggcggaaaccaatccttcggtacatctttcattggtgttacccttatatcccaattgcctttttttgcttgttcgataacctgctgttcaacagcaacagtccattcattgcctgtttctacttttttatcccaggctttgctattatgagctactaacgcattcatgaatcttctccttactttaatgtatagagtataacaaatatttctagattgatatcgctttccctttgcatatttagaaaaaagttcataaaaacgcaaaaaaatcacaaaggagatatgtgatttatatcatcagatttacttttacttcgttacataaagccattagcaatgagagctattgtttctccgggttaagaatcagcagtgaactttaacggatgagatacagtggttagatggagctgggctgatcacataacgataataaacattgaccgaacttccaattgaataagaatgaaatctaccatgattattacaaagagaccgtttataaacaaacaatttgcttaaccccgtcaagcgtccattcagttgttatttttatgcgggactgccacgttttattgaaagaaaaaagctcccaacccaaggtcgagagctttttgaaaacgtaaaattaacgttttgagaactgaggtgcacgacgagcgcctttaagaccgtattttttacgttctttcatacgagcgtcacgagtcagaagacctgcacgtttaagagttgtacggtattctggatctgcttcaagcaaagcacgagcgataccgtgacggattgctccagcttgaccagataggccgcctccatgtacgtttactaaaacatcataagtgccagctgtttcagtcaaagttaatggttgtttgatatcttcgattaaagctgcagatgggatatgttcgctgatttcacgattattaacgacgatacggccttctcctggaactaaacgcacacgcgctacagagcttttacgacggccagtaccgtaatattgaacctgtgccaaattggtaacctcctttttaattaaccgcgaagttcgtaaacttcaggtttttgtgcttcgtgtggatgctcagaaccacggtatacgttcaattttttgaacatttgacgacctagagaaccttttggaagcatgcctttgatagcaagctcaagcattttctcagggtagtttgtacgcatttcaagagcagttcttgattttaatccgcctggatgttgagtgtgacggtagtagattttgtcagttaactttttaccagttaactcgattttttcagcgttgatgatgatcacatgatctccagtatcaacgtgtggtgtgtaagttggtttgtgttttccgcgaaggatagctgcaacttctgaagaaagacgacctaaagtcttgccagcagcatcaacaactaaccacttgcgttcaatagtacttgcgttagccataggtgttgtacgcattgaatttccctcctaaatgatctgtcattttcaataaacttcgattacgttctatttcacaacacaataagttccggggcttatcgtggggttgaaatacataccatatgatatcttataactttatgcagactctgtcaagaaaatattatacacctggtttagttgtcatagtaaacgttccataaatatagcccgtgccccggcgctgtgcgccctgccgcttcgcgatccttcgcttccagcatggatttcacctcatcgggagaaatttttccaatacctgcatcaagcaaagtacccgcaataattctgaccatattatataagaaaccgctgcctgtgatccgcatttgcaggccgtcagccgtctcagtccaatcaagttcgtatatcgttcttaccttgtcctgcacttctgttttagccgcgcaaaagctcgtaaaatcatgtgtccctataagatgctttgccgcttctctcatgtcctgcacattaaggcgatatgaaaaatggtaagcgtaatgccgtttaaatacgtccgggtgtttctccgtgtatacaaagtagcgatattcttttttgactgcgctaaatcgtgcatggaacccatcatccgcaatttctgcctgtttgactgcgatatcgtccggaagcagtgcatttaaggcatatggccatctctcagccgggatagacagcggagtgtcaaaatgaatcacctgtccggctgcgtgaaccccgctgtctgttcttccagacgaaacgaccggaattctgtcttttgacttatgcaggacagccaaagccttctccagttcatcctgaaccgttcttttgcccggctgaacctgataaccgttaaacaaatgtccgtcataagaaatcgtgcatttcagtctcatacagcacctctaagcccttaagaaaaataacaaagcagctaatacaattaagctgacaatgacagaagtgtcttttcctgtccatacaagctttctatatttcgtacgtccttctccgccttgatagcctcttgcttccattgccaccgcaagctcttcggcgcgtttaaatgcgctgacgaagagcgggacaagaagcgggacaatagccttcactctttctttgacaggcccgcttgtaaaatcaacgcctcgcgccatctgagccttcatgatcttatctgtctcctccatcagtgtcggaataaaccgtaaagaaattgacatcataagagccagctcatgaacaggaagctttaattttttcaatgggttcagcagctgctccattccatcggtaatctcaatcggtgtagtcgtaagcgttaataaggttgtgattaaaatcaaatagacgaatctaagagaaatgaatatcccctgaaccagaccgccctcatagactttgaaaaaacctatttgaaagataatcggtccttcatgtgtcataagaatgtgaagaaggaacgtaaaaaggacaatccagatgattggcttcagccctttcattaaaaaagagaaaggaactcttgttaaagaaacgacgccaattgtaaataaaccaagcaacgcatatgtctgaacattattggctaagaatacaatgcagacaaataaaaagatcgtgatcagttttgttctggggtcaagccggtgcacaagtgaagtccccggtacatacttgccgataatcatgctgtccatcataaagtcttctctccctgaaaaagagcacggatttcggcagcggcatcttcgattgtgagcataggctcattaaatctcacacccagtgcagcttcaaggtgtctttggaattttattgtttcaggaagatccagcccccagccggccatctcttcaccctttaaaaacagatcacgcggactgcctgatgcttgtatcgttcctttatgcataacaatcatttcatcagcgtatgcagctgcatcctccatgctgtgtgtcacaaggatcgtcgtcaagttcccacgttgatgaagctcataaaacatgtccataatctcttttcgccctcttgggtccaatcctgcagtcggttcatccagaacaagcacttcagggtccattgcaagtacgccggcaattgcaactctgcgcatttgtcccccgcttaattcaaagggtgacctgtccaaaagctcttctgataaacctacaagctgcagcatctctctcgctttttgttcagcatcttcttttttaacaccaaagttcatcggtccgaatgaaatatctttaagaactgtttcttcgaataattgatgctcaggaaattggaaaacgattccgacttttttacgaagttttttcagatctttattctttttccctgcctgaatgacagtgctgcctagtgatatctgtcccttcgtcggcttcaggagaccatttaggtgctgtagaagagtggacttgccagagcctgtatgcccgataacggctacgtagcttccttctttaatcgatgcattgatatcatacagtgctaggcgctcaaacggggtcttcatctgatagcgatgctctacatctttgattgtaatgtccacagctctttcaccagcccttcctgagtcaaatggttttcttccaaagccagtccattttctcttaaaagctggctaagctggaatgagaagggtaaatcaagcccaattcgaacaagttctttattcaatttaaaaatctcttcaggcggcccttcagcatattttttaccgccattcatgacaatgatcctgtctgcttttgctgcctcattcaggtcatgtgtaatggatatgacagtcgccatgccctgctcttttaaatgtcttaccgtttcaagcacttcttctcgcccgatcggatcaagcatggatgttgcttcatctaagataataatatcaggacgtgcggcaataacccccgcaatcgcaactctctgcttttggcctccggagagatggtgcggctcttgatcgagaaaatcttgcatattcacctgttttactgcccagtctactctctcaatcatttcttcccgcggtacaccattgttttctaaaccaaaagccacatcatcgcgaacagtcgttccgacaaattggttatccggattttgaaagaccatacctatcttcttacgcacttcccaaacagattcctctgtcaattgaatcccggcaacctcaatgtcgcctgattcaggaagaattaaaccattcaatgcccgggccagtgttgatttccctgaaccgttatgacctacgattgcaagccattcaccctcatacacctgcagggagacgccgtctagtgctcgtctttctgcgtccttccgatatcgaaatacgatatcctctaccgatatcaactgattttgattcatggaaaaccggcctcctctcagctaatgctctgcttttctctctattaaaagttgcagtatctaaaaaaagggcatagatccagttagaaactgtcccgcccttctttagatacacaaaaatatgtgattaaaccaattcgataattgccattggtgctccgtcaccacggcgaggaccaagcttcataatacgtgtgtatccaccttggcgctcctcgtaacgagttgcaatgtcagagaataatttttgaagtgcatcttgattattttcttcgtttgcaacctcgttgcggatgtatgcagcagcttgacggcgagcgtgaagatcaccgcgtttgccaagcgtgatcattttttcaactacagagcgaagttctttcgcacgtgtttcagttgtttcgattctttcgttgatgatcaaatcagttgtaagatcacgaagcatagctttacgctgtgcactcgtacgtcctagttttctgtatgacatgtgatgtcccctcctttattggaatgctgtttctgaataataaacacacgaaaatcctagttcacaagggaaactagtcaatcgtctttgcgaagtccgagtccaagttcttctagtttcgctttcacttcttcaagtgatttgcgtcctagatttcgaactttcatcatatcttcttccgtcttgttcgcaagctcttgaaccgtgttaatacccgcacgctttaagcagttgtaagaacgaacagaaagatccaattcttcaattgtcatttcaagaactttctctttttgatcttcttctttttcaaccatgatttcagcatgttgagcttcgtcagttaaaccaacgaatatattaaggtgttcagttaaaatctttgaaccaagcgcaattgcttctttcggtccagtgcttccatcagtccaaacatcaagtgtaagtttatcatagtttgcaacttggcctacacgagtgttctctacctgataagatacacgagaaactggcgtatagatagaatcgatcggaatcacgccgattggctgatcgtctctcttgtttgcgtcagcaggcgtatacccacgtcctctttgagcagtaaggcgaactcggaaactcgcattctcaccaagagtcgcgatatgaagatcaggatttaagatctctacatcactatcgtgtgtaatatcagctgccgttacagttccttcaccctgtacatcaatttctagcgtcttctcttcatcagagtagattttcaatgcaagctttttaatgtgtaagataatcgttgtaacatcttccacaacgccttcaattgtcgagaattcgtgcagtacaccatctatctggattgatgttacagcggcaccagggagtgaggataagaggatacgacgtaaggagttacccagagttgtaccatatccacgctcaagtggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccgttatgaggaacaggagttacgtctctgatagcagtgacttctagtccagcagcttgaagtgcacggattgcagcttcacggcctgaaccaggtcctttaacagtaacctctagagttttaagaccatgttcgattgaacctttagcagctgtttctgcagccatttgcgcagcaaaaggagtagatttacgagaacctctgaatcctaaagctccggcactagaccaagaaatagcattaccatgagtgtcagtgatcgtaacgatcgtgttattgaaagttgaacgaatatgagcaattccagactcaatattctttttcacgcgacgtttacgcgtgttagatttacgagcagcagccattgtttaagaacctcccttacttattttttcttgttagctacagtacgacgcggacctttacgagtacgcgcgttgtttttagagttttgtccgcgaacaggtaatcctctgcgatgacggattccgcggtagcttccgatttcgatcagacgtttgatattaagagaaacttcacggcgaaggtcaccttctactttcagtttgtcaataatatcacggattttaccaagttcttcttcagtaagatcgcgcacacgagtatcttctgaaactccagcttcttttaaaacttgctgagccgttgtgcggccaattccgaagatgtatgttaaagaaataacaacacgtttgtcacgtgggatatctacaccagcaatacgagccattctctgggcacctccttataaattatccttgtttttgtttatgctttggattttcacagatcaccattacttttccttttctgcgaataactttacatttttcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacatgagccaaaacagtgtggccattttcaagttcaactttgaacatcgcgtttggcagtgtttcgactatagtaccttccacttcaattacatcgtctttcgccattcaagtgttctcccttcttcaaatcagtaacttgctttctgacaaatttcaaaagaagtttgtcacacgccctgtttcgtttatactgttctgaacttccggagatacgcaatcataaagggttaaatgattgatattctttttcttaggagaatgaaatgtacgcttttctccgtctgctgttagtacattgatgatggttaaaattccaacgacaagaagcaagatgaattcggtcttgccaatgttcacccaagctttctgccctatcaagcttgaaaaacatctgtcttcggaattattttcatcatctagactctcgtcagtatatcaaaacccgtttccgtaatcgcaatcgtatgttcaaaatgagcacactttttcccatctaccgttacaaccgtccagttatcagccaatgttttcacgtagcggctgccagcgttcaccataggttcaatagcgagaaccatgccaggtttaagccgtggtcctttgttgggcggaccgtaatgaggaatttgcgggtcctcatgcaagtcttgaccaacaccatgtccgacatactccctaacaactgaaaactgctcattttcgacatacgtttgtattgcgtgggaaatattcgacaaacgttcacctggttttgcttcctgcaagcctttatataaagactcctctgtcacttccagaagttttttgtcatcatcgctgatgtttcctaccggatatgtccatgcagagtcaccatgataaccatttaatttagcaccgatatcaatactgatgatgtcaccgtccttcagcaccctgctgccaggtatgccgtgaacgagttcttcattaactgatacgcaaatgctcccgcgaaacccattataccccttaaaagatgggattgcaccctgcttcttaataaaacgttcggcaatttgatccaattcttttgtcgagattcctggtttaatgtgcttttttaactcttcatgagttaaagccacgattcgccctgcttcccgcatgataccaagttcacgtggggttttacagataatcatttttttaatcctccaagaagatccttcacatctgcataaacgtcttgaatgtcctgctggccattcacgtttgcaagataacctttctctgaatagaaatcgagtaaaggctgagtttgcttcatgtttacctcaagccgtttagagactgtttcctcattatcatctgcccgttgatagagttcgcctccgtctttatcacaaatacccggcgttttcggcggattaaagactaaatgataggttgtgccgcaaacactgcaaattctgcgtccagtcagacgttccatcagaacatctttgtcgacttcaatgttaatgacataatcaatcggcttgccgtattcctcaagaatttcttcaagagcttcggcttgagcgactgttcgcggaaatccgtccagaagaaaacctctttcacaatcatctttgccaagtctctcttttacaattccgattgtgacttcgtcaggtacgagctctcccttatcaatataagattttgcttcgagtccgagtggtgtttcttctttcatagcagcacggaacatatctcctgttgagatatgaggaatcccataatcctcaacaattcgttcgccctgtgtgcctttaccggcaccaggaagccccattaagactaagttcattcggatttcccccgtcctctctttattaagagggaatggataaatccatttcctctagtttttcataaatccacggtagtttcgtttcaccaactggctttctagttgtttcattgtctccaaggctaccccgacaacaattaacaaagatgttccgccaatttgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgttttttaaggttatcagccatttgttcagggtttacctgtacaaaagcataaaagtacgtaaaggcaataatcaacgcaacatatatcgccatacccaccggatgcgtattatcaaagttgttttgaatccactttgtcacatcgtttgttccaaagaatgacgcgatcgtccgcggcgttatcaaaaacgcaaccgcaaagattaccggaataacccctgcaggattcactttcaatggaaggtgtgtagactgacctccgccagcaggtgaacgacctgtgcctttagcatattgaatcgcaattttccgtacggcttgctgaatgaaaataactccaacaataactgctaaaatcgcaatcacaagaagtgcgactttcacaatatgaataaacaactgatcgttgctgccgacaaattgagtctcatatatttgcccaattgtttttggaatactagacacaatccccgcgaagataatgatcgatattccgttgcctactccatgagaagtaatttgttccccaagccacattaaaaaggcagttccgccagtgagcactaaagcaatgataagatatgtcgatacaccggatttttcgatcagcataccgtttgccagattgttgaatccatatgacatacctaacgcttggatgaaaccaagcacaatcgtaaagtaccttgtgaactgagctaatttacggcggccaacttcaccttgcttagaccactcggtaaacttcggtaccacatccatctgaagcagctgaatgatgatcgaagccgtgatataaggagtaattcccattgcgaaaatggaaaattggtaaagcgcaccgccgccaaatgtattaaggagatcaaaaacacccatttgagactgtgcctgtaacgcttcagcgttaacgtaaggcacaggaataaacgcacctatgcgaaagacgataagcatgagtaaagtgaatatgattttattcctgatatcactcacacgcataaagttggagattgttttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctctagaagaagttcaggagtgacttccgttccttctgcaaaaccgttcaatttgtctaggttgactacagcgtattccttgcggttgatgttagtgaaaccacgtttaggaagacgttggaataaaggcatttgtcccccctcgaatccagggcgtacaccgccgccagaacgagcgttttgacctttgtgacctttaccagctgttttaccgttgccagaaccaataccacgacctacgcgattacgcgttttgcgtgaaccttctgaaggttttaattcatgaagtttcattaggacacctccttatccgatcaaatatttttattgttctttaacagaaactaaatgagatactttattaatcataccacggatcgcagcgttgtcttcatgaacaacagtttggtttgttttctttaaaccaagtgttcttacagtaacgcgttggtcttccgggcgaccgattacacttcgtttgagggtaatttctaatttagccattaatgttccctccttatcctaacagttcttctacagattttccacgaagcttcgcaacgtcttcagcacgtttaagttcacttaaaccttgaagtgttgcacgaatcatgttgatcggtgtgttagaacctaaagacttagaaaggatatcagctacaccagctagctcaagtaccgcacgtacagggcctccagcgataactccagtaccttcagaagcaggttttaacaagatgttacctgcaccgaaacgtccgatgatttcgtgtggaattgtagttccaaccattggtacttcaatcaaattctttttcgcatcttcaacagctttgcgaatcgcttctggtacttcttgtgctttaccagtaccgaatcctacgtgtccgtttttgtcaccgacaacgactagagctgcgaagcggaaacgacgaccacctttaacaactttcgctacgcggttaaccgtaactaagcgttcttctaactctaatttgcttgggtcaatacgacgcataatcatgtgtccctccttcttttattaaaatttaagtccagcttcacgagcggcatcagccaaagcttttacacgtccatggtataagtatccgccacggtcaaatactacgtcagaaatgcctttttcagcagcgcgttttgcaactaattctccaactttagtagcagcagaagtatctccagtgctttcaacgttcaagtctttatcgagagtagatgcactagcaagtgttacaccatttacatcatcgatgatttgagcgtaaatgtgcttgttagaacggaaaacgttcaggcgcggtctttcagcagtaccggaaagtttagcgcgaacacgagcgtgtcttttaagacgagcagcatttttgctagttttcgtaatcatctaggtcactcctttcttcactttaagcgatcttacttagcagatttaccttctttacggcgaacaacttcaccttcgtagcggattcctttacctttgtaaggctctggagaacgtacagcgcggatgttagcagcaatagctcctacgcgttctttgtctgtaccttttacaactacttttgtttgagaaggaacttcgatttcgatgccttcttcaggaacgatctcaacaggatgagagtatccaacgtttaaaacaagtttatttccggatttagaagcacggtaaccgacaccgactaattccaaacctctttcaaatcctttagatacaccttcaaccatgttgccaagcagactgcgagtcgtaccatgcagggcacggtgctctttttgatcagaaggacgagcgactgtaagcacattgtcctctactttaatctccatatcagggtgaaacgtacgagttaattctccttttggtcctttcacagctacagtgttgttatcatttaacgttactgtaacatcagaaggaatctcaagtagcttcttacctacacgagacataccaaacacctccattcatgttaaacttcttaccaaacgtatgctagaacttctccaccagcttgttttgcacgggcttctttgtccgttaaaacaccttgtgatgtagaaataatcgcgattccaagaccgttaagtacgcggggtacttcattagatttagcataaacacgcaaaccaggcttgctgattcttttaagaccagtgataacgcgctcgttgttttgtccgtatttcaagaaaacgcggataataccttgtttgctgtcttctacgaactcaacgtcacgaatgaaaccttcacgctttaaaatttcagcaatttctcttttcaatttagaagcaggaatttcaagcttctcatgacgtaccatgtttgcattgcgaatacgagttagcatatctgcaattggatctgtcataaccattatataattacctccttccctttcttggggattaccagctggcttttttcacgccaggaatttgtcctttatatgcaagctcacggaaacaaatacggcaaagtttaaatttacgaatgactgaatgcggacgtccgcagcgttcacagcgtgtgtactcttgtactttaaactttggtgtacgttgttgtttcgcaatcatagactttttagccacgatttcgcctccctttcattgattatttctggaacggcatacctacttgagttaatagctcacgagcttcttcgtcagtattagcagttgttacgataacgatgtccattccgcgaacctttgttactttatcgtagtcaatttcagggaagattaactgttctttgataccaagtgtgtagttaccgcgaccgtcgaaagattttttagaaaccccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcctcaacagcactgtcgattgctttggcgttttgaacagcgtcaccaacacccatgttgattacgattttttcgattttaggcacttgcatgactgaatcatagttgaacttagtcattaaagcaggtgcaatttctttattgtacttttctttaaggcggttcatgagatagacctcccttccttttaatactatttatctagaacttgcccagatttttttgctacacgaacttttttgccatcttccactttgtatcctacgcgagtcacttcacctgttttaggatcgagcggcataacgtttgatacatgaattggcgcctcttgattagaaataccgccttgagggttagcttgagttggtttagagtgtttctttaccatgttaacaccttcaactaaaacgcggtcctttttagggaaagcagcaaggattgttccttgtttgcctttatctttaccagagataaccataactttatcgcctttttttacatgcatcctgatcgcacctccttgagtaaggcatttatttcaattagataacttctggagctagagaaacaattttcataaagttgttttcacgcaattcacgagcaactggtccgaagatacgagttccgcgtgggctcttgtcgtcacggatgataacacatgcattctcatcgaagctgatgtatgaaccgtcacttctgcgcgctccgcttttagtgcgaacgataacagcttttacgacttcaccttttttgacaacgcctcctggtgttgcttgtttaaccgtgcaaacaattacatcaccaatgttagctgttttacgtccagaaccaccaagaactttaatagtaagtacttcacgtgcgccagagttgtcagctacttttaaacgagtctcttgttgaatcattatttgttacctcccttcggaaaaagaattccgaactttattagataataacagcttcttcgacaacttcaactagacggaaacgcttagttgcagacaatggacgagtttccatgatcttaacgatgtcaccgattttagcttgattattttcatcatgtgctttgaatttttttgagtattttacgcgtttaccgtaaagtgtatgttttttgtatgtctcaacaacaacagtaatggttttatccattttgtcagaaacaacacggccttggtaaactttgcgttggttacgttcgctcatgctcacgacctcccctcagtgattatttattagcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaaggcgaagcgcttcacgagcaacctcttcagacacaccagaaatttcaaataaaactttgcccggttttacaacagctacccaaccttctggagcccctttaccggatcccatacgtacctcaagtggtttagcagtgtaaggtttagaagggaaaattttgatccaaactttaccgccacgtttcatgtaacgagtcatcgcaatacgtgcagcttcgatttgacggttagtaatccaagaagcttctagagcttggataccgaattctccgaaatgtacttcagtaccgcctttcgcacggccacgcatttttccgcgatgctctctgcgatatttaacgcgttttggtaataacatattattttcctccttcctcatttttcttcttagtaggaagaacctctccacgatagatccagacttttacaccaagcttaccgtaagtagtatcagcttcagatgttgcatagtcaatgtccgcacgtaatgtgtgcaatggaacagttccttcactgtagtattcagaacgagcgatatctgcaccgccaagacgaccagaaaccattgttttcacaccttgtgctccagcacgcatagtacgttggatttgttgtttctgcgcacggcggaaagaaacacggttttctaattgacgagcgatgttgtcagcaactagctgtgcatcaagatctgctcttttgatttcaagaatgttaatgtgtacacgcttgccagtaaggctgttaagggctttgcgaagtgcttcgacttcagaaccgcctttaccgataaccataccaggcttagctgtgtggatcgtaatgttaacgcggtttgctgcacgctcaatttctactttagaaacagaagcgtcagaaaggcgtttgctaatgtattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgtgggcggaatctttttaacgtagggccttcgtcaacgaatgcttgagaaataaccaggttgttagcgtccatttcatagttatgctcagcatttgcaatagcggattttaatactttctcgataattggagaagcagctcttggtgtaaggttcaagattgatactgcctcacctacttgcttgcctcgaatcaggtccattactagacgtgctttacgaggagcaatacggactgttcttgcaacagctttagcttgcatttaaaagcctcctctcttagcgtcttgtttttttgtcatcactagcatgacctttgtacgtacgagttggagcgaattcacccaacttgtgccctaccatatcttcagagatgaatacaggcacgtgtttacgtccgtcatagactgcgattgtgtgaccaataaactgtgggaaaatagtagaacgacgagaccaagtttttacgacttgtttcttgtctgtttcatttaatttctcgattttagtcatcaagtgtccatcgacaaatggtcctttttttaagctgcgagccattttggaacctcccttcgtgattgcactacggtccgaaaagaaccgtagacaaccccgttatttatttttacgacgacgtacgataaatttatcggatttgttctttttcttacgagtcttgaatccaagagttggtttgccccatggagacattggtgatttacgtccgattggcgcacgtccttcaccaccaccgtgtgggtgatcgttagggttcattacagaaccacgaactgtaggacggatgcctttccagcgagaacgtccagctttaccaatgttgataagttcgtgctgttcgttacctacttgaccgatagaagcacggcaagcagaaaggatcatgcgaacttcaccagagttaagacgtacaagaacgtatttaccttctttaccaagaacctgagcagatgtaccagctgaacgtacaagctgtccgcctttaccaggttttaattcaatgttatgcacaactgtaccaacagggatgttgataagtggaagtgcattacctactttaatgtcagcttcaggacctgacatgatttcagtacctacttgaattcctttaggagcaagaatgtaacgtttttctccgtctgcatagttgattagagcgatgttagctgaacggtttggatcgtattcaactgtagcaacgcgtccaggtataccatctttatcgcgtttgaagtcgataacacggtattggcgtttatgtccgccaccttggtgacgtacagtcaatttaccttggttgttacgtccgccttttttgtgaaggggagcaagcaaggatttttccggcttgtcagtcgtgatttcagcaaaatctgaagttgtcatgccacgacgtccattagaggtcggtttatactttttaatcgccattttgaatttccctccttctttttacagataattaagcttcaaaaatttcgatttctttgctgtctgcagtaagttttacgatcgcttttctgcgacggctagtcataccagtgtagcgtccaacacgttttgatttgcctttgtagttcatgatgttgactttgtcaactttcactccaaagatgctttcaaccgcgtctttcacttctgttttgttagctcttacatcaacttcaaaagtatattttttttcagtcattaaatcggcagaacgttcagtaatgacggggcgctttagaacatcacgaggatctttcattatgcaagcacctcctctactttttcaaccgctgcttttgtaatcagaagcttctcgtggttgacaacgtctaaaacgttgattccgttagcttcaacaacagtaactccaggaatgttacgagcagataatgctactgcttcgtttgcatccgcagttacgattaaagcttttttctcaacagataatcctttaaggatagctgccatttcttttgttttagccgtatcaagagtaagatcttcaagaacgatgatgttgttgtcgatcactttagaagacaatactgatttgattgccaagcggcgaacttttttaggtaatttataagaatagctgcgtggtgttgggccgaatacgacaccacctccgcgccattgcggtgaacggattgaaccttgacgggcacgtccagtacctttttgacgccatggtttacgacctccgccgcgtacttcagaacgattttttactttgtgagttccttgacgtaaggaagctctttgcataagaatagcgtcgaatacaacactctcatttggttcgataccaaatacagaagcgtttaattcgatgtcaccagcagtagaaccgttttggttgtataatgctacttttggcataatcaatttcctcctttcctaagagaattatttagatttaacagcacttttaacagtgattaaagatttcttcgcaccaggtacgttacctttgatcaaaagaagattgcgttctgcatcaacttttacgatttcaaggttttgaacagtgatttgctctccgcccatacgtccaggtaataatttacctttgaatacacggttaggatctacaggtcccattgaaccaggacgacggtggtagcgtgaaccgtgagacataggtccgcgagattgtccgtggcgcttgatcgcaccttggaaacctttacctttagatactcctgttacatctacgatttctccagcagagaaaatttcaaccttgacttcctgaccaacttcatacgcatccatttccactccgcgtaattctttaacgaagcgcttaggagcagtttccgcttttgcaacgtgccctttttcaggtttgttagaaagcttttcacgcttgtcgtcaaaaccaagctggattgcttcgtaaccgtcgttttcagctgttttcttttgaagaacaacgtttggagcagcctcgataacagttaccggaataagatcaccattctcagcgaatacttgcgtcataccaatttttcttcctaagattcctttggtcattcgtcacacctcctattaagatcattctatattttagaattaaagtttaatttcgatatcgacaccagatggtaagtctaatcgcataagagcatcaacagtttgtggtgttgggttcacaatgtcgattaaacgtttatgtgtacgcatttcaaattgctcacgagaatctttgtatttgtgcaccgcacgaaggattgtgtaaactgatttttcagttggcaacggaatcggaccagatacgctggcaccagaacgttttgccgtttcaacaatcttctctgcagattgatcaaggattctatgatcatatgctttcaaacgaatacgaattttttgttttgccattattttccctccttttcgcctacatcacgttagacagttctccgtgagaaaaacctgaacaccttgccatggcaaagcggccgggtgtgtcagcaacctctcacttcatcgcagtcaaagaccaacatacaccattatacagaaaataggcgcatgttgcaagacttatttaaaatatgcatgatttgcacactttttttattatacaggggtttttcttatttatcaaggatctatcataaatggtgtcgtgcatgccgacttaatgtgttcgcgaataatgatggctcctcaatatgcggggtgtgagctgaattctcaaattgaaaccagcgcttttcaggtgcctcaagttcttgataatactgtttcgatatttctgcaggaacaattaagtcatgtttccctgaaatgaaaacacacggtactttaatagaaggaactgatgtaaaagcattaaaccggtacaactcatcagttaaatgttttttactgaagcgcaatccattaaggaagctgtgcatgttccgcactccatactcattgccagtaagcatttgaaataatacagcgagagattgacgatgacggtgagtgaatcctcccctggttagctcaacacaaaaccgatagataaggtgctggatatcctgcttccaaggcggagcaccaatgaaacgtgtaaggaaagataatatgctggctttttttgattcggaaatttcacgaatatgttgataagcagttgattcttcatcttgcgggttaacaacctggctgattccataatacgtgtaaaataaatcaggacgctgctgcagcacatgaagcgccagtattgatccccaagaatgaccggctaggtaaagttttgattttgaaaaatgagctaaaagccattgagtgacttggattgtatctttaatgaagtgatttattgtcatagagtgatgcgaaattcgcttagaataagaaagccccgatcctctctgatcccaatgaactactgtaaaatactgttccagctctttttgataatgtctaacatatccgatttgcggcgttcccggcccgccatgtaaaaaaagcagcaatggatttttcacgtcaactccattaatcatcagcatttgctttgtatttccaatgcttagttctttcatgattgcgattgatttcttttcaggaatcataaatattaacccctcgaatatgatagatcctattatacaagaaaaagataagcaaacaaaaaacgagacccacaggggtctcgtttaaaaccatactattactcagtgattgtagaaacaacgcctgaaccaacagtacgtccgccttcacgaatagagaaacgagttccttcttcgatagcgattgtagaaataagttcaacgttcatttcagtgttatctccaggcataaccatttctacgccttctggaagatggatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgaccacgttggatttcttcacgagatacaccgcgaagaagggcaccaatgttgtcaccagcttcagcgtaatcaagaagcttacggaacatttcaacacctgtaacagttgttttcttgttctcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaaccgcatccataagttcgaagattttagcttcccactcagcgtctccttcaagagctttaagagcagaacctttaacaactggtacatcatcaccagggaagtcgtattcgctaagaagatcgcgaacttccatttcaactagttcaagaagctcttcgtcgtctaccatgtcgcatttgtttaagaatacaacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtttcagtttcgtactcaacgtgtgcagtagagattgtgataccgcgctcgcgttcttctggagcaccatcaatttgatcgtacgccatagctgtacctttaccagatttcttatgaagtactgttgtgatagcagcagttaaagttgttttaccatggtcaacgtgtccaattgtaccaatattggcatgtgatttggaacggtcgaatttttctttagccattctaaaatcctccttaagagcttttaattagtaatgtatagagtgataggaagtgaaagaaagctttcacttcctcatcttacaatagtagttatacttgagttaagcggcaaaatcaattattcgcctttattttttttgataatttcttctgcgacgctcttcggcacttcttcgtagtgatccatgtgcatagtgaacgtaccgcgaccttgcgtattagaacgaagtgcagtagcgtaaccgaacatttcagcaagaggaaccatagcacgaacaacttgagcgttaccgcgtgcttccataccttctacgcgtccgcgacgtgaagtgatatcacccatgatatctcccatatattcttctggaataaccacttccactttcatgattggttcaagaagaactgggttacatttgctgactgcatttttcaatgccatagaagcagcgactttaaatgccatttcgtttgagtcaacatcatggtaagaaccgtcgaaaagtttagctttaatgtcgataagcgggaagcctgctagtacaccattttcgagtgcatcttccagacctgcttgaacagctgggatgtattcacgaggaacgaccccaccgacaatcgcattttcaaattcaaagccagcgccttcttcgtttggttcgaattcgatccaaacgtgtccgaactgaccgcgtccaccagactgacgtacgaatttaccttcaacttttgcaccggtacggaatgtttcacggtacgcaacttgaggagcaccaacattggcttctactttaaattcgcgtttcatacggtcaacaatgatatcaaggtgaagttcacccataccagagatgatcgtttggccagtttctgggtttgtttgagtacggaatgtaggatcttcttcagcaagtttcgctaaagcgatacccattttatcttggtcagcttttgatttaggctcaatagcaacgtcgataactggttctgggaattccattgactcaaggataacaagatccttctcatcacatagagtatctccagtagttgtatcttttagacctacagcagctgcgatatcccctgcgtatacagtagagatttcttcacggctgttagcgtgcatttgaagaatacgtccaacacgctcacgtttgcctttagtagagtttttcacgtatgaaccagaatcaagtgttccagagtacacacggaagaacgtcaacttaccaacgtaagggtcagtcataactttaaatgctaatgcagagaatggctcttcgtcagaagaatgacgctcaatctcttcatttgtatcaggacgtgtacctttgattgcagcaacgtcagttggtgcaggaaggtagtcaagaacagcatcaagtactagttgaacacctttgtttttgaaggcagaaccaacaagaacagggtagaattcaacatttaatgtacctttacgaattcctgcttttaactcgtcaattgtgatttcttcaccctcaaggtacttatccataagctcttcatcaagctcacatacagcttcaataaggctgttgcgaagctcttcagcttgctctttgtactcttcagggatttcttttgcatcagaacgagttccgaggtcatcttcgtagaaatacgcaacgttttctacaaggtcaatgataccttcgaagttatcttcagcaccgatcggcaattgaattgcatgagcgtttgcttgaagacggtctcttaaagttcctacagagtaaaggaagtctgcaccgattttgtccattttgttaacaaaaacgatacgcggtactccataagttgttgcctgacgccaaacagtttctgtttgaggctcaacgcctgattgcgcgtcaagtacagcaacagcaccatcaagtacacgaagagaacgttcaacttcaactgtgaagtctacgtgtcctggagtatcgatgatgtttacgcggtatcctttccactgtgcagtagtcgcagcggaagtgattgtgataccacgttcttgttcctgctccatccagtccatttgtgaagctccttcatgagtttcaccaattttgtggatacgaccagtatagaacaagatacgttctgtagtagtcgttttaccggcatcgatgtgagccatgataccgatattacgagttttttctaaggagaactctcttgccattgggtaatttctccttccttattaggaaattgtgttttgttaatctataaatcctaccagcgatagtgagcaaatgctttgtttgcttcagccatcttatgagtgtcttcacgtttcttaacagcagcaccagtgttgttagctgcgtcaaggatttcgttagctaaacgctcttccatcgttttttctccacgaagacgagcgtagttaactaaccagcgaagtccaagagtcgtacgacgttcaggacgaacttctacaggaacttggtagttcgcaccacctacacggcgtgcttttacttcaagtacaggcatgatgtttttcaatgcttgttcgaaaacctccattgcatcattgccagtacgttctttaatgatatcgaatgacttgtataggatcgtttgagacttaccttttttaccatcgatcatcattttgttgattaaacgagatacaagcttagagttgtaaatcggatcaggtaaaacatctctttttgctacaggacctttacgtggcatctgaatatcctcccttcatcaattatgcgtattttcgtatattattttgctttaggttttttcgtaccgtatttagaacggccttgtgcacggttttcaactccagcagtatcaagcgcaccacgaacgatgtggtaacgtacccctggtaagtcttttacacgtccgccgcggataagtacaacactgtgctcttgcaggttgtgaccgataccaggaatgtaagcagtaacctcgattccgttagtcaaacgaacacgagcatatttacgaagtgctgagttcggttttttcggtgtcattgtaccaacacgagtacataccccgcgtttttgtggagaagatacgttagtgtgctcttttttaaagctgttgtatcctttgttaagtgcaggagactttgagttttctactttactcacgcgtcctttgcgaattagctgattaattgtaggcatgaatttttcctcccttcattacgttttataacccacatacccaggtggttcatcaaaaggcaaaaaacaatgtctttacacaagatggaatcttacgcaaaaacaaaagtacgttataaaataatggcaacagcggctgctcctacctcaattccgcaggctttgccgagctttttcatggattcaaccattgagacagagataccttgatcttcagcaagtgaaacaacacttgacgtgagtatcggatctgcgtcttttgcaacgactacttcctttactgaacctcgctttagagctttcactgtttgcttcgtaccaataataattgatttggcctgtgatactttatcataagacataaacatatcctccaaagtaacaggtttatttcgagcaccttggttatattatcattctaggagacgaatgtcaacaaggtatgacattttttagattcgttcttctcatagagtgactttttcataaatatatctgctgaaagactgtttttgcagtctttcagcagagttaaatcagttattcaaccgggaccatatcgtcagtcggctgaacatttgatactggttttactttacggtatttcatcattcctgtacctgctggaacaagcttaccgatgataacattctctttcaagccgagaagctcgtcacgcttacctttgatcgctgcatctgtaaggacacgtgttgtttcctggaaggaagcagcagataagaatgaatcagtttcaagagatgcttttgtaataccgagtaagacaggacggcctgtagctggtcggttgccttcaagcaatacctttttgttcgcttcagtaaattggtgaatatcaagcaatgtacctggaagcacatcagtgtcaccggcatcaatcacgcgtactttgcgaagcatctggcgaaccattacttctacgtgtttatcaccgatttcaacaccctgcatacggtaaaccttttgaacctcatggagaagatactcttgaacagtcgtcaggtcagtcactttaagaagttctttcggatcgattgaaccttctgtcagtacttggcctcgagtaattttatctccttccgctactttcaggcgggagttgtaaggtgccgtataagaacgtgtttccactgcgccttgaaccacaatttcctgttgcttatcacgaacttcattgatctcaacgactgtaccgtcgatttctgtaattgttgcctgacctttcggattacgcgcttcgaaaagctcttggatacgcggaagaccctgtgtgatatcgtctccggcaaccccgcctgtatggaatgtacgcattgttaactgtgtaccaggctcaccgattgattgggcagcaatgattccgacagcttcaccgacttcaacatcggagccagttgcaagatttcggccatagcatcgtttacatacaccatgaggcgtattacatgtgaaggcagaacggatccacacttcttcaatgccggcttcgacaatctccagtgctttatcttcatcgatcagttcgttttcattcacaagcacttcacctgtttcagggtgcttcacttgttttcttgcaaaacgtccgattaagcgttcttctaagcgctcaattgtttcagttccttctttaagaggcttagcaagaatgcctcggtcagttccgcaatcagtttcacggatgataacatcctgagcaacgtcaacgagacggcgtgtaaggtaacctgagtcagcagttttaagagcggtatcggcaagacctttacgcgcaccgtgtgtggagataaagtactccaatactgtcagaccttcacggaaacttgatttgatcggcaactcaatgatacgtccagccgggttggccatcaggccgcgcattccggcaagctgcgtaaagttagatgcgttaccacgggcaccagagtcactcatcatgtagatcgggttgagttcatcaagtgatttcatcagtttgccttggataacgtcttttgcagcactccagatagagatgactctctcatagcgttcttcttcagtgataagaccgcggcggaattgcttcataacgttgtcaactttgctttgcgcttcctcaagaatttcttgtttatcatcgagtacgacgatgtcagaaaccccaactgtaataccagctttagttgaatatttgaaacctaggtttttcatgcggtcaagcattttagacgtttccgtaatatggaatcgtttaaagatttccgcgatgattttacccagaatgccttttttaaacggcgcattgattggctgctgtgcgataacagctttaacatcagcacctttttctaagaagaaacggtcaggtgttttctcttcaatgttgctcttcgttggttcattcatgtaagggaatgattccggaagaatttcattgaagacaagcttaccgacagttgtaattaacaattttgagcgctgttcttcggtaaatgtcacattcttaagtgagttagctgcaacagctactctcgtatgaaggtgaacatatccgttttgataagcaagaagcgcttcgtctgtattcttgaagaccataccttcaccgacagcaccggcacgctcaagtgtcaggtaatagttacctagtaccatatcctgagacggtgttacaaccggtttaccatctttagggttcaagatgttttgagcagcaagcatcaagatgcgtgcttcagcttgtgcttcagcagataatggtacgtgaaccgccatttggtcaccgtcaaagtcagcgttgtaagctgtacatacgagcgggtgaagacggattgcgcgtccttcaacaagcgttggttcaaacgcctggatacctaatctgtgaagtgtaggggcacggttcagcagtaccggatgctccttaataactgattctagtacatcccaaacttcaggctgtacgcgctcaattttgcgtttcgcactcttaatgttgtgagcaagacctttttcaacaagttctttcataacgaaaggtttgaaaagttcaagtgccatttccttcggtaatccgcattggtacattttcaaatgaggaccaacaacgattacagaacgtccggagtaatcgacacgtttaccaagaaggttttgacggaaacggccttgcttccctttcagcatgtgagaaagagattttaacggtctgtttccaggacctgttacagggcgtccgcggcggccgttgtcaattagggcatcgacagcctcttgaagcatacgcttttcgttttgaacgatgatgctaggcgcaccaaggtccaaaaggcgtttcaaacgattgttacggttgatgacacgacgataaaggtcattcaaatcagaagtcgcaaaacgtccgccatctagctgaaccatcggtctaagctccggaggaataacaggaagcacatcaaggatcatccaagaaggcttgtttcctgagttacggaaggcttctaaaacttcaagacgtttgatcgcacgagtacggcgttgtccttgtgaagttttcagctcttcttttaacatatcaacttcttttacaagatcgatatcttgaagaagtttatgaattgcttcagcacccatagatgcttggaatttattaccgtatttatcaagataagcacggtattctttctcagacagaagctgtttcttttcaagcggtgtattcgccggatcagttacaacgtaagaagcaaagtaaatgacttcttctaaagcacgaggtgacatatccagcacaagacccatacggcttggaatacctttgaaataccaaatgtgggaaactggggcagccagttcaatgtgccccattctctcacgacggactttagcccgtgttacttcgactccgcagcggtcacaaactacgcctttataacgaactcgcttgtacttcccgcaatgacattcccagtccttagtcggtccgaaaatgcgttcgcagaatagaccgtccttttcaggttttaacgtacgatagtttatcgtttcaggctttttcacttcaccaaaagaccatgaacggattttatctggtgaagcaagaccgatgttcatatactcaaaattgttcacatctagcaaggggcctacctccctttttatcttcggattaaccgatgtcacttgcctttataactagagattattcttttgttactacatcgcgttcaacgtctgcagatgctgtttcttccggctcttcatcacctgataatgccaggccgtcagcttgtttcgcatcttcttcgtcttctaaatctctcatttctatttcttcttcatcaccagaaaggattttgacatccatacctaagctttgaagttctttgattaatactttgaatgattccggaacacctggttcaggaacattgtcgcctttaacgatggcttcgtatgttttcacacgtccaaccacgtcatcagacttaacagtcagaatttcttgaagagtgtaagccgcaccgtaagcttcaagtgcccaaacctccatctcaccaaaacgctgtccgccaaattgcgctttaccgccaagaggctgctgcgtaacaagtgagtaagggcctgtagagcgtgcatgaagtttatcgtcaaccatgtgagccagtttgatcatgtacatgataccgacagatacacggttatcaaacggctctccagtacgtccgtcgtaaagcactgttttggcgtcacgagacatgccggcttcttcaagtgtttcccagacatcctcttctcgcgctccgtcaaatacaggagatgcaatgtgaatgccaaggtaacgagcggccatacccatgtgaagttccaatacctgcccgatgttcatacgtgatggtacgcccagcgggttaagcatgatatcaattggtgtgccgtcaggaaggtaaggcatatcctcttcaggaagaatcttagagataacacctttgttaccgtgacgaccggccattttatccccttcagaaatcttacgtttctgaacgatatatacgcgtactaactggttaacacctggaggaagttcgtctccgtcttcacggttgaagactttaacgtcatggataattccgccgccgccatgaggcacacgaagagaagtatcacgaacctcgcgggctttctcgccaaagatggcgtgaagaaggcgttcttcggcagtcagttcagttacgcctttaggcgttactttaccaacaagaagatctccgtcttttacttctgccccaatacggatgattccgcggtcatcaagattgcgaagcgcatcttcaccgacgtttggaatatcgcgagtgatttcttcaggtccaagtttcgtatcacgtgcttctgattcgtattcttcaatgtggatagatgtataaacatcatccttcactaggcgttcactcatgatgatggcatcctcatagttgtagccatcccacgtcatgaagccgaccattacgttacggccaagtgcaagttcaccaagctccatagaaggaccgtcagcaaggatttctccttttaccacttcatcgccgacacttacgatcggacgctggttgtagcacgtaccttggttagagcggacaaatttcagcaggctgtatttatccaggtttccttttactttttgaccgtctacttcttcataacggcgaacccaaacgtttttggcttctacgcgttcaacgataccagggtgtttacaaataacagcggcaccagagtcttttcctgatacgtattccataccagttccaacaaatggcgcttccggctgcatcaaaggcacagcctgacgctgcatgttcgctcccatgagggcacggttggagtcatcgttttctaagaacgggatacatgctgtcgcagcagatacaacctgcttaggcgatacatccatgtagtctacacgatttctggaaacaacggtgttctccccgcggaaacgagctacgatgctgtcatcaataaaggcgccttcgtcatcaagacgagcattcgcttgagcgacaacatagttatcctcttcatcagcagttaagtaatcgattctgcccgttaccttccctgtttcagggtcaacgcggcgatatggcgtttcaataaagccaaaacggtttacttttgcataagatgatagtgagttgatcaaaccgatgttcgggccctcaggcgtttcaatcggacacatacggccatagtgggagtagtgaacgtcacgcacttccattccggcacgctcacgtgtcaatccgcccggtcctaatgctgacagacgacgcttgtgcgttaattcagcaagcgggttcgtctgatccatgaattgagaaagctgtgagcttccaaagaactctttaatggacgcaataacaggacgaatattgatcagctgctgaggcgtaattgtattcgtatcttgaattgacattctctcacgaaccacacgctccatacggcttaaaccgatacggaattggttctggagaagctcgcctacagaacgtaaacggcggtttccaagatgatcgatatcatctgtgtcgcctactccgtgcagcaggttgaagaagtagctgattgaagaaataatatcagcaggcgtgatgtttttaatctcttcttcgatgtaagcattgccgattacattgataacctgttctccttcttgatcagtcggagcaaagattttaattgattgaagagtcacttcatcttcaacaacgccgccattcggatacagctttctaaaaccgattccgttttctaagtatggcagtactttatcaagcgttcttctatcaagaatctggcctttttcagcaaggatttctcctgtttcaggatcaacaagcgtttcagcaagtctctgattgaagaggcgattcttaatatgaagttttttattaattttatagcgtcctacattggcaagatcgtatcgtttcggatcaaagaaacgagaatcaagcaagcttttcgcattttctactgtaggcggctctccaggacggagacgctcgtaaatttccagcaacgctttgtcgctgttttctgtgttatctttatcaagcgtatttcgcaggtattcgttttctcctatgagatcaagaatctcttgatcggagccgaagccgagagcacgcaaaagaaccgtaaccggcaacttacgtgtgcgatcaatgcggacataaacaacatctttcgcatcagtttcgtattctaaccatgcgccacggtttggaatgacagttgcggtaaaacctttttaccgtttttgtctactttaccactgaaatatacacttggagaccgaacaagctgggaaacgataacacgttccgcaccgttaatgataaaagtacctgtatctgtcataatagggaaatcacccatgaagacatcttggtcttttacctctccagtttctttgttaattaaacgaaccttcactcttagcggagctgagtaagtcacatcacgttcttttgattcctctacaggatatttaggctcacctaaactataatcaatgaactcaagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatttcttccaaagaaagaaaatacttttacaagacaaaagaaaaaagggtttctaattaagaaaaccacatccaaaaacaaataccgattttattagcatttccatacttgtataatttatacatagatattgacaattcatcatatcaagcaaaatatatacattggcattttacaatattaacatagttaaaataccgagtcaaactttttttgcttttatgatataatagcctttctttttttgaacgacggaaacttcatcgaacagttcctcgagcttttcaatggcagaaggcgcgccttgctttttctgtatgacgatccacaattcacctgaagcttttaagtgttcagcgcttttctcaaagatagcatggacaactttttttccggctcggattgggggatttgtaagaatagaagcaaatgtttgagcagaatcaacgtttgaaaacaaatcgctttgataaatcttaacgtttgttattccgttctgttccgcattttcatttgatagttctacggctctctcattaacgtcaatcatgtggatggtccggtctttaaagtcgctggcgagcgataaaccaatcgggccgtatccgcagcctacatctaaaatgccgccctcaacctcaggctcttcaaaagaatcaatcagcaggcgggagccgaaatcaacttcttttttagaaaaaaccccgctgtcgctggtaaacgtgaaatctttattccgaagcctaaaagaccaggtttgcttgttgctttttactgaaggtttttctgaataatagtgctcactcattattagaacctccttttttcatggcttaaagaatggcaaagaaaaagctcgcctcataaaagcgagcttcccctacaggtaagtgaagattacttaacttctacagaagcgccaacttcttcaagtttagctttaagctcttcagcttcttctttagcaataccttctttaagtggttttggagtgttgtcaacaagctctttagcttctttcaagccaagaccagtgatttcacgtacaactttgataactttgattttttgagatcctgcaccagcaaggataagatcgaattcgctttgctcttcagcagctccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgtaattcctccattttgttttaatttatgaaaaactgattagattaagcgccttgttcttccttttgttctgccacagcttttgcagcaagagcaaggttgcgaactggagcttgaagtacgctaagcaacatagaaagcaagccttcgcgtgatggaagttcagcaagagctttcacttcttcaacagtagaaactttaccttcgataacgccagctttgatttcaagagcttcgtgatttttagcgaagtcattaagaactttagccggagcgacaacatcttcagtgctgaatgcgatcgcgttcggtccagttaagaaatcattcaaaccattaagctcagcttgttcaaccgcacggcgagtcatcgtatttttgtaaactttgaactcaacgttagcttcgcgaagctgtttacgaagttcagttacttcagaaacgttaagtccgcgatagtcaacgatgatcgttgatttactttctttcagtttagaagcaatttcttcaacaacaactttttttgtttcaattgcgctgctcatggttacacctcctgtagattcttgtgtaacacttataccgttaggtgatcacgactgagacgacggattccatataaaaagcctccatgagacatggaggctgtatatacaagcatacgtaacgtaatagctgtgataatatacacctcggtaggataattaagcggttaggcccctactgtctacggtataaatgatattctattttacaacattttgaataatatcagaatgttgatgtcatgtcaatattattttacgttaaaagttgaagagtctactttgacaccaggtcccatagtagaagttacagcaacgtttttcacgtaaacgcctttagctgcagcaggtttagctttaaggattgtatcgtacattgttgtgaagttctcaacaagtttttcatcctcgaaagaaactttaccgataggaacatgaatgtttccagctttatcaacgcggtattcaactttaccagctttgatttcgccgatagctttttcaacttcgaaagtaactgtaccagttttagggttcggcattaaaccttttggtccaagtacacgaccgattttaccaacttcacccatcatgtcaggtgtagctacgataacatcgaaatcgaaccagccttgttgaattttgttgatgtagtcagtatcgcctacgaaatctgcaccagcagcttcagcttctttcgctttttcgccttttgcgaaaacgagaacgcgctgagttttaccagttccgtttggaagcacaactgctccacggatttgctggtcgtttttacgagggtcaacccctaaacggaaagccacttcaactgtagcgtcgaatttagctgtgtttgtttttttaacgagagctactgcttcagagacgtcgtaagctttagaacggtctacaagcttagcagcttcaacgtactttttaccttttttagccattttaaaatttcctccttatgtggttatagcggaataacctcccacgaataagggttgcgaacttgttaaaactcgcaacccgacaagaaacaaattaatcctcgattacaatacccatactgcgggcagtaccttcaaccatgcgcattgccgcttcaacgtctgctgcgtttaagtcaggcattttcgtttcagcgatttcgcgtactttatcgcgcttaacggttgccactttattacggtttggttcaccagaaccagactcaattccagctgcttttttaagcaatactgcagcaggtggagtttttgtaataaatgtaaatgaacggtcttcgtaaaccgaaatttcaacaggaatgattaaaccagcttggtcagctgtacgagcgttaaactccttacagaatcccatgatgttaacaccggcttgaccaagtgcaggtccaactggtggtgctgggttagcttttccagcaggaatttgcaattttacaactttaactacttttttagccacgagacacacctccttaagtccgtgatgtggtaatagggtaaaccctcccactcaaggtttcattctttatatgaatgacgaaatatcatgctagttgccttggataagtccaagacgtacctttgctatattatcatttatatatagcaatttcaagttttttcacattacaatttatcgatttgggtaaattccagctcaaccggcgtttcacggccaaacatattaacgaaaactttgaccttgcttttatcataatcaatctcttcaattgatcctgtaaagttagcaaaaggtccgtctattactttcactgtctctttcagttcaaagtcaatatcagtttttcgttcatccatgcccattctcttcagaatggtttctgcttcccccggaagaagcggcgtcggttttgaacctgacccggcagatcctacgaatccagtaacgcccggcgtgttgcggacgacataccaagagtcgtctgtcattacaatttcaacaagcacataaccagggaatactttctttttcacgacttttttcttgccgtttttgatatccgtttcttcttcttcgggtacgactacacggaaaattttatcctgcatccccattgattcaacacgcttttccaagttggcttttactttattctcataaccagagtacgtgtgaacaacataccaattcttttccattctattcaggactgtccagtccttccctccccgcatttggttttagtgaattaccataacgcttcaaaaaataggcggcaagcctatgataactttcattttaagccacaataaaaaacccgctgaacgggttttggcaagtaatattatgatctattatagcacgtattgctgatcattattcaactattaaacgaattaattgagaaattcctgtgtcaaggagggcaaaaaagataacaaaaaagataactgttgaaattaccgtaatggtataacgcgttaactcttttcctttaggccagcttacctttttcatttctttcccaacatctttaaagaatttcataatacgcatgtaaaagacctccacaatttaaaagcgcaaaaactattttgtttcaagatgagctgtatgtgaattgcaagtactgcagtatttctttacttctaatcgctcagccgctgatgcagagctcttcattgtcgtataattacggtttccgcatgtcttgcatgctaacgtaatcttttttctcatgtcattacacctttttctaaatagacattagttcttatctttagtaacatatcatagtcagaaaaatactgtcaatatagcataaattcctattacaaactgatttcgcgaatttccaagtacttctccagcttgcgtttcacacgctgaagggcattgtcgatcgatttcacatgtcggttcagttcatcagaaatctcttggtaacttctcccgtcgagatataagacgagtacttttctctctaaatcacttaatagttctcccattttcatttcaatatcatcaaattcttcctgattaatgatcatttcctcaggatttaaggttttcgctcctgaaatgacatccagcagcgttcggtctgattcttcatcaaagatcggtttatctaatgagacgtaggaattcaaaggaatgtgtttctggcgagtagctgtctttattgcggtaataatttggcgggtaatacataattctgcaaaagctttgaatgaggtaagcttgtcctctttgaagtcacgaatagacttatagaggcctatcatgccttcctgaacaatatcctctctgtccgcccctattaagaaataggatcttgcttttgcccgaacaaagtttcggtacttcgtaatcaagtaatctaacgcatcactgtccccaacatgaaccttttcaatgacctgctcgtcctccaactggcaaaactgctctttgttgaattttcccttgttgttctgtagattcactccgatccccccggcgcacgtagatagaaatattatacagtattgggcaaaaaagcgtcaacttaatctaagtctccccgcctccacttttcaaacgttttcaaaacctcttccgataaagcaattttacccgccggcttttcggaagtgatttttcttacccgtctctctattcgcctttcaatcgtttctacctctctcagaagctcccgggccgatttccgcaatgccccctgtccgaaaatcgcccactgctcagtatagtcagaggtcgcaacgtgaatttgagtcgcaatattattcaaagcctgagcgagcttttctatccgctcatcagccgtctcattttcttttgtaaaaattacttcaactctatggttggtctgttttttctcaagcccttttacgagatgcgcgtcaaaaacaacaataaccctgtttcctgtatacgattgatattccgccattttctgaatcagtacgtctctcgcctcttcaaaactgttcgcttttaaatccttcagctgcggccaggctccaatcatgttgtacccgtctactaacaggatatccatgggtctttattctcccacagggtttcgtttccggtagacttcatacatcaaaagaccagccgcgacagatgcatttagtgaagttacctttccggccatcgggagtttaatgagaaaatcgcacttttccttcacaaggcggcccatcccttttccttcacttccgatgactagagccaaaggcatattgccgtccatattacggaaatcctcacgcgcggacgcatccgttccgacaacccagattccccgctctttcatctcttctaacgtccgtgccaaattggtgactcttgctacaggaatgtgctcaattgctcctgttgaagcttttgccactgttgttgtcagcccgacagctctccgttttggaatgacgatgccatgagcgccgaccgcatctgctgtcctcataatggaaccaagattatgagggtcttcaagctcgtccagaatgaggaagaaaggctgttcatttttttcttcggctgctttatataaatcgtccagttctgcatattcatacgctgcaacctgtgccactacgccctgatgctgtcctgtcaccatttgatcgagtttttttctcgggacgtattgaatcgtgattccctgctttttggcaagctcaatcacttgctgtgcttgtccctttacggtgttttccgccatccacagcttatacagcttccgatcagattttaacgtctcgatcactgcatttttccctatgacgtaatcatgttgctgactcatttgttttcctccctgacgtcccgaattgtatagcttcggctacgagctgactaagtcgttcctcttttttctctagaaaaaggtagcccagaagcgcttcaaatgctgtactgtagcggtacgtctgaacatctgtatttttaggtgttgtccctgacttggcatttctgcctcttttcagcaccgcttcctcttcttccgtaaaaaatgattgattctgcagaaaaaataggatctcagcctgtgactttgctgaaacaatccggcttgatttcttatgaagatcatttggtttggtaaagccctgcttaagcaggtgatgcctgacatacacttcaaaaatggcatcacctatataagcaagcgcaagaccgttaagctgcttagaatcttttatcgtatcaaattcaagcatctgttattctccccgtttccagcgagtgccttgagccgtatcttcaagaatgatattcatgcttttcagctggtcgcggatctggtctgacaatgcaaaatcgcgattccggcgcgcttcatttcgcttttcgattaagtcttcaatctcttgatcgagaagttcctgctcacccaacgaaaaaccgaggacagaaacaatgcggtcaaacatctcaataaacgccgtaatcacatgatcagccgtatgatctttctgaagataataattggcgtgtttcgctaagtcaaacaagactgaaatggcattcgccgtattaaaatcatcgtccatctcttcttcgaatgctttgcggtgttcttcaaccttttcaagccattgatcgtcatcttcggttaaattcgtactgctgttcagacggtgctgaagattgctgtacgctgtttttaaacggctgaacgcgcttttcgtattctccagaagctcttctgaatagttaatcggatggcgataatgaacagatagcataaagaatctcaaaagctgcggatcatgctgtttaatgatgtcatgcacaagcacaaagttgcctagtgattttgacattttttcattatcaatattgatataaccattatgaagccagtacttcgcaaacgttttgcctgtcagcgcctcagattgcgcaatttcgttttcatggtgagggaatgttaaatcctgtccgcccgcatggatatcaatctggtcaccgagatactttttcaccattgctgagcattcaatgtgccagcccggacgccctttcccccaagggctatcccaagagatttctccttcttttgccgctttccacagtgcgaaatcaagagcatcttcttttttctcgccgacccggatgcgtgcacctgatcttagttcatcgattgattgctgagaaagctttccgtacccttcaaatgctctggttttgaaatatacgtcaccttctgattcatatgcgtagccctttttcacgagctgatctacgaattcgataatggcatccatgttctccattactcgcggatgaaggtcggcttttcggcagccgagcgcacctacgtcttcaaagtatgctttaataaaacgctctgaaatggtgggtacatcctcaccgagttcatttgccgctttaattaatttatcgtctacgtctgtgaagttagagacatactgcacatcatagcctttatactctaaatagtttcgaaccgtatcgtaaacgattgccggacgcgcgttcccgatatgaatgtaattgtaaaccgtgggtccgcatacatacattttcacttttccctcttcaagaggaacgaatgtttccttctgtctagtcaatgtattataaagtgtgattgtcatttttgattgatcctttcttttctgtcttcaagttctgccttcagctctaaaatctgctgttccaaagacttaaagcggtcagcaactggatcgggcaaatcctgatggtttaaatcgcgtcttactttcttgccattttgtacaacgacccgtccagggataccgacaactgttgaaaaatcaggaacatcatgcagcactactgaaccagcgccaatctttgagccttcaccgaccgtaatagaaccgagcactttagcacctgtggctatcaatgcgtcatctttaatcgttgggtgcctttttcccttttcttttcccgttcccccgagggtaaccccctgaaaaacggttacgttattgccgatttcacatgtctccccaatgacaacccccatgccgtggtctatgaaaaatcttctcccgattgtagcgccggggtggatttctatcccggtaaaaaatcggcttacttgagatataaggcgtgcaaggaaataaaattttcgtttatataaagcatgtgcaatccgatgcgcccatatagcatgtaaaccggaataagttaaaatcacttcaaaatagcttcttgctgcgggatcttgatcgaacacagtatcaatgtcttctttgagcattctaaaaaacacatgcttccccccgtttctctatctgatttcctctacccaataaaaaaagcgtctctgcatgtaaacatgacagagacgctttaaccgcgcggttccactctgtttgaaaagcagacttctgctctcccaacttcagcctgtaacggcggcggccgcctttgaatactgatttcaaaaaacgttcttcaaaggtcttaagggcgcacttctaaaacccggctcatggatctctctcagccaatgaagatcctttctgtaatggcctaaagctttatactcttccctgtcaacaatcatttatttagatattctttaaacgctgaattgcagtctctttaccgatcaattcaattgattgcggcagttccggaccgtgagtttgccctgttacagcaacacgaatcggcataaacagttttttccctttatggccagtttctttctgcactgctttgatcgatgctttgatattatccggagtgaactcctcaagctcttcaagcttcgctgcgaatgtgctgagcacttcaggaacctgttcttcttccagaacagctttcgcttcttgattatactcgatctcatccgtaaagaacaaatcagtcagctcaacaatttccgcaccgtagcttaattgctcatgatacagggaaatcagtttacgaacccattcttgttcttcagcagaaagctcagtgccaactttgccggctttttgcaaatgcggaagcgtcagttcaacaacctgatcaagatccagcttcttcacatattggttgttaacccattttagcttatgcatatcaaacaaagctggtgatttagataaacgatttacatcaaaaatttcaataaactgctcttttgtgaaaagctcttcttctccaaccggtgaccagcctaacaagccgataaagttgaacagcgcttctggcaggtagccaagctctttgtactgctcgatgaattgaataatggattcatcacgtttgctgagctttttacggctttcgtttacaatcagcgtcatgtgtccgaactgaggaatatcccacccgaatgcttgatagatcataatctgtttcggtgtgttagaaatatgatcctcaccgcgcagcacgtgtgtcattttcattaagtagtcatcaatagctaccgcgaagttataagtaggcgttccgtcctttttcacaataacgaagtcgccgatgccatctgattcaaaagaaatttcgccttttacgatgtcgttgaaggcgatgacttttccttccggcacacggaaacgaatacttggttttctgccttcggcgataaatttctcctgttcttcctgagtcaggtctctgtgttttccggaataacgaggcatttctccgcgggcaatctgttcttcacgctctttttcaagctcttcttccgtacagtaacatttataagcaagccctttttcaagaagctcttcatagtacactttatagatatcgttacgctctgactgacggtatggaccgtactctcctccgacatccacactctcatcccagtcaatacctagccacttcagataattcagctggctttgttctccgccctcaatattgcgctttttatcagtatcctcaactcgaatgataaacttaccgccttgattgcgggcaaataaataattaaaaagcgccgttctggcatttccaatatgcaaatgtccggttggactcggtgcataacggacgcgtacttcgtttcccattttcaaatacttcctttcatgtcatgtatggcctcaggcaaaaatgtatgaatctattctaccaccaaatagacccggcatcaaaacaagttagcctttttgtatcagtactgtcgcctgagccgctattccttccgcccggcctgtaaatccaagcttttctgtcgttgttgcttttacatttacttgagaaacatctgcctcaaggccttcagcaattctttttctcatatcttctatgtacggcagcatcttcggcttttgcgctatgatggtgcaatcaatgttcccaaggacataccccttctgtttcacgattccccagacatgctgaagtaatttgaaagaatctgcgtccttgaactcgggatctgtgtcaggaaaatgcttgcctatgtctccttcacccacagctcccaggcaggcgtcagcgacggtatgcaacaatacgtctgcatcagaatggccaagcagccctttttcgtacgggatttcaattccgccaataatgagaggacggccctccactaattgatgcacatcaaatccttgtccaattctaaacatgtttattcccactttctgattccatgatagcttcagctgacgtcaaatcgtctggcgtcgtcagcttaatatttgtatagctgccttctacaacacggaccgaaccgccctccatctgttcaacgaggctggcgtcatccgtccctaaaaatcccttgcgctcggcctcagcgtgagccttcatcaataaagaaagacgaaaagcttgtggcgtttggacagcccacaagcttgaacgttcaatcgtctcactgacttgtaaatcttgaacgcgtttaatcgtatcttttaccggaacagcaaggatggccgctcctgtctgttccgcctctgcgatcagttcgtcaatttgttcatgttttataaatggacgggcaccgtcatgtacaaggacaatcttttcctgctttacggctttcagccccttatacacactgtgctgtcgctcatctccgcctgcaacaagctcaattgaagtttgaaacgggtaatcggacagcaattgctgaaagtgctcccgctcctgctcgttaatcaccaaaatgattttatcgcactgccggtggctgtcaaacactcttaacgtgtgtatgatcaccgggtctcccttcagctcaatgaacagtttatttctccctgccttcatccgctttccctgtccggctgcaggaatcaccacatcataactcattgtttcttctccctttacagcgccttctccaacagcttaggcttcgcaaaaatcattcgtcccgctgctgtctgcagcacacttgtgacgagtacatcaatatgcttgccgatataattccgtccttcttcaacgacaatcatcgtaccgtcatccaagtaggcaactccctgattatgctctttcccgtccttaatgacctgaacattcatttcctcgccaggaagcacaacaggcttaaccgcattggcaaggtcattaatgtttaatactgctaccttctgaagctcgcacactttatttaaattaaaatcattcgtcacaacgaccccggatgtcagcttagcaagtttgacgagcttgctgtcaacctcctgaatatcttcaaagtcgccttcgtaaatttcaacttcaatgtctaattctttctgaatgcggttcaggatatcaagaccgcggcgtcctctgtttcgttttaaaacatctgaagagtctgcaatatgctgcaattcctcaaggacaaactgcggaatcacgataactccctctaaaaaaccagtctgacaaatatctgctattctcccatcaataataacactagtgtccaaaattttcagcttcttgtcttgaacctcatgttcttcatcagctgttccttttttcttttgcattctggcggaaatggaaaacaggctgatcaattcatcctttttcttaaagcccacctggaagccgagataaccgaggaagaaagccaaaaatacaggaattattgtgctgaatatgcggtaaggtatattgtctaaaggaataacatttacgataagataagcaattataagtccaaaaactaagccaagacttccaaataacaaatctggaaccggcgcttttaacaatgaatcctctatccacttcacccagttcacaacgtattctgtaccccatatactgatgagaaaaaagataattgctcctattgccgcagacgtatatgcgtttgttattaaaggtatgtcctgtatatttaacagtacaaacaattcaggtatcaaaaatataccaacaacgccgccaaaaataatgaagaacgcctgaactattcgttttaacatacccccacctccttttttaacattttaatttcacaaagtcttatgcatcctacgaatatcagaataaacaaaaaccaacattaatatacccgtattcataaggttttaaccgaaatcacagttgtctgtctaaataatgcttctcttgcaggcgttttaatccttttttgattttttgggctcgtacttcaccgattccctctacttcatctaattcttctgcactcgcctcaataatccttggcaggactccaaatgcttctacaacattttcaacaatcggcatcggaagacgcggtatcttatttaacagcctgtatcctctcggcaatacataatcatcaagattagtagaagcagggtaaccgagaagcttatacacaatggaatcatccagcagatcataactggacatatcctgcagctccttcaagagaacaaacggatctttaatcttttcttttacatagtccttaataaataaagcggcctcttcttccatatccgtaatcaattcaatgacttgcagtttgatcagatgcccttctgtccccagctctttgatatacatattaatttcgtttttgattctcagtaccatttcataacgatgcatgacagacaagacatcactgaaggtaacaagttcctcaaactctaacgcgttcagtgcattaatcgttttatcgaggattgtcttatatttttcaagtgtttgaatggcttggttcgccttggttaaaataaatcctatgtcttttagtgtatacttcatgttttcctgatataacgttatgacatttcttctttcagaaatggcgattacaagacagccagtttgcttagctactctttcggcagttctgtgccgcattcctgtttctgatgaagaaattgtggcatccggcatcagctgagtattcgcgtataggatcttttgaccagaatcacttaaaatgatcgctccatccattttagccagctcatataaatgcgccggagaaaaagccgtgtttatgtgaaagccgccgtccaccacttcttttactttatcattatatccaacaacaatcagaccgcctgtatttgctctcaagacgttttccatccccgctctgagcggtgtacccggagcaacaaactgcaatatagatgacaggtctaactcgtgtttcgccccttttttctctttttccatctattatcctcctaatgaagtacgaagcgcttctgcaacatttgctactccgataacctcaatcccttttggttttgtccatccatccagatttgccgcgggtatgatcatgcgtttaaaaccaagctttgccgcttctttcacacgctgttcaattcttgaaacccgccggacttctccggttaatcccacttctccaataaaacaatctgcaggatttggaggtgtgtctctaaagcttgatgcaatactaatcacaatcgcaagatcaattgccggttcatcaagcttaacgccgccagccactttcaaataagcatcctgattttgcagcagcagtccaactcttttttctaacacagccattaacagagaaaccctgttatggtctattcccgttgccatacgccttgggttgccaaaacttgttggcgagatgagtgcctgaatttcaacgagaatcggtctagtgccctccatagaggcagtgatactcgagcctgcggaaccagcagagcgttcttctaagaaaatttccgaaggattcaaaacctcagtgagcccctcttcccgcatttcgaaaatgcccatttcgtttgtagatccgaaacggttttttacagcccgcaaaatacggaaagtatggtggcgttctccttcaaaatataaaacagtgtcaaccatatgctccaacagtctcggacctgcaatagacccttctttcgtcacgtgccctacgataaaaatcggaataccttttgtttttgcaattttcatcagctcagcggtacattctctgacctgtgacacactgcctggagcagatgtaatatcgctttggtaaaccgtttgaatagagtcaacaacgacaaacgatggattcatctcttgtatagcagacgaaatatactccatatcggtttcagataaaacatgcagtgacggattattaatgccgagacggtctgctcgcagcttcgtttgctttacagattcttctcccgaaatatacaggacactgtttgatgagcctgataattgagcggaaacctgcagtaatagcgttgactttccgataccaggatcaccgccaattaaaacgagggagcctttaacgacacctccgccgagtactctgttaaactcgccaagctgggttttgacgcggggttcttctgatgtttcgattgatgtaataggtgaaggtttctgtacagtttgaacagaatgagaaaaagccgctctccgattggccggtgcttttttaatcatttcttccaccattgtattccaagcaccacagcccggacatttccccatccattttggagactcgtagccgcaggattggcagatgaacttcgattttgttttagccatatatagtgtaagacctctcccttgttctatttcttgatatgaaagtgaggcatacacttacatgctgtatgcctcatttccgtcttctatattaattcgttttagcagtcgtttttacgacaaattcgccatcttctacatcaagaacaatatgctgtcctttatgaatatttcctctgaggagttcttcagataaacgatcctcgacatgtttttggatcgctcttcttaacggacgggcaccgtattccaggtcaacgccctcttccgcgactttcgcttttgcagcatctgtcaattcgatagaaagatcttgttctttcaggcgtttcgttaattgatcagacattaatgacacaatctcagtgagatgttttttctcaagtgaatggaagacaatgatttcatcaatacggttgatgaactcaggtctgaacgctcgttttaattcacccatcactttatctttcatgtctttatgattttgagtttcatcctgaacgttaaagccgacatatttattgcgttttagctcacttgctccgacgtttgatgtcatgatcagaatggtattgcggaaatcgactgtgcgtcctttagaatcagtcaatcgtccgtcttcaagaacttgcagaaggatattgaagacatcagggtgcgctttctcgatctcatcaagaagcacgacagagtaaggttttcttctgactttctctgtcaattgaccgccttcatcatatcccacataacccggaggtgaaccaacaagtcttgaagttgaatgtttttccatgtattcagacatatcaattctgatcatggattcttcatcgccaaaaatggattcagcaagtgctcgtgcaagttctgttttacctacacctgtagggcctaagaaaatgaatgagccgattgggcgtttaggatctttcaatcctgctcttgcacgtctgacggcttttgcaaccgctacaactgcttcatcctggccgatgacacgggagtgaagaatgttttccatattgagaagcttatcagtttcagtttgggcgattttagatacaggcacaccggtccagctggatacaaccatcgcaatatcatccacagtaacctctgagttttcctgcccttgcttctctttccatgatttcttcgtatcctctacttgctcgcgcaggcgttgttcagtatcacgcaaggaagcagctttttcaaactcttggctttgcactgccgcatccttctctttacgaacctcatcaagcttctgctcaagctcttttaagttaggaggcgttgtaaatgagcgcagtctcacctttgaacccgcttcatcgatcaagtcaattgctttatccggaaggaagcggtcagaaatatatctgtcagaaagcttaaccgcagcttcaatggcatcatcagtgatagaaacgcggtggtgggcttcgtatctgtcacgcagaccttgtaaaatttgaatactttcatctacagatggctgatcaacctgaatcggctgaaaacggcgttccagtgctgcatctttttcaatatatttacggtactcatcaagagtcgttgcaccaatacattggagttcgccacgagcaagtgaaggttttaaaatattagatgcatcaatagcaccttctgctccgcctgccccgattaatgtatggagctcatcgatgaatagaatgatatttcctgcctggcgaatttcatccatgaccttcttcaggcgatcctcaaattctccgcggtattttgtgccggcaacaactgttcccatgtctaatgtcatcacacgtttatcacgcaaaatttcgggtacttcattattgataatttgctgtgccaaaccttctgcgatagccgttttacctacacctggttccccaatgagaacagggttgtttttcgttctgcggcttaacacttcaatgacacgctggatctccttgcttctgccgattacagggtcaaggctgtcttccttcgcaatagcagttaagtctcttgccaagctgtcaagcgtaggcgtattcgcattgctgtttgttcctgccgctgatgatcctgtttcattacttcctagaagctggagcacctgctgtcttgctttatttaagctgacaccgagattattcagaactctcgcagcaacaccttctccttcacgaatcagaccaagaagaatatgttctgttcccacataagaatgaccgagttttcttgcctcatccattgaaagctcaatgacttttttagctctaggagtataatgaatcgtttgagacatttcctgcccgcgcccgatcaaactttctacttctttctgaattttttctgaaccgagtccaagcgcttgaagagctttagcagcaatgccctctccttctcttaccagtcctaataaaatatgctcagtgccaatgttattatgacctaaccgaagtgcttcttcctgtgctagcgccagtactttttgagctcgttctgtaaatcttccaaacatcatatcgattcatcctcctgtcttttcccattcatttctaagtgaagccgttctctgatgagagccgctcttcgaatgtccctttcgttcggtcgcaaagcgcctcccgagtattgctgtaaaaaccctggctgcgtcaaaatcataagttcgttaagtatgttgcttgaaagtccttttattatgcctaagtctatgcctaaccgaacatctgaaaggcactttgcagtttctttcgattctatcatccggcaattagacaagaccccatatgaccgatatacccgatcctcaagttcgattttagaagtttgataaatcgcttctcgggcagatcgttcttgttcaatcaactgagcagcaacactgttaagatcctctacaatatcctgctctgacttaccaagcgtgatctgatttgaaatttgaaagatattccctactgcttcgctgccttccccataaattcctctaacaactaagcctaattgattaattgccggtataattcgatttatttgcctagttaaaaccagcgccggcagatgcatcatgaccgaagcccttaaaccagtacctacgtttgtaggacagctggttaagtatcctctttgctcattgaatgcataatcaactttttcttcaatccagtcgtcgacctggtttgcggctttcattgcttctaaaagctgaaatccagggaaaagacactgaattctaatatggtcctcttcatttagcatgacgcttacttcctcattttcagaaagcaaacagccgccaaaaggagactctgtcaaattcgggctgattagatgtttttcaacaagtacacgcttttctaaaggctgtgcatcattcattctaatcaaaacaaatttgccgattccgggaatttcttgctctgaaaactgatcttcaaattgctgtatgatggatgaggcttcttcattggaataccgcgtagggaaccgaatatgctcaaagtttcttgctaaacgtatgcggctgctgagtacaatgtcactttcaggtcctttctgcttcatccaactgcttagtgcgtcctgaataaaatgctttagcgacattactcctgttcctcctcactatctgtacttttgagtgattgttctaataaacgaatttgatctcttacatgagctgcattttcaaattcttcttgatggattaaggattctaattccttttttagcatatcaatctgccgtctgacatgaagattgccgcctattcgtttcggtatcttacctgcatgcacagtgtttccgctgtgcactttacgtaggattggtgtaatgttgctatgaaatgttttgtaacattcagaacatccaaaacggccaatttttctgaattgctgaaaagtcattccgcatttcggacaagcagatatttgctccgagtgactgaacatttgagttcctgcattttgaaatgaagaatccatgttcagtaaacccgaaagtaaattatgaatagagaaaccctgatttgcacttataccatatgaatcactattttctttggcacattgttcacaaatatgaacttctattttttctccgttaacaacctttgtaaagtgaaaagtggctggtctctcgtggcactcttgacaaatcaatcttttcacccgcttattttaattttaaagaagtcagcattgccttcatcattctcgctcttaattcatcacgttcaggtaagtcaatgtgtaaaactgagcggtccattacgctgaccatcatttttgcttctctttctgaaattaccttgtcttctaatagccttaaaataatgtcatcagaggctgcttgagacaaatgggtattaatttgagaaattatattattgatcaggacaacttcattgttcattttaattttaatgattctgatgtaaccgccgcccccgcgtttgctctcaacaatatatcctctttcgcttgtaaatctggtgttgatgacataatttatttgggaaggaacgcattgaaatttatctgcaatttcacttcgtttaatctctaaaatttccttgccattttgatctaacactcgttttaaatattgttcaatgatgtcagaaatattatgtcccactcaaccccctcctttactgactttgactatatttgactttaatcttactataagccgtttctcgagaattttcaactttctcgctctatccttcattatttccattttcccggtccacaaaacctgattgctgatttaaaattcggtataaagttattatattatacagttaagtggaattttatgataccaataaaccaaaatacaaaaaacccagctcattgagctgggtttaagc
